United States Patent 11,464,847 (LASSA VIRUS VACCINE) - sequence listing, part 2

SEQ ID NO: 1781 - RNA, 1710 nt, Artificial Sequence
  derived and/or modified CDS sequence (opt3) from Lassa virus__AIT17421__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaacaugaucgggauggucucaggagcacagggcacccagccuggucgggauggggugguacgcguuugggacgugaaaaauccagaucuucugaacaaucaauucggaacaaugccgaguuugacccucgccugucugacuaagcagggccaggucgacuuaaacgaugcugugcuggcacucacagaccuuggccugauuuacaccgccaaguaucccaauagcucugacuuggaucgacuaucccaaucacauccuauccugaacaugguggacauuaaaaagagcagucucaauaucucuggguacaacuuuucccugggagcugccgucaaagcgggugcaugcaugcuugauggcgggaauaugcuggagacgauaaagguuacuccacagaccauggacggaaucuugaaaagcauucucaaggugaaaagaucgcugggcauguucguaucugauacacccggugaaaggaacccuuaugagaacaucuuauacaagauuugucuguccggggacggauggccauauaucgccucacggaccaguauagugggccgugcuugggaaaauacuacagucgaucuagagagcgacggcaagccccagaaaaugggguccgccggaucuaacaagagccuccagucagcagguuuuccuaccggccugacguacagucaacuuaugacuuugaaagauuccaugaugcagcuggacccaagcgcuaagacauggauugauaucgaggggcgcccggaagaccccguggagauugcccucuaccagccuaugucuggaugcuauauccacuucuuuagagaaccaaccgaccugaaacaguucaagcaagaugcgaaguacucacauggcaucgacguugccgaucuuuuucccgcacagccuggucugacaagugcugugauugaggccuugccaaggaauaugguccucacuugucaggggagcgacgauauaaaacggcuguuagacucccagggccgacgcgauaucaagcugauugacaucgcucuaucuaaagccgauucgagaagguucgaaaacgcagugugggaccaaugcaaggaucucugucacaugcauaccggaguaguuguggagaaaaagaagcggggcgggaaagaggaaauaacgccccacugcgcccugauggacuguauuauguaugaugcugcggucagcggaggucuuaauaucccgguguugcgcgcaguccugccuagagacaugguguuuaggaccuccucacccaagguugugcucuga

SEQ ID NO: 1782 - RNA, 1710 nt, Artificial Sequence
  derived and/or modified CDS sequence (opt3) from Lassa virus__AIT17425__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucggaggcgcacaggguacccagccugggcgggauggagugguacgcguuugggacgugaaaaacccagaucuucugaauaaccaauucggcacaaugccgaguuugacccucgccugucugacuaagcagggccaggucgacuuaaaugaugcugugcuggcacucacagaccuugggcugauuuacaccgccaaguaucccaacagcucugacuuggaucgacuaucccaaucacauccuauccugaauaugguggacacgaaaaagagcagucucaacauuucuggauacaauuuuucccugggugcugccgucaaagcgggcgcaugcaugcuugaugggggaaacaugcuggagacuaucaagguuaccccacagacaauggacggcauauugaaaagcauccucaaggugaaaaagucgcuggguauguucguaucugauacucccggggaaagaaauccuuaugagaacauuuuauacaagaucugucuguccggagacggcuggccauauauugccucaaggaccaguaucgugggccgggcuugggaaaacacaauagucgaucuagagagcgacgggaaaccccagaaggugggaaccgccgguuccaauaaaucucuccagagcgcaggcuuuccuacggggcugacuuacucacaacuuaugacauugaaggauaguaugaugcagcuggacccauccgcuaaaaccuggauugauaucgagggacguccggaagaccccguugagauugcccucuaccagccuaugagcggcugcuauauccacuucuuucgcgaaccaacugaccugaagcaguucaagcaagaugcgaaauacucucaugguaucgacguggccgaucuuuuucccgcacagccugggcugacaucagcugucauugaggccuugccaagaaacauggugcucaccugucagggcagugacgauauaaagaggcuguuagacagccagggacggcgagauaucaaacugauugacaucgcucuauccaaggccgauucucgcagauucgaaaaugcaguaugggaccaaugcaaagaucucugucacaugcauacgggcguuguggucgagaagaagaaaaggggagggaaggaggaaauaacaccccacugcgcccugauggacuguauuauguaugaugcugcggugucggguggccuuaacaucccggucuugcgggcagugcugccucgcgacaugguuuuuagaaccagcucccccaaagugguacucuga

SEQ ID NO: 1783 - RNA, 1710 nt, Artificial Sequence
  derived and/or modified CDS sequence (opt3) from Lassa virus__AIT17429__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccgcccagcaacuagagcagagaagggcacuccugaacaugaucgggauggucggaggcgcccaggguacucagccugggcgggauggagugguacgcguuugggacgugaaaaauccagaucuucugaacaaucaauucggcaccaugccgucauugacacucgcuugucugaccaagcagggccaggucgacuuaaacgaugcagugcuggcccucacugaccuugggcugauuuacacagcuaaguaucccaauaguagcgacuuggaucgacuaucucaaucccauccuauccugaacaugguggacaccaaaaagucaagccucaauauuaguggauacaacuuuucucugggugccgcggucaaagcaggcgccugcaugcuugaugggggaaauaugcuggagacgaucaagguuacuccacagaccauggacggcauauugaaauccauccucaaggugaaaagaagccuggguauguucguaucggaugcucccggggaaaggaacccuuaugagaacauuuuauacaagaucugucugucuggagacggcuggccauauauugccucccggacaucaaucgugggccgugcaugggaaaauacuaccgucgaucuagagagugacgggaagccccagaaagugggaacagcugguagcaacaagucccuccagucugccggcuuuccuaccgggcugacguacagccaacuuaugacuuugaaagauucaaugaugcagcuggacccaagugcgaagacauggauagauauugagggacgcccggaagaccccguugagaucgcccucuaccagccuauguccggcugcuauauucacuucuuuagagaaccaaccgaccugaaacaguucaagcaagaugcaaaguacagccaugguaucgacguggcugaucuuuuucccgcccagccugggcugacuucugcugucaucgaggccuugccaaggaauauggugcucacaugucagggcucagacgauauuaaacggcuguuagacagucagggacgacgcgauauaaagcugaucgacauugcacuaagcaaagccgauuccagaagguucgaaaacgcuguaugggaccaaugcaaggaucucugucacaugcauaccggcguuguggucgagaaaaagaagcgcgggggaaaagaggaaaucacgccccacugcgcgcugauggacuguauaauguaugaugcagccgugucugguggccuuaauauuccggucuugcgggcugugcugccuagagacaugguuuuuaggaccucgagccccaaggugguacucuga

SEQ ID NO: 1784 - RNA, 1710 nt, Artificial Sequence
  derived and/or modified CDS sequence (opt3) from Lassa virus__AIT17431__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaacaugaucgggauggucggaggcgcacaggguacccagccugggcgggauggagugguacgcguuugggacgugaaaaauccagaucuucugaacaaucaauucggcacaaugccgucauugacccucgccugucugacuaagcagggccaggucgacuuaaacgaugcugugcuggcacucacagaccuugggcugauuuacaccgccaaguaucccaauaguagcgacuuggaucgacuaucucaaucccauccuauccugaacaugguggacacgaaaaagucaagccucaauauuaguggauuuaacuucucucugggugcugccgucaaagcgggcgcaugcaugcuugaugggggaaauaugcuggagacuaucaagguuaccccacagacaauggacggcauauugaaauccauccucaaggugaaaaagagccuggguauguuuguaucggauacucccggggaaagaaacccuuacgagaacauuuuauauaagaucugucugucuggagacggcuggccauacauugccuccaggaccucaaucgugggccgggcuugggaaaauacaaccgucgaucuagagagugacgggaaaccccagaaggugggaacggccgguagcaacaaaucccuccagucugcaggcuucccuacugggcugacauauagccaacuuaugaccuugaaggauucaaugaugcagcuggacccaagugcuaaaacuuggauagauauugagggacguccggaagaccccguugagaucgcccucuaccagccuauguccggcugcuacauucacuuuuuccgcgaaccaacagaccugaagcaguuuaagcaagaugcgaaauauagccaugguaucgacguggccgaucuuuuccccgcacagccugggcugaccucugcugucaucgaggccuugccaagaaauauggugcucacgugucagggcucagacgauauuaagaggcuguuagacagucagggacggcgagauauaaaacugaucgacauugcucuaagcaaggccgauucccgcagauuugaaaacgcaguaugggaccaaugcaaagaucucugucacaugcauaccggcguuguggucgagaagaagaaaaggggagggaaggaggaaaucacaccccacugcgcccugauggacuguauaauguacgaugcugcggugucugguggccuuaauauuccggucuugcgggcagugcugccucgcgacaugguuuucagaacugccucgcccaaagugguacucuga

SEQ ID NO: 1785 - RNA, 1710 nt, Artificial Sequence
  derived and/or modified CDS sequence (opt3) from Lassa virus__AIT17439__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucggaggcgcacaggguacccagccugggcgggauggagugguacgcguuugggacgugaaaaacccagaucuucugaauaaccaauucggcacaaugccgaguuugacccucgccugucugacuaagcagggccaggucgacuuaaaugaugcugugcuggcacucacagaccuugggcugauuuacaccgccaaguaucccaacagcucugacuuggaucgacuaucccaaucacauccuauccugaauaugguggacacgaaaaagagcagucucaacauuucuggauuuaauuucucccugggugcugccgucaaagcgggcgcaugcaugcuugaugggggaaacaugcuggagacuaucaagguuaccccacagacaauggacggcauauugaaaagcauccucaaggugaaaagaucgcuggguauguuuguaucugauacucccggggaaaggaauccuuacgagaacauuuuauauaagaucugucuguccggagacggcuggccauacauugccucacggaccaguaucgugggccgugcuugggaaaacacaaccgucgaucuagagagcgacgggaagccccagaaaaugggaacggccgguuccaauaagucucuccagagcgcaggcuucccuacugggcugacauauucacaacuuaugaccuugaaagauaguaugaugcagcuggacccauccgcuaagacuuggauagauauugagggacgcccggaagaccccguggagaucgcccucuaccagccuguuagcggcugcuacauucacuuuuucagagaaccaacagaccugaaacaguuuaagcaagaugcgaaguauucucaugguaucgacguggccgaucuuuucucagcacagcccgggcugaccagugcugucaucgaggccuugccuaggaacauggugcucacgugucagggcagcgacgauauuaaacggcuguuagacucccagggacgacgcgauauaaagcugaucgacauugcucuaucuaaagccgauucgagaagguuugaaaaugcaguaugggaccaaugcaaggaucucugucacaugcauaccggcguuguggucgagaaaaagaagcgcgggggaaaagaggaaaucacaccacacugcgcccugauggacuguauaauguacgaugcugcggugagcgguggccuuaacauucccgucuuccgggcaguguugccgagagacaugguuuuuaggacuuccucaccuaaggugguacuguga

SEQ ID NO: 1786 - RNA, 1710 nt, Artificial Sequence
  derived and/or modified CDS sequence (opt3) from Lassa virus__AIT17443__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucggaggcgcacaggguacccagccugggcgggauggagugguacgcguuugggacgugaaaaacccagaucuucugaauaaccaauucggcacaaugccgaguuugacccucgccugucugacuaagcagggccaggucgacuuaaaugaugcugugcuggcacucacagaccuugggcugauuuacaccgccaaguaucccaacagcucugacuuggaucgacuaucccaaucacauccuauccugaauaugguggacacgaaaaagagcagucucaacauuucuggauacaauuuuucccugggugcugccgucaaagcgggcgcaugcaugcuugaugggggaaacaugcuggagacuaucaagguuaccccacagacaauggacggcauauugaaaagcauccucaaggugaaaagaucgcuggguauguucguaucugaugcccccggggaaaggaauccuuaugagaacauuuuauacaagaucugucuguccggagacggcuggccauauauugcuucacggaccaguaucgugggccgugccugggaaaacaccacagucgaucuagagagcgacgggaagccccagaaagugggaaccgcagguuccaauaagucucuccagagcgcuggcuuuccuacggggcugacuuacucacaacuuaugacauugaaagauaguaugaugcagcuggacccauccgccaagaccuggauagauauugagggacgcccggaagaccccguugagaucgcgcucuaccagccuaugagcggcugcuauauucacuucuuuagagaaccaacugaccugaaacaguucaagcaagaugccaaguacucucaugguaucgacguggcagaucuuuuucccgcucagccugggcugacaucagccgucaucgaggcuuugccaaggaacauggugcucaccugucagggcagugacgauauuaaaaagcuguuagacagccagggacggcgagauauaaaacugaucgacauugcccuauccaaggcagauucucgcagauucgaaaaugccguaugggaccaaugcaaagaucucugucacaugcauacgggcguuguggucgagaagaagaaaaggggagggaaggaggaaaucacuccccacugcgcucugauggacuguauaauguaugaugcggcagugucggguggccuuaacauuccggucuugcgggccgugcugccucgcgacaugguuuuuagaacaagcucccccaaagugguacucuga

SEQ ID NO: 1787 - RNA, 1710 nt, Artificial Sequence
  derived and/or modified CDS sequence (opt3) from Lassa virus__AIT17447__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaacaugaucgggauggucggaggcgcacaggguacccagccugggcgggauggagugguacgcguuugggacgugaaaaauccagaucuucugaacaaucaauucggcacaaugccgucauugacccucgccugucugacuaagcagggccaggucgacuuaaacgaugcugugcuggcacucacagaccuugggcugauuuacaccgccaaguaucccaauaguagcgacuuggaucgacuaucucaaucccauccuauccugaacaugguggacacgaaaaagucaagccucaauauuaguggauacaacuuuucucugggugcugccgucaaagcgggcgcaugcaugcuugaugggggaaauaugcuggagacuaucaagguuaccccacagacaauggacggcauauugaaauccauccucaaggugaaaaagagccuggguauguucguaucggauacucccggggaaagaaacccuuaugagaacauuuuauacaagaucugucugucuggagacggcuggccauauauugccuccaggaccucaaucgugggccgggcuugggaaaauacaaccgucgaucuagagagugacgggaaaccccagaaggugggaacgacugguagcaacaaaucccuccagucugccggcuuuccuacagggcugaccuacagccaacuuaugacuuugaaggauucaaugaugcagcuggacccaagugcaaaaacauggauagauauugagggacguccggaagaccccguugagaucgcucucuaccagccuauguccggcugcuauauucacuucuuucgcgaaccaaccgaccugaagcaguucaagcaagaugccaaauacagccaugguaucgacgugacggaucuuuuucccgcgcagccugggcugaccucugccgucaucgaggcauugccaagaaauauggugcucacaugucagggcucagacgauauuaagaggcuguuagacagucagggacggcgagauauaaaacugaucgacauugcucuaagcaaggccgauucccgcagauucgaaaacgcuguaugggaccaaugcaaagaucucugucacaugcauacuggcguuguggucgagaagaagaaaaggggagggaaggaggaaaucacaccccacugcgcccugauggacuguauaauguaugaugcagccgugucugguggccuuaauauuccggucuugcgggcugugcugccucgcgacaugguuuuuagaaccucgagccccaaagugguacucuga

SEQ ID NO: 1788 - RNA, 1710 nt, Artificial Sequence
  derived and/or modified CDS sequence (opt3) from Lassa virus__AIT17451__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaacaugaucgggauggucggaggcgcacaggguacccagccugggcgggauggagugguacgcguuugggacgugaaaaauccagaucuucugaacaaucaauucggcacaaugccgucauugacccucgccugucugacuaagcagggccaggucgacuuaaacgaugcugugcuggcacucacagaccuugggcugauuuacaccgccaaguuucccaauaguagcgacuuggaucgacuaucucaaucccauccuauccugaacaugguggacacgaaaaagucaagccucaauauuaguggauauaacuucucucugggugcugccgucaaagcgggcgcaugcaugcuugaugggggaaauaugcuggagacuaucaagguuaccccacagacaauggacggcauauugaaauccauccucaaggugaaaaagagccuggguauguuuguaucggauacucccggggaaagaaacccuuacgagaacauuuuauauaagaucugucugucuggagacggcuggccauacauugccuccaggaccucaaucgugggccgggcuugggaaaauacaaccgucgaucuagagagugacgggaaaccccagaaggugggaacgacugguagcaacaaaucccuccagucugccggcuucccuacagggcugaccuauagccaacuuaugacuuugaaggauucaaugaugcagcuggacccaagugcaaaaacauggauagauauugagggacguccggaagaccccguugagaucgcucucuaccagccuauguccggcugcuacauucacuuuuuccgcgaaccaaccgaccugaagcaguuuaagcaagaugccaaauauagccaugguaucgacguggcggaucuuuuccccgcccagccugggcugacgucugcagucaucgaggcuuugccaagaaauauggugcucaccugucagggcucagacgauauuaagaggcuguuagacagucagggacggcgagauauaaaacugaucgacauugcccuaagcaaggcugauucccgcagauuugaaaacgccguaugggaccaaugcaaagaucucugucacaugcauacaggcguuguggucgagaagaagaaaaggggagggaaggaggaaaucacuccccacugcgcacugauggacuguauaauguacgaugccgcugugucugguggccuuaauauuccggucuugcgggcggugcugccucgcgacaugguuuucagaaccucgagccccaaagugguacucuga

SEQ ID NO: 1789 - RNA, 1710 nt, Artificial Sequence
  derived and/or modified CDS sequence (opt3) from Lassa virus__AIT17455__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaagugugcucaggguuggaacucugacguccgacgaucugcucaccuuagcggcugaccuggagaaguugaaaucuaaggugauucggacagaacgccccuugagcuccggugucuauaugggcaaccugucaacucagcaacuagagcagagaagggcccuccugaguaugauagggauggugggaggcgcacaggguacccagccugggcgggauggaguaguucgcgugugggacgucaaaaauccagaucuucugaacaaucaauucggcacaaugccgagcuugacccucgccugucugacuaagcagggccagguggacuuaaacgaugcugugcuggcacucacagaccuugggcugaucuacaccgccaaguaucccaauucuuccgacuuggaucgacuaucacaaagccauccuauucugaacauggucgacacgaaaaagaguucucucaauaucuccggauacaacuuuagccugggugcugccguuaaagcgggcgcaugcaugcuugaugggggaaauaugcuggagacuauuaaggugaccccacagacaauggacggcaucuugaaaucgauacucaagguaaaaagaucucuggguauguucguguccgauacucccggggaaaggaacccuuaugagaauaucuuauacaagauuugucugucaggagacggcuggccauauaucgccagucggaccagcauugucggccgugcuugggaaaacacaaccguggaucuagaguccgacgggaagccccagaaaguuggaacggccgguucuaacaagagccuccagucagcaggcuuuccuacugggcugacauacagucaacuuaugaccuugaaagauuccaugaugcagcuggacccaagcgcuaagacuuggaucgauauagagggacgcccggaagaccccguggagauugcccucuaccagccuaugucuggcugcuauauccacuucuuuagagaaccaacagaccugaaacaguucaagcaagaugcgaaguacucacaugguauugacgucgccgaucuuuuucccgcacagccugggcugaccagugcugugaucgaggccuugccaaggaauaugguacucacgugucagggcagcgacgauaucaaacggcuguuagacucccagggacgacgcgauauuaagcugauagacaucgcucuaucuaaagccgauucgagaagguucgaaaacgcaguuugggaccaaugcaaggaucucugucacaugcauaccggcguggucguggagaaaaagaagcgcgggggaaaagaggaaauuacaccccacugcgcccugauggacuguaucauguaugaugcugcggucagcgguggccuuaauauaccgguguugcgggcaguucugccuagagacaugguguuuaggacuuccucacccaagguaguccucuga

SEQ ID NO: 1790 - RNA, 1710 nt, Artificial Sequence
  derived and/or modified CDS sequence (opt3) from Lassa virus__AIT17459__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucggaggcgcacaggguacccagccugggcgggauggagugguacgcguuugggacgugaaaaacccagaucuucugaauaaccaauucggcacaaugccgaguuugacccucgccugucugacuaagcagggccaggucgacuuaaaugaugcugugcuggcacucacagaccuugggcugauuuacaccgccaaguaucccaacagcucugacuuggaucgacuaucccaaucacauccuauccugaauaugguggacacgaaaaagagcagucucaacauuucuggauacaauuuuucccugggugcugccgucaaagcgggcgcaugcaugcuugaugggggaaacaugcuggagacuaucaagguuaccccacagacaauggacggcauauugaaaagcauccucaaggugaaaagaucgcuggguauguucguaucugauacucccggggaaaggaauccuuaugagaacauuuuauacaagaucugucuguccggagacggcuggccauauauugccucacggaccaguaucgugggccgugcuugggaaaacacaaccgucgaucuagagagcgacgggaagccccagaaaaugggaacggccgguuccaauaagucucuccagagcgcaggcuuuccuacugggcugacauacucacaacuuaugaccuugaaagauaguaugaugcagcuggacccauccgcuaagacuuggauagauauugagggacgcccggaagaccccguggagaucgcccucuaccagccuguuagcggcugcuauauucacuucuuuagagaaccaacagaccugaaacaguucaagcaagaugcgaaguacucucaugguaucgacguggccgaucuuuuucccgcacagccugggcugaccucagcugucaucgaggccuugccaaggaacauggugcucacgugucagggcagugacgauauuaaacggcuguuagacagccagggacgacgcgauauaaagcugaucgacauugcucuauccaaagccgauucuagaagguucgaaaaugcaguaugggaccaaugcaaggaucucugucacaugcauaccggcguuguggucgagaaaaagaagcgcgggggaaaagaggaaaucacaccccacugcgcccugauggacuguauaauguaugaugcugcggugucggguggccuuaacauuccggucuugcgggcagugcugccuagagacaugguuuuuaggacuagcucccccaaggugguacucuga

SEQ ID NO: 1791 - RNA, 1710 nt, Artificial Sequence
  derived and/or modified CDS sequence (opt3) from Lassa virus__AIT17463__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcauaaacgagacgauucagaccucaagcgucugagagaucuuaaucaggccgugaacaaucuggucgaacucaagagcacacaacagaaaaguauuuugagggugggaacucugacguccgacgaucugcucaccuuagcggcugaccuggagaaacuuaaaucuaagguuauacggacagaacgccccuugagcuccgguguguauaugggcaaccugucaacucagcagcuagagcaaagaagggcccuccugaauaugaucgggauggucggaggcgcacagaguacccagccuggucgggauggggugguacgcguuugggacgugaaaaacccagaucuucugaauaaccaguucggaacaaugccgagcuugacccucgccugucugacuaagcaaggccaggucgacuuaaaugaugcugugcuggcacucacagaccuuggccugauuuacaccgccaaguaucccaacucuuccgacuuggaucgacuaucacagagccacccuauccugacgaugguggacacuaaaaagaguucucucaauauuuccggguuuaacuucagccugggagcugccgucaaagcgggugcaugcaugcuugauggcgggaauaugcuggagaccaucaagguuacaccacaaacuauggacggaauauugaaaucgauccucaaggugaaaaagucucugggcauguuuguauccgauacccccggugaaagaaacccuuacgagaauauuuuauauaagaucugucugucaggggacggauggccauacauugccaguaggacaagcaucgugggccgggcuugggaaaacaccauagucgaucuagagacggacggcaaaccccagaagguggggacugccggauccucucguagccuccagucagcagguuucccuacaggccugaccuauagucagcuuaugacuuugaaagauuccaugaugcaacuggacccaagcgcuaagacauggauugauaucgaggggcgcccggaagaccccguugagauugcccucuaccagccuaugucuggaugcuacauccacuuuuucagagaaccaaccgaccugaaacaguuuaagcaggaugcgaaguauucacauggcaucgacguggccgaucuuuuccccgcacaaccuggucugacgagugcugucauugaggccuugccaaggaacauggugcucaccugucaggggagcgacgauauaaagaagcuguuagacucccagggccggcgagauaucaaacugauugacaucgcucuaucuaaggccgauucgcgcagauuugaaaaugcaguaugggaccagugcaaagaucucugucauaugcacacaggaguuguggucgagaagaagaaaaggggcgggaaggaggaaauaacuccccacugcgcccugauggacuguauuauguacgaugcugcggugagcggaggucuuaacaucccggucuugcgggcagugcugccucgcgacaugguuuucagaaccuccucacccaaagugguacucuga

SEQ ID NO: 1792 - RNA, 1710 nt, Artificial Sequence
  derived and/or modified CDS sequence (opt3) from Lassa virus__AIT17467__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucggaggcacccaggguacacagccugggcgggauggagugguacgcguuugggacgugaaaaacccagaucuucugaauaaccaauucggcaccaugccgaguuugacucucgcaugucugacaaagcagggccaggucgacuuaaaugaugccgugcuggcucucaccgaccuugggcugauuuacacggcaaaguaucccaacagcucugacuuggaucgacuaucccaaucacauccuauccugaauaugguggacacuaaaaagagcagucucaacauuucuggauacaauuuuucccugggugccgcugucaaagccggcgcgugcaugcuugaugggggaaacaugcuggagaccaucaagguuacaccacagacuauggacggcauauugaaaagcauccucaaggugaaaaagucgcuggguauguucguaucugauacccccggggaaagaaauccuuaugagaacauuuuauacaagaucugucuguccggagacggcuggccauauauugcaucaaggacaaguaucgugggccgggccugggaaaacaccacggucgaucuagagagcgacgggaaaccccagaaggugggaacugcugguuccaauaaaucucuccagagcgccggcuuuccuacagggcugaccuacucacaacuuaugacuuugaaggauaguaugaugcagcuggacccauccgcaaaaacauggauagauauugagggacguccggaagaccccguugagaucgcucucuaccagccuaugagcggcugcuauauucacuucuuucgcgaaccaaccgaccugaagcaguucaagcaagaugccaaauacucucaugguaucgacguggcggaucuuuuucccgcccagccugggcugacgucagcagucaucgaggcuuugccaagaaacauggugcucaccugucagggcagugacgauauuaagaggcuguuagacagccagggacggcgagauauaaaacugaucgacauuucccuaucuaaggccgauucgcgcagauucgaaaaugcuguaugggaccaaugcaaagaucucugucacaugcauacaggcguuguggucgagaagaagaaaaggggagggaaggaggaaaucacuccccacugcgcccugauggacuguauaauguaugaugcagccgugagcgguggccuuaacauuccggucuugcgggcugugcugccucgcgacaugguuuuuagaaccuccucacccaaagugguacucuga

SEQ ID NO: 1793 - RNA, 1710 nt, Artificial Sequence
  derived and/or modified CDS sequence (opt3) from Lassa virus__AIT17471__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucggaggcgcacaggguacccagccugggcgggauggagugguacgcguuugggacgugaaaaacccagaucuucugaauaaccaauucggcacaaugccgaguuugacccucgccugucugacuaagcagggccaggucgacuuaaaugaugcugugcuggcacucacagaccuugggcugauuuacaccgccaaguaucccaacagcucugacuuggaucgacuaucccaaucacauccuauccugaauaugguggacacgaaaaagagcagucucaacauuucuggauacaauuuuucccugggugcugccgucaaagcgggcgcaugcaugcuugaugggggaaacaugcuggagacuaucaagguuaccccacagacaauggacggcauauugaaaagcauccucaaggugaaaagaucgcuggguauguucguaucugauacucccggggaaaggaauccuuaugagaacauuuuauacaagaucugucuguccggagacggcuggccauauauugccucacggaccaguaucgugggccgugcuugggaaaacacaaccgucgaucuagagagcgacgggaagccccagaaaaugggaacgacugguuccaauaagucucuccagagcgccggcuuuccuacagggcugaccuacucacaacuuaugacuuugaaagauaguaugaugcagcuggacccauccgcaaagacauggauagauauugagggacgcccggaagaccccguggagaucgcucucuaccagccuaugagcggcugcuauauucacuucuuuagagaaccaaccgaccugaaacaguucaagcaagaugccaaguacucucaugguaucgacguugcggaucuuuuucccgcccagccugggcugacgucagcagugaucgaggcuuugccaaggaacaugguccucaccugucagggcagugacgauauuaaaaagcuguuagacagccagggacggcgagauauaaaacugaucgacauugcccuauccaaggcugauucucgcaaauucgaaaaugugguaugggaccaaugcaaggaucucugucacaugcauacaggcguuguggucgagaagaaaaagagagggggaaaagaggaaaucacuccccacugcgcccugauggacuguauaauguaugaugcagccgugucggguggccuuaacauuccggucuugagggcugugcugccucgggacaugguuuuucgcaccagcucccccaaggugguacucuga

SEQ ID NO: 1794 - RNA, 1710 nt, Artificial Sequence
  derived and/or modified CDS sequence (opt3) from Lassa virus__AIT17475__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaagugugcucaggguuggaacucugacguccgacgaucugcucaccuuagcggcugaccuggagaaguugaaaucuaaggugauucggacagaacgccccuugagcuccggugucuauaugggcaaccugucagcccagcaacuagagcagagaagggcacuccugaguaugauagggauggugggaggcgcccaggguacucagccugggcgggauggaguaguucgcgugugggacgucaaaaauccagaucuucugaacaaucaauucggcaccaugccgagcuugacacucgcuugucugaccaagcagggccagguggacuuaaacgauacugugcuggcacucacagaccuugggcugaucuacaccgccaaguaucccaauucuuccgacuuggaucgacuaucacaaagccauccuauucugaacauggucgacacgaaaaagaguucucucaauaucuccggauacaacuuuagccugggugcugccguuaaagcgggcgcaugcaugcuugaugggggaaauaugcuggagacuauuaaggugaccccacagacaauggacggcaucuugaaaucgauacucaagguaaaaagaucucuggguauguucguguccgauacucccggggaaaggaacccuuaugagaauaucuuauacaagauuugucugucaggagacggcuggccauauaucgccagucggaccagcauugucggccgugcuugggaaaacacaaccguggaucuagaguccgacgggaagccccagaaaguuggaacggccgguucuaacaagagccuccagucagcaggcuuuccuacugggcugacauacagucaacuuaugaccuugaaagauuccaugaugcagcuggacccaagcgcuaagacuuggaucgauauagagggacgcccggaagaccccguggagauugcccucuaccagccuaucucuggcugcuauauucacuucuuuagagaaccaacagaccugaaacaguucaagcaagaugcgaaguacucacaugguaucgacgucaccgaucuuuuucccgcccagccugggcugacgagugcagugaucgaggcuuugccaaggaauaugguacucaccugucagggcagcgacgauauuaaacggcuguuagacucccagggacgacgcgauauaaagaucauugacaucgcccugucuaaagcugauucgagaagguucgaaaacgccguuugggaccaaugcaaggaucuaugucacaugcauacaggcguggucguggagaaaaagaagcgcgggggaaaagaggaaauaacuccccacugcgcacucauggacuguauuauguaugaugccgcugucagcgguggccugaauaucccggugcuucgggcgguuuugccuagagacaugguguuuaggaccuccucacccaagguaguccuguga

SEQ ID NO: 1795 - RNA, 1710 nt, Artificial Sequence
  derived and/or modified CDS sequence (opt3) from Lassa virus__AIT17479__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcgugcucaggguuggaacucugacgagugacgaucugcucaccuuagcggcugaccuggagaaacuuaaguccaaggugauucggacagaacgccccuugucuagcggugucuauaugggcaaucuguccacucagcaacuagagcagagaagggcccuccugaacaugauagggauggugggaggcgcacaggguacccagccugggcgggauggaguaguucgcgugugggacgucaaaaauccagaucuucugaacaaucaauucggcacaaugccgucauugacccucgccugucugacuaagcagggccagguggacuuaaacgaugcugugcuggcacucacagaccuugggcugaucuacaccgccaaguaucccaauaguagcgacuuggaucgacuaucucaaucccauccuauucugaacauggucgacacgaaaaagucaagccucaauaucaguggauacaacuuuucucugggugcugccguuaaagcgggcgcaugcaugcuugaugggggaaauaugcuggagacuauuaaggugaccccacagacaauggacggcaucuugaaauccauacucaagguaaaaagaagccuggguauguucgugucggauacucccggggaaaggaacccuuaugagaacaucuuauacaagauuugucugucuggagacggcuggccauauaucgccucccggaccucaauugucggccgugcuugggaaaauacaaccguggaucuagagagugacgggaagccccagaaaguuggaacggccgguagcaacaagucccuccagucugcaggcuuuccuacugggcugacauacagccaacuuaugaccuugaaagauucaaugaugcagcuggacccaagugcuaagacuuggaucgauauagagggacgcccggaagaccccguggagauugcccucuaccagccuauguccggcugcuauauccacuucuuuagagaaccaacagaccugaaacaguucaagcaagaugcgaaguacagccaugguauugacgucgccgaucuuuuucccgcacagccugggcugaccucugcugugaucgaggccuugccaaggaauaugguacucacgugucagggcucagacgauaucaaaaagcuguuagacagucagggacggaaagauauuaagcugauagacaucgcucuaagcaaaguugauucccgacgcuucgaaaacgccgugugggaccaaugcaaggaucucugucacaugcauaccggcgucguggucgagaagaaaaagagagggggaaaagaggaaauuacaccccacugcgcacugauggacuguaucauguaugaugccgcugugucugguggccuuaauauaccgguuuugagggcggugcugccucgggacaugguauuucgcacuucgagccccaaggucgugcucuga

SEQ ID NO: 1796 - RNA, 1710 nt, Artificial Sequence
  derived and/or modified CDS sequence (opt3) from Lassa virus__AIT17491__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauggagaccucaagcgucugagagaucuuaaccaagccgugaauaaccuggucgaauugaagucgacacagcagaaaucagugcucaggguugguacucugacgagcgacgaucugcucaccuuagcggcugaccuggagaaacuuaagaguaaggugauucggacagaacgccccuuguccucuggcgucuauauggggaaucugagcacucagcaacuagagcagagaagggcccuccuguccaugauaggaauggugggcggugcacgggggacccagccuggacgcgauggcguaguucgagugugggacgucaaaaacccagaucuucugaauaaccaguucggcacaaugccgucauugacccucgccugucugacuaagcaaggacagguggacuuaaaugaugugguccuggcucucacagaccuugggcugaucuacaccgcaaaguaucccaacaguagcgacuuggauagacuaucucagucccauccuauucugaauaugguugacacgaaaaagucaagccucaacaucagugguuacaauuuuucucugggcgccgcugugaaagccggggcgugcaugcuugauggaggcaacaugcuggagacuauuaagguaaccccacaaacaauggacgguaucuugaaauccauacucaaggugaaaaagagccuggggauguucgucucggauacucccggagaaaggaauccuuaugagaacaucuuauacaagauuugucugucuggcgacggcuggccauauaucgcaucccggaccucaauuguggggcgugccugggaaaacacaaccguugaucuagagagugacggaaaaccccagaaggugggugcugccggcagcaauaaaucccuccagucugcaggguuuccuacgggacugacuuacagccagcuuaugacauugaaggauucaaugaugcaacuggacccaagugcuaaaaccuggaucgauauagagggccgcccggaagaccccgucgagauugcccucuaccagccuauguccgguugcuauauccacuucuuuagagaaccaacugaccugaagcaguucaagcaggaugcgaaauacagccaugggauugacgugacagaucuguuuucugcccaacccggccuuaccucagcaguaaucgaggcuuugccuaggaacaugguucucacgugucagggaagugacgauaucaagcggcuguuagacagccagggccgacgcgauauuaaacugauagacaucgcccuauccaaggcugauucuagaagguucgaaaaugccgugugggaccagugcaaagaucucugucacaugcauaccggggucguggucgagaagaagaaacggggagguaaggaggaaauuacaccacacugcgcacugauggacuguaucauguaugaugccgcugugucgggcgggcuuaacauacccguuuugcgcgcggugcugccgagagacaugguauuuaggacuagcuccccuaaagucgugcucuga

SEQ ID NO: 1797 - RNA, 1710 nt, Artificial Sequence
  derived and/or modified CDS sequence (opt3) from Lassa virus__AIT17495__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaacaugaucgggauggucggaggcgcacagucagcccagccuggucgggauggggugguacgcguuugggacgugaaaaauccagaucuucugaacaaucaauucggaaccaugccgaguuugacacucgcuugucugaccaagcagggccaggucgacuuaaacgaugcagugcuggcccucacugaccuuggccugauuuacacagcuaaguaucccaauagcucugacuuggaucgacuaucccaaucacauccuauccugaacaugguggacaccaaaaagagcagucucaauauuucuggguuuaacuucucccugggagccgcggucaaagccggugcaugcaugcuugauggcgggaauaugcuggagacgaucaagguuacuccacagaccauggacggaauauugaaaagcauccucaaggugaaaagaucgcugggcauguuuguaucugaugcucccggugaaaggaacccuuacgagaacauuuuauauaagaucugucuguccggggacggauggccauacauugccucacggacaaguaucgugggccgugcaugggaaaauacuaccgucgaucuagagagcgacggcaagccccagaaaguggggacagcuggauccaacaagucucuccagagcgccgguuucccuaccggccugacguauucacaacuuaugacuuugaaagauaguaugaugcagcuggacccauccgcgaagacauggauagauauugaggggcgcccggaagaccccguugagaucgcccucuaccagccuaugagcggaugcuacauucacuuuuucagagaaccaaccgaccugaaacaguuuaagcaagaugcaaaguauucucauggcaucgacguggcugaucuuuuccccgcccagccuggucugacuucagcugucaucgaggccuugccaaggaauauggugcucacaugucaggggagugacgauauuaaaaagcuguuagacagccagggccggcgagauauaaaacugaucgacauugcacuauccaaggccgauucucgcagauuugaaaacgcuguaugggaccaaugcaaagaucucugucacaugcauaccggaguuguggucgagaagaagaaaaggggcgggaaggaggaaaucacgccccacugcgcgcugauggacuguauaauguacgaugcagccgugucgggaggucuuaauauuccggucuugcgggcugugcugccucgcgacaugguuuucagaaccagcucccccaaagugguacucuga

SEQ ID NO: 1798 - RNA, 1710 nt, Artificial Sequence
  derived and/or modified CDS sequence (opt3) from Lassa virus__AIT17499__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaucauugggauggucggaggcgcacaggguacccagccugggcgggauggagugguacgcguuugggacgugaaaaacccagaucuucugaauaaccaauucggcacaaugccgaguuugacccucgccugucugacuaagcagggccaggucgacuuaaaugaugcugugcuggcacucacagaccuugggcugaucuacaccgccaaguaucccaacagcucugacuuggaucgacuaucccaaucacauccuauucugaauaugguggacacgaaaaagagcagucucaacaucucuggauacaauuuuucccugggugcugccgucaaagcgggcgcaugcaugcuugaugggggaaacaugcuggagacuauaaagguuaccccacagacaauggacggcaucuugaaaagcauucucaaggugaaaagaucgcuggguauguucguaucugauacucccggggaaaggaauccuuaugagaacaucuuauacaagauuugucuguccggagacggcuggccauauaucgccucacggaccaguauagugggccgugcuugggaaaacacaaccgucgaucuagagagcgacgggaagccccagaaagugggagccgcagguuccaauaagucucuccagagcgcuggcuuuccuacggggcugacuuacucacaacuuaugacauugaaagauaguaugaugcagcuggacccauccgccaagaccuggauugauaucgagggacgcccggaagaccccguugagauugcgcucuaccagccuaugagcggcugcuauauccacuucuuuagagaaccaacugaccugaaacaguucaagcaagaugccaaguacucucaugguaucgacguggcagaucuuuuucccgcucagccugggcugacaucagccgucauugaggcuuugccaaggaacauggugcucaccugucagggcagugacgauguaaaacggcuguuagacagccagggacgacgcgauauaaagcugaucgacauugcccuauccaaagcagauucuagaagguucgaaaaugccguuugggaccaaugcaaggaucucugucacaugcauacgggcguggucguggagaaaaagaagcgcgggggaaaagaggaaaucacaccccacugcgcucugauggacuguauaauguaugaugcggcagucucggguggccuuaacauuccgguguugcgggccguucugccuagagacaugguguuuaggaccagcucccccaagguaguccucuga

SEQ ID NO: 1799 - RNA, 1710 nt, Artificial Sequence
  derived and/or modified CDS sequence (opt3) from Lassa virus__AIT17503__NP
augagcuccucuaaggaggugaaaucauuccuguggacccagagucucagaagggaacuuagcggcuacugcuccucuaucaagcugcaagucguuaaagacgcccaggcuuuguuacacgggcuggauuuuucggaggugucaaacguacagcggcuaaugcgcaagcagaaacgagacgauagcgaccucaagcgucugagagaucuuaaucaagcagugaacaaucuggucgaauugaagaguacacagcagaaauccauucucagggugggaacucugacgucugacgaucugcucaccuuagccgcggaccuggagaaacuuaagagcaagguuauacggacagaacgccccuuguccucagguguguauaugggcaaccugagugcucagcaacuagagcagagaagggcccuccugaauaugaucgggauggucggaggcgcacaggguacucagccugggcgggauggagugguacgcguuugggacgugaaaaacccagaucuucugaauaaccaauucggcaccaugccgagcuugacacucgccugucugaccaagcagggccaggucgacuuaaaugaugcugugcuggcacucacugaccuugggcugauuuacacagccaaguaucccaacucuuccgacuuggaucgacuaucacaaagccauccuauccugaauaugguggacaccaaaaagaguucucucaacauuuccggauacaauuuuagccugggugcugccgucaaagcgggcgcaugcaugcuugaugggggaaacaugcuggagacgaucaagguuacuccacagaccauggacggcauauugaaaucgauccucaaggugaaaaagucucuggguauguucguauccgauacacccggggaaagaaauccuuaugagaacauuuuauacaagaucugucugucaggagacggcuggccauauauugccaguaggacuagcaucgugggccgggcuugggaaaacaccacagucgaucuagaguccgacgggaaaccccagaaggugggaaccgccgguucuaauaaaagccuccagucagcaggcuuuccuacggggcugacuuacagucaacuuaugacauugaaggauuccaugaugcagcuggacccaagcgcuaaaaccuggauagauauugagggacguccggaagaccccguugagaucgcccucuaccagccuaugucuggcugcuauauucacuucuuucgcgaaccaacugaccugaagcaguucaagcaagaugcgaaauacucacaugguaucgacguggccgaucuuuuucccgcacagccugggcugacaagugcugucaucgaggccuugccaagaaacauggugcucaccugucagggcagcgacgauauuaagaggcuguuagacucccagggacggcgagauauaaaacugaucgacauugcucuaucuaaggccgauucgcgcagauucgaaaaugcaguaugggaccaaugcaaagaucucugucacaugcauacgggcguuguggucgagaagaagaaaaggggagggaaggaggaaaucacaccccacugcgcccugauggacuguauaauguaugaugcugcggugagcgguggccuuaacauuccggucuugcgggcagugcugccucgcgacaugguuuuuagaaccuccucacccaaagugguacucuga

SEQ ID NO: 1800 - RNA, 1710 nt, Artificial Sequence
  derived and/or modified CDS sequence (opt3) from Lassa virus__AIT17507__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaaccuuaucgggauggucggaggcgcacaggguacccagccugggcgggauggagugguacgcguuugggacgugaaaaauccagaucuguugaacaaucaauucggcacaaugccgucacucacccuggccuguuuaacuaagcagggccaggucgaccugaacgaugcugugcucgcacuuacagaccugggguugauuuacaccgccaaguaucccaauaguagcgaccuagaucgacugucucaaucccauccuauccucaacaugguggacacgaaaaagucaagccugaauauuaguggauuuaacuucucucuuggugcugccgucaaagcgggcgcaugcaugcuggaugggggaaauauguuggagacuaucaagguuaccccacagacaauagacggcauccucaaauccauucugaaggugaaaaagagcuuagguauguuuguaucggauacucccggggaaagaaacccuuacgagaacauccuguauaagauuugucuaucuggagacggcuggccauacaucgccuccaggaccucaauagugggccgggcuugggaaaauacaaccgucgaucucgagagugacgggaaaccccacaaggugggaacggccgguagcaacaaaucccugcagucugcaggcuucccuacugggcuuacauauagccaguugaugacccugaaggauucaaugaugcaacucgacccaagugcuaaaacuuggauugauaucgagggacguccggaagaccccguugagauugcccuguaccagccuauguccggcugcuacauccacuuuuuccgcgaaccaacagaccuuaagcaguuuaagcaggaugcgaaauauagccaugguaucgacguggccgaucuguuccccgcacaaccuggguugaccucugcugucauugaggcccucccaagaaauauggugcugacgugucagggcucagacgauauaaagagguuacuggacagucagggacggcgagauaucaaacuaauugacaucgcucucagcaagguagauucccgcagauuugaaaacgccguuugggaccagugcaaagaucugugucauaugcacaccggcguggucguggagaagaagaaaaggggagggaaggaggaaauaacaccccacugcgcacuuauggacuguauuauguacgaugccgcugucucugguggcuugaauaucccggugcugcgggcgguucucccucgcgacaugguguucagaacuucgagccccaaaguaguccuguga

SEQ ID NO: 1801 - RNA, 1710 nt, Artificial Sequence
  derived and/or modified CDS sequence (opt3) from Lassa virus__AIT17511__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauggagaccucaagcgucugagagaucuuaaccaagccgugaauaaccuggucgaauugaagucgacacagcagaaaucaauucucaggguggguacucugacgagcgacgaucugcucaccuuagcggcugaccuggagaaacuuaagaguaagguuauacggacagaacgccccuuguccucuggcguguauauggggaaucugagcacucagcaacuagagcagagaagggcccuccugaacaugaucggaauggucggcggugcacaggggacccagccuggacgggauggcgugguacgcguuugggacgugaaaaauccagaucuucugaacaaucaauucggcacaaugccguccuugacccucgccugucugacuaagcaggggcaggucgacuuaaacgaugcugugcuggcacucacagaccuuggacugauuuacaccgccaaguaucccaauucaagugacuuggaucgacuaagccaaucucauccuauccugaacaugguggacacgaaaaaguccucacucaauauuagcgguuacaacuuuagucugggcgcugccgucaaagcgggggcaugcaugcuugauggaggcaauaugcuggagacuaucaagguuaccccacagacaauagacgguaucuugaaaucuauucucaaggugaaaaagucccuggggauguucguaagcgauacucccggagaaagaaacccuuaugagaacaucuuauacaagauuugucugucgggcgacggcuggccauauaucgccucuaggaccuccauaguggggcgggcuugggaaaauacaaccgucgaucuagagucagacggaaaaccccagaagguggguacggccggcaguaacaaaagccuccaguccgcaggguuuccuacuggacugacauacucucaacuuaugaccuugaaggauagcaugaugcagcuggacccaucagcuaaaacuuggauugauaucgagggccguccggaagaccccguugagauugcccucuaccagccuaugagugguugcuauauccacuucuuucgcgaaccaacagaccugaagcaguucaagcaagaugcgaaauacucccaugggaucgacgugaccgaucuuuuuagcgcccagcccggccugacgucugcagucauugaggcuuugccuagaaauauggugcucaccugucagggaucagacgauauaaagaggcuguuagacagucagggccggcgagauaucaaacugauugacaucgcccuaagcaaggcugauucccgcagauucgaaaacgccguaugggaccaaugcaaagaucucugucacaugcauacagggguuguggucgagaagaagaaaaggggagguaaggaggaaauaacuccacacugcgcacugauggacuguauuauguaugaugccgcugugucuggcgggcuuaauauccccgucuugcgggcggugcugccgcgcgacaugguuuuuagaaccucgagcccuaaagugguacucuga

SEQ ID NO: 1802 - RNA, 1710 nt, Artificial Sequence
  derived and/or modified CDS sequence (opt3) from Lassa virus__AIT17515__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucggaggcgcacaggguacccagccugggcgggauggagugguacgcguuugggacgugaaaaacccagaucuucugaauaaccaauucggcacaaugccgaguuugacccucgccugucugacuaagcagggccaggucgacuuaaaugaugcugugcuggcacucacagaccuugggcugauuuacaccgccaaguaucccaacagcucugacuuggaucgacuaucccaaucacauccuauccugaauaugguggacacgaaaaagagcagucucaacauuucuggauacaauuuuucccugggugcugccgucaaagcgggcgcaugcaugcuugaugggggaaacaugcuggagacuaucaagguuaccccacagacaauggacggcauauugaaaagcauccucaaggugaaaagaucgcuggguauguucguaucugauacucccggggaaaggaauccuuaugagaacauuuuauacaagaucugucuguccggagacggcuggccauauauugccucacggaccaguaucgugggccgugcuugggaaaacacaaccgucgaucuagagagcgacgggaagccccagaaagugggagccgcagguuccucuaagagccuccagucagcuggcuuuccuacggggcugacuuacagucaacuuaugacauugaaagauuccaugaugcagcuggacccaagcgccaagaccuggauagauauugagggacgcccggaagaccccguugagaucgcgcucuaccagccugugucuggcugcuauauucacuucuuuagagaaccaacugaccugaaacaguucaagcaagaugccaaguacucacaugguaucgacgucgcagaucuuuuucccgcucagccugggcugacaagugccgugaucgaggcuuugccaaggaauaugguacucaccugucagggcagcgacgauauuaaacggcuguuagacucccagggacgacgcgauauaaagcugaucgacauugcccuaucuaaagcagauucgagaagguucgaaaacgccguuugggaccaaugcaaggaucucugucacaugcauacgggcguggucguggagaaaaagaagcgcgggggaaaagaggaaaucacaccccacugcgcucugauggacuguauaauguaugaugcggcagucagcgguggccuuaauauuccgguguugcgggccguucugccuagagacaugguguuuaggaccuccucacccaagguaguccucuga

SEQ ID NO: 1803 - RNA, 1710 nt, Artificial Sequence
  derived and/or modified CDS sequence (opt3) from Lassa virus__AIT17519__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccgcccagcaacuagagcagagaagggcacuccugaacaugaucgggauggucggaggcgcccaggguacucagccugggcgggauggagugguacgcguuugggacgugaaaaauccagaucuucugaacaaucaauucggcaccaugccgucauugacacucgcuugucugaccaagcagggccaggucgacuuaaacgaugcagugcuggcccucacugaccuugggcugauuuacacagcuaaguaucccaauaguagcgacuuggaucgacuaucucaaucccauccuauccugaacaugguggacaccaaaaagucaagccucaauauuaguggauuuaacuucucucugggugccgcggucaaagcaggcgccugcaugcuugaugggggaaauaugcuggagacgaucaagguuacuccacagaccauggacggcauauugaaauccauccucaaggugaaaagaagccuggguauguuuguaucggauacacccggggaaaggaacccuuacgagaacauuuuauauaagaucugucugucuggagacggcuggccauacauugcuucccggacuucaaucgugggccgugccugggaaaauaccacagucgaucuagagagugacgggaagccccagaaagugggaaccgcagguagcaacaagucccuccagucugcuggcuucccuacggggcugacuuauagccaacuuaugacauugaaagauucaaugaugcagcuggacccaagugccaagaccuggauagauauugagggacgcccggaagaccccguugagaucgcgcucuaccagccuauguccggcugcuacauucacuuuuucagagaaccaacugaccugaaacaguuuaagcaagaugccaaguauagccaugguaucgacguggcagaucuuuuccccgcucagccugggcugacaucugccgucaucgaggcuuugccaaggaauauggugcucaccugucagggcucagacgauauuaaacggcuguuagacagucagggacgacgcgauauaaagcugaucgacauugcccuaagcaaagcagauuccagaagguuugaaaacgccguaugggaccaaugcaaggaucucugucacaugcauacgggcguuguggucgagaaaaagaagcgcgggggaaaagaggaaaucacaccccacugcgcucugauggacuguauaauguacgaugcggcagugucugguggccuuaauauuccggucuugcgggccgugcugccuagagacaugguuuucaggaccucgagccccaaggugguacucuga

SEQ ID NO: 1804 - RNA, 1710 nt, Artificial Sequence
  derived and/or modified CDS sequence (opt3) from Lassa virus__AIT17525__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagcgacgugacgauucagaccucaaaagacugagggaucuuaaucaagccgugaacaaucuggucgaacucaagagcacacagcagaagaguauuuugcgggugggaacucugacguccgacgaucugcucaccuuagcggcugaccuggagaaacuuaagucuaaaguuauacgcacagaaagacccuugagcuccgguguguauaugggcaaccugucaacucagcaacuagagcagaggcgggcccuccugaauaugaucgggauggucggaggcgcacaggguacccagccugggcgcgauggagugguacgaguuugggacgugaagaacccagaucuucugaauaaccaauucggcacaaugccgaguuugacccucgccugucugacuaaacagggccaggucgacuuaaaugaugcugugcuggcacucacagaccuugggcugauuuacaccgccaaguaucccaacagcucugacuuggauagacuaucccaaucacauccuauccugaauaugguggacacgaagaaaagcagucucaacauuucuggauacaauuuuucccugggugcugccgucaaggcgggcgcaugcaugcuugaugggggaaacaugcuggagacuaucaaaguuaccccacagacaguggacggcauacucaagagcaucuugaaaguaaagaggucgcuggguauguucgugucugauacucccggggaacggaauccuuaugagaacauuuuauacaaaaucugucuguccggagacggcuggccauauauugccucacguaccaguaucgucggccgcgcuugggaaaacacaaccguggaucuagagagcgacgggaagccccagaagguuggaacggccgguuccaauaaaucucuccagagcgcaggcuuuccuacugggcugacauacucacaacuuaugaccuugaaggauaguaugaugcagcuggacccauccgcuaaaacuuggauagauauugagggaagaccggaagaccccguggagaucgcccucuaccagccuaugagcggcugcuauauucacuucuuuagggaaccaacagaccugaagcaguucaaacaagaugcgaaguacucucaugguaucgacgucgccgaucuuuuucccacccagccugggcugacgucagcagugaucgaggcuuugccacggaacaugguacucaccugucagggcagugacgauauuaagcgacuguuagacagccagggacgcagagauauaaaacugaucgacauugcccuauccaaggcugauucuaggaaauucgaaaaugccguuugggaccaaugcaaggaucucugucacaugcauacaggcguggucguggagaaaaagaagcgcgggggaaaagaggaaaucacuccccacugcgcacugauggacuguauaauguaugaugccgcugucucggguggccuuaacauuccgguguugcgggcgguucugccuagagacaugguguuuaggaccagcucccccaagguaguccucuga

SEQ ID NO: 1805 - RNA, 1710 nt, Artificial Sequence
  derived and/or modified CDS sequence (opt3) from Lassa virus__AIT17533__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugaauaacguacagcggcuaaugcgcaagcagaaacgagacgauucugaccucaagcgucugagagaucuuaaucaagccgugaacaaucuggucgaauugaagucgacacagcagaaaucaauucucagggugggaacucugacgagcgacgaucugcucaccuuagcggcugaccuggagaaacuuaagaguaagguuauacggacagaacgccccuuguccucugguguguauaugggcaaccugagcacucagcaacuagagcagagaagggcccuccugaauaugaucgggauggcaggaggcacccaggguacacagccugggcgggauggagucgugcgcguaugggacguuaaaaacccagaucuucugaauaaccaauucggcaccaugccguccuugacucucgccugucugacaaagcagggccagguggacuuaaaugaugcuguccuggcacucaccgaccuugggcugauuuacacggccaaguaucccaacucaagugacuuggaucgacuaagccaaucucauccuauccugaauaugguggacacuaaaaaguccucacucaacauuagcggauacaauuuuagucugggugcugccgugaaagcgggcgcaugcaugcuugaugggggaaacaugcuggagaccaucaaggucacaccacagacuauggacggcauauugaaaucuauccucaagguuaaaagaucccuggguauguucgugagcgauacccccggggaaaggaacccuuaugagaauauuuuauacaagaucugucugucgggagacggcuggccauauauugccucucggacauccaucguaggccgugcuugggaaaacaccacgguggaucuagagucagacgggaagccccagaaagucggaacugccgguaguaauaagagccuccaguccgcaggcuuuccuacagggcugaccuacucucaacuuaugacuuugaaagauagcaugaugcagcuggacccaucagcuaagacauggauagauauugagggacgcccggaagaccccguggagaucgcccucuaccagccuaugaguggcugcuauauucacuucuuuagagaaccaaccgaccugaaacaguucaagcaagaugcgaaguacucccaugguaucgacguugccgaucuuuuucccgcacagccugggcugacgagcgcugugaucgaggccuugccaaggaacaugguccucaccugucagggcucugacgauauuaaaaagcuguuagacucacagggacggcgagauauaaaacugaucgacauuagucuaagcaagaucgauucccgcaaauucgaaaaugcugugugggaccaaugcaaggaucucugucacaugcauacaggcguaguuguggagaagaaaaagagagggggaaaagaggaaauaacuccccacugcgcccugauggacuguauuauguuugaugcagccgucucugguggccuuaacaucccgguguugagggcuguccugccucgggacaugguguuccgcaccucgagccccaagguugugcucuga

SEQ ID NO: 1806 - RNA, 1710 nt, Artificial Sequence
  derived and/or modified CDS sequence (opt3) from Lassa virus__AIT17539__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauggagaccucaagcgucugagagaucuuaaccaagccgugaauaaccuggucgaauugaagucgacacagcagaaaucagugcucaggguugguacucugacgagcgacgaucugcucauuuuagcggcugaccuggagaaacuuaagaguaaggugauacggaccgaacgccccuuguccucuggcgucuauauggggaaucugagcacacagcaacuagagcagagaaaagcccuccuguccaugaucggaauggugggcggugcacaggggacucagccuggaagggauggcguaguucgggugugggacgucaagaacccagaucuucugaauaaccaauucggcaccaugccgucauugacacucgccugucugaccaagcagggacagguggacuuaaaugaugcugugcuggcacucacugaccuugggcugauuuacacagccaaauaucccaacaguagcgacuuggaucgccuaucucaaucccauccuauccugaauauggucgacaccaagaaaucaagccucaacauuagugguuacaauuuuucucugggcgcugccguuaaggcgggggcaugcaugcuugauggaggcaacaugcuggagacgaucaaagugacuccacagaccauggacgguauauugaaguccauccucaaaguaaagcgaagccuggggauguucgugucggauacacccggagaaagaaauccuuaugagaacauuuuauacaagaucugucugucuggcgacggcuggccauauauugccuccaggacuucaaucgucgggcgggcuugggaaaacaccacaguggaucuagagagugacggaaaaccccagaagguugguagcgccggcuccaauaaaucucuccagagcgcaggguuuccuaccggacugacguacucacaacuuaugacuuugaaggauaguaugaugcagcuggacccauccgcuaaaacauggauagauauugagggccguccggaagaccccguggagaucgcccucuaccagccuaugagcgguugcuauauucacuucuuucgcgaaccaaccgaccugaagcaguucaagcaagaugcgaaauacucucaugggaucgacgucacugaucuguuuucagcccagcccggccuuacaagugcagugaucgaggcuuugccuagaaacaugguacucaccugucagggaagcgacgauauuaagaaacuguuagacucccagggcaggcgggauauaaagcugaucgacauuucucuagggaaagccgauucgcgacgcuucgaaaaugcuguuugggaccaaugcaaggaucucugucacaugcauacgggaguggucguggagaagaaaaagagagguggcaaagaggaaaucaccccacacugcgcccugauggacuguauaauguuugaugcagccgucagcgggggacuuaacauucccaucuugagggcugugcugccgcgggacaugguuuuccgcacauccucaccuaaggugguacucuga

SEQ ID NO: 1807 - RNA, 1710 nt, Artificial Sequence
  derived and/or modified CDS sequence (opt3) from Lassa virus__AIT17541__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauggagaccucaagcgucugagagaucuuaaccaagccgugaauaaccuggucgaauugaagucgacacagcagaaaucagugcucaggguugguacucugagcagugacgaucugcucacguuagcggcugaccuggagaaacuuaaguccaaggugauucggaccgaacgccccuugucuagcggcgucuauauggggaaucuguccucacagcaacuagaucagagaagggcccuccugaacaugauaggaaugacaagugaccggcagggcgcaagcacuggucgcgaugggaucgugcgaguaugggacguuaaaaaugccgagcuucugaacaaucaguucggaaccgugccuucuuugacacucgcuugucugaccaagcaaggccaggucgauuuaaacgacgcagugcaggcccugacugaccucggccuuauuuacacagcuaaguauccaaauuccucagaucuggacagauugagccaaagucauccgauccuaaacaugauugauaccaaaaagucuucccugaauaucagcggguacaacuuuucgcucggagccgcggugaaagcuggugccugcaugcuggacggcgggaauaugcuugagacgauaaaggucucuccccagacuauggauggaauccugaaauccauuuugaagguuaaaaggucacucggcauguucgugagugacaucccuggugaacggaacccauaugagaacauucuguacaagaucuguuuaagcggggauggauggcccuauauagcuucccguaccucuauuacaggccgcgccugggaaaauacuaucguagaccuggagagcgauucaaagccucagaaaccaggcaacaguggguccaauagaagccuacagucugcaggauuucccgcuggucucaccuacucacaacugaugacacuuaaggacaguauguugcagcuggauccuaacgccaaaaccuggauggacauugagggcaggccagacgauccgguggaaaucgcgcucuaccagcccagcuccgggugcuauauccacuucuuucgggagccuacggaccugaagcaguucaaacaagaugccaaguacucucauggaauugacgucggcgaucuuuuugcagcucagccaggucugacuucggccgugauagaagcauugccccgaaauaugguuaucacaugucaggggagcgaggacauuaagaaacuccuggaaucccagggccgcaaggauaucaaauuaguggacauaucaaugaguaagccugauucuagaaaauucgagaacgccgucugggaccaauauaaggaucugugccacaugcauaccggaauugugguagagaagaaaaagaggggcgggaaagaagagaucacuccacacugugcacuaauggacugcaucauguuugaugccgcuguugugggaggucucgacgcgcggauucugcgcgcaguccuucccagagacaugguguucaggacaagcaccccgaaggucguguuguga

SEQ ID NO: 1808 - RNA, 1710 nt, Artificial Sequence
  derived and/or modified CDS sequence (opt3) from Lassa virus__AIT17545__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcgugcucaggguuggaacucugacgagugacgaucugcucaccuuagcggcugaccuggagaaacuuaaguccaaggugauucggacagaacgccccuugucuagcggugucuauaugggcaaucuguccacucagcaacuagagcagagaagggcccuccugaacaugauagggauggugggaggcgcacaggguacccagccugggcgggauggaguaguucgcgugugggacgucaaaaauccagaucuucugaacaaucaauucggcacaaugccgucauugacccucgccugucugacuaagcagggccagguggacuuaaacgaugcugugcuggcacucacagaccuugggcugaucuacaccgccaaguaucccaauaguagcgacuuggaucgacuaucucaaucccauccuauucugaacauggucgacacgaaaaagucaagccucaauaucaguggauacaacuuuucucugggugcugccguuaaagcgggcgcaugcaugcuugaugggggaaauaugcuggagacuauuaaggugaccccacagacaauggacggcaucuugaaauccauacucaaggugaaaaagagccuggguauguucguaucggauacucccggggaaagaaacccuuaugagaacaucuuauacaagauuugucugucuggagacggcuggccauauaucgccuccaggaccucaauugucggccgggcuugggaaaauacaaccguggaucuagagagugacgggaaaccccagaagguuggaaucgccgguagcaacaaaucccuccagucugcaggcuuuccuacggggcugacuuacagccaacuuaugacauugaaggauucaaugaugcagcuggacccaagugcuaaaaccuggauagauauugagggacguccggaagaccccguggagaucgcccucuaccagccuauguccggcugcuauauucacuucuuucgcgaaccaacugaccugaagcaguucaagcaagaugcgaaauacagccaugguaucgacgucgccgaucuguuuucugcacagcccgggcuuacaucagcugugaucgaggccuugccuagaaauaugguacucaccugucagggcagugacgauauuaagaggcuguuagacagccagggacggcgagauauaaaacugaucgacauugcucuauccaaggccgauucucgcaaauucgaaaacgcaguuugggaccaaugcaaggaucucugucacaugcauacgggcguggucguggagaagaaaaagagagggggaaaagaggaaaucaccccacacugcgcccugauggacuguauaauguaugaugcugcggucucggguggccuugacauucccguguugagggcaguucugccgcgggacaugguguuucgcacaagcuccccuaagguaguccucuga

SEQ ID NO: 1809 - RNA, 1710 nt, Artificial Sequence
  derived and/or modified CDS sequence (opt3) from Lassa virus__AIT17549__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaacaugaucgggauggucggaggcgcacaggguacccagccugggcgggauggagugguacgcguuugggacgugaaaaauccagaucuucugaacaaucaauucggcacaaugccgucauugacccucgccugucugacuaagcagggccaggucgacuuaaacgauguggugcuggcucucacagaccuugggcugauuuacaccgcaaaguaucccaauaguagcgacuuggaucgacuaucucaaucccauccuauccugaacauggucgacacgaaaaagucaagccucaauauuaguggauacaacuuuucucugggugccgcuguuaaagccggcgcgugcaugcuugaugggggaaauaugcuggagacuaucaaggugaccccacagacaauggacggcauauugaaauccauccucaaggugaaaaagagccuggguauguucguaucggauacucccggggaaagaaacccuuaugagaacauuuuauacaagaucugucugucuggagacggcuggccauauauugcauccaggaccucaaucgucggccgggccugggaaaauacaaccguggaucuagagagugacgggaaaccccagaagguuggaacgguggguagcaacaaaucccuccagucugcuggcuuuccuacugggcugacauacagccaacuuaugaccuugaaggauucaaugaugcagcuggacccaagugccaaaacuuggauagauauugagggacguccggaagaccccgucgagaucgcacucuaccagccuauguccggcugcuauauucacuucuuucgcgaaccaacagaccugaagcaguucaagcaagaugcuaaauacagccaugguaucgacguggccgaucuuuuucccgcgcagccugggcugaccucugccguaaucgaggcauugccaagaaauaugguucucacgugucagggcucagacgauauuaagaaacuguuagacagucagggaaggcgggauauaaagcugaucgacauugcucuaagcaaagccgauucccgaaaguucgaaaacgcugugugggaccaaugcaaggaucucugucacaugcauaccggcgucguggucgagaaaaagaaacgcgggggaaaggaggaaaucacaccccacugcgcccugauggacuguauaauguaugaugcagccgugucugguggccuuaauauuccgguuuugagagcugugcugccuagggacaugguauuucggacuucgagccccaaagucgugcucuga

SEQ ID NO: 1810 - RNA, 1710 nt, Artificial Sequence
  derived and/or modified CDS sequence (opt3) from Lassa virus__AIT17553__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucggaggcgcacaggguacccagccugggcgggauggagugguacgcguuugggacgugaaaaacccagaucuucugaauaaccaauucggcacaaugccgaguuugacccucgccugucugacuaagcagggccaggucgacuuaaaugaugcugugcuggcacucacagaccuugggcugauuuacaccgccaaguaucccaacagcucugacuuggaucgacuaucccaaucacauccuauccugaauaugguggacacgaaaaagagcagucucaacauuucuggauacaauuuuucccugggugcugccgucaaagcgggcgcaugcaugcuugaugggggaaacaugcuggagacuaucaagguuaccccacagacaauggacggcauauugaaaagcauccucaaggugaaaagaucgcuggguauguucguaucugauacucccggggaaaggaauccuuaugagaacauuuuauacaagaucugucuguccggagacggcuggccauauauugccucacggaccaguaucgugggccgugcuugggaaaacacaaccgucgaucuagagagcgacgggaagccccagaaaaugggaacggccgguuccaauaagucucuccagagcgcaggcuuuccuacugggcugacauacucacaacuuaugaccuugaaagauaguaugaugcagcuggacccauccgcuaagacuuggauagauauugagggacgcccggaagaccccguggagaucgcccucuaccagccuaugagcggcugcuauauucacuucuuuagagaaccaacagaccugaaacaguucaagcaagaugcgaaguacucucaugguaucgacguugccgaucuuuuucccgcacagccugggcugaccucagcugugaucgaggccuugccaaggaacaugguccucacgugucagggcagugacgauauuaaaaagcuguuagacagccagggacggcgagauauaaaacugaucgacauugcucuauccaaggccgauucucgcagauucgaaaaugcagugugggaccaaugcaaagaucucugucacaugcauaccggcguaguuguggagaagaagaaaaggggagggaaggaggaaaucacaccccacugcgcccugauggacuguauaauguaugaugcugcggucucggguggccuuaacauuccgguguugcgggcaguccugccucgcgacaugguguuuagaacuagcucccccaaaguugugcucuga

SEQ ID NO: 1811 - RNA, 1710 nt, Artificial Sequence
  derived and/or modified CDS sequence (opt3) from Lassa virus__AIT17561__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaacaugaucgggauggucggaggcgcacaggguacccagccugggcgggauggagugguacgcguuugggacgugaaaaauccagaucuucugaacaaucaauucggcacaaugccgucauugacccucgccugucugacuaagcagggccaggucgacuuaaacgaugcugugcuggcacucacagaccuugggcugauuuacaccgccaaguaucccaauaguagcgacuuggaucgacuaucucaaucccauccuauccugaacaugguggacacgaaaaagucaagccucaauauuaguggauacaacuuuucucugggugcugccgucaaagcgggcgcaugcaugcuugaugggggaaauaugcuggagacuaucaagguuaccccacagacaauagacggcaucuugaaauccauucucaaggugaaaaagagccuggguauguucguaucggauacucccggggaaagaaacccuuaugagaacaucuuauacaagauuugucugucuggagacggcuggccauauaucgccuccaggaccucaauagugggccgggcuugggaaaauacaaccgucgaucuagagagugacgggaaaccccagaaggugggaacgguugguagcaacaaaucccuccagucugccggcuuuccuacugggcugacauacagccaacuuaugaccuugaaggauucaaugaugcagcuggacccaagugcaaaaacuuggauugauaucgagggacguccggaagaccccguggagauugcucucuaccagccuauguccggcugcuauauccacuucuuucgcgaaccaacagaccugaagcaguucaagcaagaugccaaauacagccaugguaucgacgucgcggaucuuuuucccgcccagccugggcugaccucugcagugauugaggcuuugccaagaaauaugguacucacgugucagggcucagacgauauaaagaggcuguuagacagucagggacggcgagauaucaaacugauugacaucgcccuaagcaaggcugauucccgcagauucgaaaacgccguuugggaccaaugcaaagaucucugucacaugcauaccggcguggucguggagaagaagaggcgcgggggaaaagaggaaauaacaccccacugcgcacugauggacuguauuauguaugaugccgcugucucugguggccuuaauaucccgguguugcgggcgguucugccuagagacaugguguuuaggacuucgagccccaagguaguccucuga

SEQ ID NO: 1812 - RNA, 1710 nt, Artificial Sequence
  derived and/or modified CDS sequence (opt3) from Lassa virus__AIT17565__NP
augagcgccuccaaggagaucaaaucuuuccuguggacccagucacucagaagggaacuuaguggcuacugcagcuccauuaagcugcaaguggucaaagacgcucaggcauuguuacacgggcuggauuuuucugagguuucgaacgugcagcggcuaaugcgcaagcagaaacgagacgauucagaccucaagcgucugagagaucuuaaucaagccguaaacaaucugguggaacuuaagagcacacagcagaaaaguauacucagggucggaacucugacguccgacgaucugcucaccuuagcggcugaccuggagaaguugaaaucuaaggugauccggacagaacgccccuugagcuccgguguuuauaugggcaaccugucaacucagcaacuagagcagagaagggcccuccugaauaugauugggauggugggaggcgcacaggguacccagccugggcgggauggagucgugcgcguaugggacguuaaaaacccagaucuucugaauaaccaauucggcacaaugccgaguuugacccucgccugucugacuaagcagggccagguggacuuaaaugaugcuguccuggcacucacagaccuugggcugaucuacaccgccaaguaucccaacagcucugacuuggaucgacuaucccaaucacauccuauucugaauaugguggacacgaaaaagagcagucucaacaucucuggauacaauuuuucccugggugcugccgugaaagcgggcgcaugcaugcuugaugggggaaacaugcuggagacuauaaaggucaccccacagacaauggacggcaucuugaaaagcauucucaagguuaaaagaucgcuggguauguucgugucugaugcccccggggaaaggaauccuuaugagaacaucuuauacaagauuugucuguccggagacggcuggccauauaucgcuucacggaccaguauaguaggccgugccugggaaaacaccacaguggaucuagagagcgacgggaagccccagaaagucggaaccgcagguuccaauaagucucuccagagcgcuggcuuuccuacggggcugacuuacucacaacuuaugacauugaaagauaguaugaugcagcuggacccauccgccaagaccuggauugauaucgagggacgcccggaagaccccguggagauugcgcucuaccagccuaugagcggcugcuauauccacuucuuuagagaaccaacugaccugaaacaguucaagcaagaugccaaguacucucaugguaucgacguugcagaucuuuuucccgcucagccugggcugacaucagccgugauugaggcuuugccaaggaacaugguccucaccugucagggcagugacgauauaaaacggcuguuagacagccagggacgacgcgauaucaagcugauugacaucgcccuauccaaagcagauucuagaaaguucgaaaaugccgugugggaccaaugcaaagaucucugucacaugcauacgggcguaguuguggagaagaagaaaaggggagggaaggaggaaauaacuccccacugcgcucugauggacuguauuauguaugaugcggcagucucggguggccuuaacaucccgguguugcgggccguccugccucgcgacaugguguuuagaacaagcucccccaaaguugugcucuga

SEQ ID NO: 1813 - RNA, 1710 nt, Artificial Sequence
  derived and/or modified CDS sequence (opt3) from Lassa virus__AIT17569__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaacaugaucgggauggucggaggcgcacaggguacccagccugggcgggauggagugguacgcguuugggacgugaaaaauccagaucuucugaacaaucaauucggcacaaugccgucauugacccucgccugucugacuaagcagggccaggucgacuuaaacgaugcugugcuggcacucacagaccuugggcugauuuacaccgccaaguuucccaauaguagcgacuuggaucgacuaucucaaucccauccuauccugaacaugguggacacgaaaaagucaagccucaauauuaguggauauaacuucucucugggugcugccgucaaagcgggcgcaugcaugcuugaugggggaaauaugcuggagacuaucaagguuaccccacagacaauggacggcauauugaaauccauccucaaggugaaaaagagccuggguauguuuguaucggauacucccggggaaagaaacccuuacgagaacauuuuauauaagaucugucugucuggagacggcuggccauacauugccuccaggaccucaaucgugggccgggcuugggaaaauacaaccgucgaucuagagagugacgggaaaccccagaaggugggaacgacugguagcaacaaaucccuccagucugccggcuucccuacagggcugaccuauagccaacuuaugacuuugaaggauucaaugaugcagcuggacccaagugcaaaaacauggauagauauugagggacguccggaagaccccguugagaucgcucucuaccagccuauguccggcugcuacauucacuuuuuccgcgaaccaaccgaccugaagcaguuuaagcaagaugccaaauauagccaugguaucgacguggcggaucuuuuccccgcccagccugggcugacgucugcagucaucgaggcuuugccaagaaauauggugcucaccugucagggcucagacgauauuaagaggcuguuagacagucagggacggcgagauauaaaacugaucgacauugcccuaagcaaggcugauucccgcagauuugaaaacgccguaugggaccaaugcaaagaucucugucacaugcauacaggcguuguggucgagaagaagaaaaggggagggaaggaggaaaucacuccccacugcgcacugauggacuguauaauguacgaugccgcugugucugguggccuuaauuugccgguccugcgggcggugcucccucgcgacaugguuuucagaaccucgagccccaaagugguacuguga

SEQ ID NO: 1814 - RNA, 1710 nt, Artificial Sequence
  derived and/or modified CDS sequence (opt3) from Lassa virus__AIT17573__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaacaugaucgggauggucggaggcgcacaggguacccagccugggcgggauggagugguacgcguuugggacgugaaaaauccagaucuucugaacaaucaauucggcacaaugccgucauugacccucgccugucugacuaagcagggccaggucgacuuaaacgaugcugugcuggcacucacagaccuugggcugauuuacaccgccaaguaucccaauaguagcgacuuggaucgacuaucucaaucccauccuauccugaacaugguggacacgaaaaagucaagccucaauauuaguggauacaacuuuucucugggugcugccgucaaagcgggcgcaugcaugcuugaugggggaaauaugcuggagacuaucaagguuaccccacagacaauggacggcauauugaaauccauccucaaggugaaaaagagccuggguauguucguaucggauacucccggggaaagaaacccuuaugagaacauuuuauacaagaucugucugucuggagacggcuggccauauauugccuccaggaccucaaucgugggccgggcuugggaaaauacaaccgucgaucuagagagugacgggaaaccccagaaggugggaacggccgguagcaacaaaucccuccagucugcaggcuuuccuacugggcugacauacagccaacuuaugaccuugaaggauucaaugaugcagcuggacccaagugcuaaaacuuggauagauauugagggacguccggaagaccccguugagaucgcccucuaccagccuauguccggcugcuauauucacuucuuucgcgaaccaacagaccugaagcaguucaagcaagaugcgaaauacagccaugguaucgacaucgccgaucuuuuucccgcacagccugggcugaccucugcugugauugaggccuugccaagaaauaugguccucacgugucagggcucagacgauauaaagaggcuguuagacagucagggacggcgagauaucaaacugauugacaucgcucuaagcaaggccgauucccgcagauucgaaaacgcagugugggaccaaugcaaagaucucugucacaugcauaccggcguaguuguggagaagaagaaaaggggagggaaggaggaaauaacaccccacugcgcccugauggacuguauuauguaugaugcugcggucucugguggccuuaauaucccgguguugcgggcaguccugccucgcgacaugguguuuagaacuucgagccccaaaguugugcucuga

SEQ ID NO: 1815 - RNA, 1710 nt, Artificial Sequence
  derived and/or modified CDS sequence (opt3) from Lassa virus__AIT17577__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucggaggcgcacaggguacccagccugggcgggauggagugguacgcguuugggacgugaaaaacccagaucuucugaauaaccaauucggcacaaugccgaguuugacccucgccugucugacuaagcagggccaggucgacuuaaaugaugcugugcuggcacucacagaccuugggcugauuuacaccgccaaguaucccaacagcucugacuuggaucgacuaucccaaucacauccuauccugaauaugguggacacgaaaaagagcagucucaacauuucuggauacaauuuuucccugggugcugccgucaaagcgggcgcaugcaugcuugaugggggaaacaugcuggagacuaucaagguuaccccacagacaauggacggcauauugaaaagcauccucaaggugaaaagaucgcuggguauguucguaucugauacucccggggaaaggaauccuuaugagaacauuuuauacaagaucugucuguccggagacggcuggccauauauugccucacggaccaguaucgcuggccgugccugggaaaacacaaccguggaucuagagagcgacgggaagccccagaaagucggagcagcugguuccaauaagucucuccagagcgccggcuuuccuacggggcugacuuacucacaacuuaugacauugaaagauaguaugaugcagcuggacccauccgcgaagaccuggauagauauugagggacgcccggaagaccccguggagaucgcccucuaccagccuaugagcggcugcuauauucacuucuuuagagaaccaacugaccugaaacaguucaagcaagaugcaaaguacucucaugguaucgacguugcugaucuuuuucccgcccagccugggcugacaucagcugugaucgaggccuugccaaggaacaugguccucaccugucagggcagugacgauauuaaacggcuguuagacagccagggacgacgcgauauaaagcugaucgacauugcacuauccaaagccgauucuagaagguucgaaaaugcugugugggaccaaugccgggaucucugucacaugcauacgggcguaguuguggagaagaaaaagcgcgggggaaaggaggaaaucacaccccacugcgcgcugauggacuguauaauguaugaugcagccgucucggguggccuuaacauuccgguguugagagcuguccugccuagggacaugguguuucguaccagcucccccaaaguugugcucuga

SEQ ID NO: 1816 - RNA, 1710 nt, Artificial Sequence
  derived and/or modified CDS sequence (opt3) from Lassa virus__AIT17581__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaagugugcucaggguuggaacucugacguccgacgaucugcucaccuuagcggcugaccuggagaaguugaaaucuaaggugauucggacagaacgccccuugagcuccggugucuauaugggcaaccugucagcccagcaacuagagcagagaaggacucuccugaauaugauagggauggugggaggcgcacaggguacccagccugggcgggauggaguaguucgcgugugggacgucaaaaacccagaucuucugaauaaccaauucggcacaaugccgaguuugacccucgccugucugacuaagcagggccagguggacuuaaaugaugugguccuggcucucacagaccuugggcugaucuacaccgcaaaguaucccaacagcucugacuuggaucgacuaucccaaucacauccuauucugagcaugguugacacgaaaaagaguucucucaauaucuccggauacaacuuuagccugggugccgcugugaaagccggcgcgugcaugcuugaugggggaaauaugcuggagacuauuaagguaaccccacagacaauggacggcaucuugaaaucgauacucaaggugaaaaagucucuggguauguucgucuccgauacucccggggaaagaaacccuuaugagaauaucuuauacaagauuugucugucaggagacggcuggccauauaucgcaaguaggaccagcauugugggccgggccugggaaaacacaaccguugaucuagaguccgacgggaaaccccagaaggugggaacggcugguucuaacaaaagccuccagucagccggcuuuccuacugggcugacauacagucaacuuaugaccuugaaggauuccaugaugcagcuggacccaagcgcaaaaacuuggaucgauauagagggacguccggaagaccccgucgagauugcucucuaccagccuaugucuggcugcuauauccacuucuuucgcgaaccaacagaccugaagcaguucaagcaagaugccaaauacucacaugguauugacgugaccgaucuuuuucccgcgcagccugggcugacgagugccguaaucgaggcauugccaagaaauaugguucucaccugucagggcagcgacgauaucaagaggcuguuagacucccagggacggcgagauauuaaacugauagacaucgcucuaucuaaggccgauucgcgcagauucgaaaacgcugugugggaccaaugcaaagaucucugucacaugcauacaggcgucguggucgagaagaagaaaaggggagggaaggaggaaauuacuccccacugcgcccugauggacuguaucauguaugaugcagccgugagcgguggccuuaauauaccgguuuugcgggcugugcugccucgcgacaugguauuuagaaccuccucacccaaagucgugcucuga

SEQ ID NO: 1817 - RNA, 1710 nt, Artificial Sequence
  derived and/or modified CDS sequence (opt3) from Lassa virus__AIT17589__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucagcccagcaacuagagcagagaagggcacuccugaauaugaucgggauggucggaggcgcccaggguacucagccugggcgggauggagugguacgcguuugggacgugaaaaacccagaucuucugaauaaccaauucggcaccaugccgaguuugacacucgcuugucugaccaagcagggccaggucgacuuaaaugaugcagugcuggcccucacugaccuugggcugauuuacacagcuaaguaucccaacagcucugacuuggaucgacuaucccaaucacauccuauccugaauaugguggacaccaaaaagagcagucucaacauuucuggauacaauuuuucccugggugccgcggucaaagcaggcgccugcaugcuugaugggggaaacaugcuggagacgaucaagguuacuccacagaccauggacggcauauugaaaagcauccucaaggugaaaagaucgcuggguauguucguaucugauacacccggggaaaggaauccuuaugagaacauuuuauacaagaucugucuguccggagacggcuggccauauauugcuucacggaccaguaucgugggccgugccugggaaaacacuacagucgaucuagagagcgacgggaagccccagaaagugggaaccacggguuccaauaagucucuccagagcgcaggcuuuccuacugggcugacauacucacaacuuaugaccuugaaagauaguaugaugcagcuggacccauccgcuaagacuuggauagauauugagggacgcccggaagaccccguugagaucgcccucuaccagccuaugagcggcugcuauauucacuucuuuagagaaccaacagaccugaaacaguucaagcaagaugcgaaguacucucaugguaucgacguggccgaucuuuuucccgcacagccugggcugaccucagcugucaucgaggccuugccaaggaacauggugcucacgugucagggcagugacgauauuaaaaagcuguuagacagccagggacggcgagauauaaaacugaucgacauugcucuauccaaggccgauucucgcaaauucgaaaaugcaguaugggaccaaugcaaggaucucugucacaugcauaccggcguuguggucgagaagaaaaagagagggggaaaagaggaaaucacaccccacugcgcccugauggacuguauaauguaugaugcugcggugucggguggccuuaacauuccggucuugagggcagugcugccucgggacaugguuuuucgcacuagcucccccaaggugguacucuga

SEQ ID NO: 1818 - RNA, 1710 nt, Artificial Sequence
  derived and/or modified CDS sequence (opt3) from Lassa virus__AIT17593__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauggagaccucaagcgucugagagaucuuaaucaagccgugaacaaucuggucgaauugaagucaacacagcagaaaagcauucucaggguggguacucugacgagugacgaucugcucaccuuagcggcugaccuggagaaacuuaaguccaagguuauacggacagaacgccccuugucuagcggcguguauauggggaaccuguccucacagcaacuagagcagagaagggcccuccugaauaugaucggaauggucggcggugcacaggggacucagccuggacgggauggcgugguacgcguuugggacgugaaaaacccagaucuucugaauaaccaauucggcaccaugccgaguuugacacucgccugucugaccaagcaggggcaggucgacuuaaaugaugcugugcuggcacucacugaccuuggacugauuuacacagccaaguaucccaacagcucugacuuggaucgacuaucccaaucacauccuauccugaauaugguggacaccaaaaagagcagucucaacauuucugguuacaauuuuucccugggcgcugccgucaaagcgggggcaugcaugcuugauggaggcaacaugcuggagacgaucaagguuacuccacagaccauggacgguauauugaaaagcauccucaaggugaaaagaucgcuggggauguucguaucugauacacccggagaaaggaauccuuaugagaacauuuuauacaagaucugucuguccggcgacggcuggccauauauugccucacggaccaguaucguggggcgugcuugggaaaacaccacagucgaucuagagagcgacggaaagccccagaaagugggugccgcaggcuccaccaagucucuccagagcgcuggguuuccuacgggacugacuuacucacaacuuaugacauugaaagauaguaugaugcagcuggacccauccgccaagaccuggauagauauugagggccgcccggaagaccccguugagaucgcgcucuaccagccuaugagcgguugcuauauucacuucuuuagagaaccaacugaccugaaacaguucaagcaagaugccaaguacucucaugggaucgacguggcagaucuuuuucccgcucagccuggccugacaucagccgucaucgaggcuuugccaaggaauauggugcucaccugucagggaagugacgauauuaaacggcuguuagacagccagggccgacgcgauauaaagcugaucgacauugcccuauccaaaguagauucuagaagguucgaaaacgcaguuugggaccaaugcaaggaucucugucacaugcauacggggguggucguggagaaaaagaagcggggagguaaagaggaaaucacuccccacugcgcccugauggacuguauaauguaugaugcugcggucucgggcgggcuuaauauuccgguguugcgcgcaguucugccuagagacaugguguuuaggacaagcucccccaagguaguccucuga

SEQ ID NO: 1819 - RNA, 1710 nt, Artificial Sequence
  derived and/or modified CDS sequence (opt3) from Lassa virus__AIT17605__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaacuuaagucuaagguuauacggacagaacgccccuugagcuccgguguguauaugggcaaccugucaacucagcaacuagagcagagaagggcccuccugaauaugaucgggauggcaggaggcgcccaggguacccagccugggcgggauggagucgugcgcguaugggacguuaaaaacccagaucuucugaauaaccaauucggcacaaugccgaguuugacccucgcuugucugacuaagcagggccagguggacuuaaaugaugcaguccuggcccucacagaccuugggcugauuuacaccgcuaaguaucccaacagcucugacuuggaucgacuaucccaaucacauccuauccugaauaugguggacacgaaaaagagcagucucaacauuucuggauacaauuuuucccugggugccgcggugaaagcaggcgccugcaugcuugaugggggaaacaugcuggagacuaucaaggucaccccacagacaauggacggcauauugaaaagcauccucaagguuaaaaagucgcuggguauguucgugucugauacucccggggaaagaaauccuuaugagaacauuuuauacaagaucugucuguccggagacggcuggccauauauugcuucaaggaccaguaucguaggccgggccugggaaaacacaaccguggaucuagagagcgacgggaaaccccagaaggucggaacggcagguuccaauaaaucucuccagagcgcuggcuuuccuacugggcugacauacucacaacuuaugaccuugaaggauaguaugaugcagcuggacccauccgccaaaacuuggauagauauugagggacguccggaagaccccguggagaucgcgcucuaccagccuaugagcggcugcuauauucacuucuuucgcgaaccaacagaccugaagcaguucaagcaagaugccaaauacucucaugguaucgacguugcagauuuguuuucagcucagcccgggcugaccagugccgugaucgaggcuuugccuagaaacaugguccucacgugucagggcagcgacgauauuaagaggcuguuagacucccagggacggcgagauauaaaacugaucgacauugcccuaucuaaggcagauucgcgcagauucgaaaaugccgugugggaccaaugcaaagaucucugucacaugcauaccggcguaguuguggagaagaagaaaaggggagggaaggaggaaaucacaccacacugcgcucugauggacuguauaauguaugaugcggcagucagcgguggccuuaacauucccguguugcgggccguccugccgcgcgacaugguguuuagaacuuccucaccuaaaguugugcucuga

SEQ ID NO: 1820 - RNA, 1710 nt, Artificial Sequence
  derived and/or modified CDS sequence (opt3) from Lassa virus__AIT17609__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggcaggaggcgcccaggguacccagccugggcgggauggagucgugcgcguaugggacguuaaaaacccagaucuucugaauaaccaauucggcacaaugccgaguuugacccucgcuugucugacuaagcagggccagguggacuuaaaugaugcaguccuggcccucacagaccuugggcugauuuacaccgcuaaguaucccaacagcucugacuuggaucgacuaucccaaucacauccuauccugaauaugguggacacgaaaaagagcagucucaacauuucuggauacaauuuuucccugggugccgcggugaaagcaggcgccugcaugcuugaugggggaaacaugcuggagacuaucaaggucaccccacagacaauggacggcauauugaaaagcauccucaagguuaaaagaucgcuggguauguucgugucugauacucccggggaaaggaauccuuaugagaacauuuuauacaagaucugucuguccggagacggcuggccauauauugcuucacggaccaguaucguaggccgugccugggaaaacacaaccguggaucuagagagcgacgggaagccccagaaagucggagcagcugguuccaauaagucucuccagagcgccggcuuuccuacggggcugacuuacucacaacuuaugacauugaaagauaguaugaugcagcuggacccauccgcgaagaccuggauagauauugagggacgcccggaagaccccguggagaucgcccucuaccagccuaugagcggcugcuauauucacuucuuuagagaaccaacugaccugaaacaguucaagcaagaugcaaaguacucucaugguaucgacguugcugaucuuuuucccgcccagccugggcugacaucagcugugaucgaggccuugccaaggaacaugguccucaccugucagggcagugacgauauuaaacggcuguuagacagccagggacgacgcgauauaaagcugaucgacauugcacuauccaaagccgauucuagaagguucgaaaaugcugugugggaccaaugcaaggaucucugucacaugcauacgggcguaguuguggagaaaaagaagcgcgggggaaaagaggaaaucacaccccacugcgcgcugauggacuguauaauguaugaugcagccgucucggguggccuuaacauuccgguguugcgggcuguccugccuagagacaugguguuuaggaccagcucccccaagguugugcucuga

SEQ ID NO: 1821 - RNA, 1710 nt, Artificial Sequence
  derived and/or modified CDS sequence (opt3) from Lassa virus__AIT17613__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaacaugaucgggauggucggaggcgcacaggguacccagccugggcgggauggagugguacgcguuugggacgugaaaaauccagaucuucugaacaaucaauucggcacaaugccgucauugacccucgccugucugacuaagcagggccaggucgacuuaaacgaugcugugcuggcacucacagaccuugggcugauuuacaccgccaaguaucccaauaguagcgacuuggaucgacuaucucaaucccauccuauccugaacaugguggacacgaaaaagucaagccucaauauuaguggauacaacuuuucucugggugcugccgucaaagcgggcgcaugcaugcuugaugggggaaauaugcuggagacuaucaagguuaccccacagacaauggacggcauauugaaauccauccucaaggugaaaagaagccuggguauguucguaucggauacucccggggaaaggaacccuuaugagaacauuuuauacaagaucugucugucuggagacggcuggccauauauugccucccggaccucaaucgugggccgugcuugggaaaauacaaccgucgaucuagagagugacgggaagccccagaaagugggaacggccgguagcaacaagucccuccagucugcaggcuuuccuacugggcugacauacagccaacuuaugaccuugaaagauucaaugaugcagcuggacccaagugcuaagacuuggauagauauugagggacgcccggaagaccccguugagaucgcccucuaccagccuauguccggcugcuauauucacuucuuuagagaaccaacagaccugaaacaguucaagcaagaugcgaaguacagccaugguaucgacguggccgaucuuuuucccgcacagccugggcugaccucugcugucaucgaggccuugccaaggaauauggugcucacgugucagggcucagacgauauuaaacggcuguuagacagucagggacgacgcgauauaaagcugaucgacauugcucuaagcaaaaccgauuccagaagguucgaaaacgccguaugggaccaaugcaaggaucucugucacaugcauacaggcguuguggucgagaaaaagaagcgcgggggaaaagaggaaaucacuccccacugcgcacugauggacuguauaauguaugaugccgcugugucugguggccuuaauauuccggucuugcgggcggugcugccuagagacaugguuuuuaggaccucgagccccaaggugguacucuga

SEQ ID NO: 1822 - RNA, 1710 nt, Artificial Sequence
  derived and/or modified CDS sequence (opt3) from Lassa virus__AIT17617__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucagcccagcaacuagagcagagaagggcacuccugaauaugaucgggauggucggaggcgcccaggguacucagccugggcgggauggagugguacgcguuugggacgugaaaaacccagaucuucugaauaaccaauucggcaccaugccgaguuugacacucgcuugucugaccaagcagggccaggucgacuuaaaugaugcagugcuggcccucacugaccuugggcugauuuacacagcuaaguaucccaacagcucugacuuggaucgacuaucccaaucacauccuauccugaauaugguggacaccaaaaagagcagucucaacauuucuggauuuaauuucucccugggugccgcggucaaagcaggcgccugcaugcuugaugggggaaacaugcuggagacgaucaagguuacuccacagaccauggacggcauauugaaaagcauccucaaggugaaaagaucgcuggguauguuuguaucugauacacccggggaaaggaauccuuacgagaacauuuuauauaagaucugucuguccggagacggcuggccauacauugcuucacggaccaguaucgugggccgugccugggaaaacaccacagucgaucuagagagcgacgggaagccccagaaagugggaaccgcagguuccaauaagucucuccagagcgcuggcuucccuacggggcugacuuauucacaacuuaugacauugaaagauaguaugaugcagcuggacccauccgccaagaccuggauagauauugagggacgcccggaagaccccguugagaucgcgcucuaccagccuaugagcggcugcuacauucacuuuuucagagaaccaacugaccugaaacaguuuaagcaagaugccaaguauucucaugguaucgacguggcagaucuuuuccccgcucagccugggcugacaucagccgucaucgaggcuuugccaaggaacauggugcucaccugucagggcagugacgauauuaaacggcuguuagacagccagggacgacgcgauauaaagcugaucgacauugcccuauccaaagcagauucuagaagguuugaaaaugccguaugggaccaaugcaaggaucucugucacaugcauacgggcguuguggucgagaaaaagaagcgcgggggaaaagaggaaaucacuccccacugcgcucugauggacuguauaauguacgaugcggcagugucggguggccuuaacauuccggucuugcgggccgugcugccuagagacaugguuuucaggacaagcucccccaaggugguacucuga

SEQ ID NO: 1823 - RNA, 1710 nt, Artificial Sequence
  derived and/or modified CDS sequence (opt3) from Lassa virus__AIT17621__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugacaaacguacagcggcuaaugcgcaagcagaaacgagacgauucggaccucaagcgucugagagaucuuaaucaagccgugaacaaucuggucgaauugaagucaacucagcagaaaagcauucucagggugggaacgcugaccagugacgaucugcucacauuagcggcugaccuggagaaacuuaaguccaagguuauacggacugaacgccccuugucuagcgguguguauaugggcaaccuguccacccagcaacuagagcagagaagggcccuccugaauaugaucgggauggucggaggcgcacaggguacacagccugggcgggauggagugguacgcguuugggacgugaaaaacccagaucuucugaauaaccaauucggcaccaugccgucauugacucucgccugucugacaaagcagggccaggucgacuuaaaugaugcugugcuggcacucaccgaccuugggcugauuuacacggccaaguaucccaacaguagcgacuuggaucgacuaucucaaucccauccuauccugaauaugguggacacuaaaaagucaagccucaacauuaguggauacaauuuuucucugggugcugccgucaaagcgggcgcaugcaugcuugaugggggaaacaugcuggagaccaucaagguuacaccacagacuauggacggcauauugaaauccauccucaaggugaaaagaagccuggguauguucguaucggauacccccggggaaaggaauccuuaugagaacauuuuauacaagaucugucugucuggagacggcuggccauauauugccucccggacaucaaucgugggccgugcuugggaaaacaccacggucgaucuagagagugacgggaagccccagaaagugggaauagccgguagcaauaagucccuccagucugcaggcuuuccuacugggcugacauacagccaacuuaugaccuugaaagauucaaugaugcagcuggacccaagugcuaagacuuggauugauaucgagggacgcccggaagaccccguugagauugcccucuaccagccuauguccggcugcuauauccacuucuuuagagaaccaacagaccugaaacaguucaagcaagaugcgaaguacagccaugguaucgacguggccgaucuuuuucccgcacagccugggcugaccucugcugucauugaggccuugccaaggaacauggugcucacgugucagggcucagacgauauaaaacggcuguuagacagucagggacgacgcgauaucaagcugauugacaucgcucuaagcaaagccgauuccagaaaguucgaaaaugcaguaugggaccaaugcaaagaucucugucacaugcauaccggcguuguggucgagaagaagaaaaggggagggaaggaggaaauaacaccccacugcgcccugauggacuguauuauguaugaugcugcggugucugguggccuuaacaucccggucuugcgggcagugcugccucgcgacaugguuuuuagaacuucgagccccaaagugguacucuga

SEQ ID NO: 1824 - RNA, 1710 nt, Artificial Sequence
  derived and/or modified CDS sequence (opt3) from Lassa virus__AIT17625__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagcgacgugacgauucagaccucaaaagacugagggaucuuaaucaagccgugaacaaucuggucgaacucaagagcacacagcagaagaguauuuugcgggugggaacucugacguccgacgaucugcucaccuuagcggcugaccuggagaaacuuaagucuaaaguuauacgcacagaaagacccuugagcuccgguguguauaugggcaaccugucaacucagcaacuagagcagaggcgggcccuccugaauaugaucgggauggucggaggcgcacaggguacccagccugggcgcgauggagugguacgaguuugggacgugaagaacccagaucuucugaauaaccaauucggcacaaugccgaguuugacccucgccugucugacuaaacagggccaggucgacuuaaaugaugcugugcuggcacucacagaccuugggcugauuuacaccgccaaguaucccaacagcucugacuuggauagacuaucccaaucacauccuauccugaauaugguggacacgaagaaaagcagucucaacauuucuggauacaauuuuucccugggugcugccgucaaggcgggcgcaugcaugcuugaugggggaaacaugcuggagacuaucaaaguuaccccacagacaguggacggcauacucaagagcaucuugaaaguaaagaggucgcuggguauguucgugucugauacucccggggaacggaauccuuaugagaacauuuuauacaaaaucugucuguccggagacggcuggccauauauugccucacguaccaguaucgucggccgcgcuugggaaaacacaaccguggaucuagagagcgacgggaagccccagaagguuggaacggccgguuccaauaaaucucuccagagcgcaggcuuuccuacugggcugacauacucacaacuuaugaccuugaaggauaguaugaugcagcuggacccauccgcuaaaacuuggauagauauugagggaagaccggaagaccccguggagaucgcccucuaccagccuaugagcggcugcuauauucacuucuuuagggaaccaacagaccugaagcaguucaaacaagaugcgaaguacucucaugguaucgacgucgccgaucuuuuucccgcacagccugggcugaccucagcugugaucgaggccuugccacggaacaugguacucacgugucagggcagugacgauauuaagcgacuguuagacagccagggacgcagagauauaaaacugaucgacauugcucuauccaaggccgauucuaggaaauucgaaaaugcaguuugggaccaaugcaaggaucucugucacaugcauaccggcguggucguggagaaaaagaagcgcgggggaaaagaggaaaucacaccccacugcgcccugauggacuguauaauguaugaugcugcggucucggguggccuuaacauuccgguguugcgggcaguucugccuagagacaugguguuuaggacuagcucccccaagguaguccucuga

SEQ ID NO: 1825 - RNA, 1710 nt, Artificial Sequence
  derived and/or modified CDS sequence (opt3) from Lassa virus__AIT17627__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaagucagcaacuagagcagagaagggcccuccugaauaugaucgggauggucggaggcgcacaggguacucagccugggcgggauggagugguacgcguuugggacgugaaaaacccagaucuucugaauaaccaauucggcaccaugccgagcuugacacucgccugucugaccaagcagggccaggucgacuuaaaugaugcugugcuggcacucacugaccuugggcugauuuacacagccaaguaucccaacucuuccgacuuggaucgacuaucacaaagccauccuauccugaauaugguggacaccaaaaagaguucucucaacauuuccggauacaauuuuagccugggugcugccgucaaagcgggcgcaugcaugcuugaugggggaaacaugcuggagacgaucaagguuacuccacagaccauggacggcauauugaaaucgauccucaaggugaaaagaucucuggguauguucguauccgauacacccggggaaaggaauccuuaugagaacauuuuauacaagaucugucugucaggagacggcuggccauauauugccagucggacuagcaucgugggccgugcuugggaaaacaccacagucgaucuagaguccgacgggaagccccagaaagugggaucugccgguagcaauaagucacuccagagugcaggcuuuccuaccgggcugacguacucccaacuuaugacuuugaaagauagcaugaugcagcuggacccaucugcuaagacauggauagauauugagggacgcccggaagaccccguugagaucgcccucuaccagccuaugucaggcugcuauauucacuucuuuagagaaccaaccgaccugaaacaguucaagcaagaugcgaaguacagucaugguaucgacguggccgaucuuuuucccgcacagccugggcugacuagcgcugucaucgaggccuugccaaggaacauggugcucacaugucagggcuccgacgauauuaaacggcuguuagacucucagggacgacgcgauauaaagcugaucgacauugcucuaucgaaagccgauagcagaagguucgaaaaugcaguaugggaccaaugcaaggaucucugucacaugcauaccggcguuguggucgagaaaaagaagcgcgggggaaaagaggaaaucacgccccacugcgcccugauggacuguauaauguaugaugcugcgguguccgguggccuuaacauuccggucuugcgggcagugcugccuagagacaugguuuuuaggaccucaagucccaaggugguacucuga

SEQ ID NO: 1826 - RNA, 1710 nt, Artificial Sequence
  derived and/or modified CDS sequence (opt3) from Lassa virus__AIT17631__NP
augagcgccuccaaggagaucaaaucuuuccuguggacccagucacucagaagggaacuuaguggcuacugcagcuccauuaagcugcaaguggucaaagacgcucaggcauuguuacacgggcuggauuuuucugagguuucgaacgugcagcggcuaaugcgcaagcagaaacgagacgauucagaccucaagcgucugagagaucuuaaucaagccguaaacaaucugguggaacuuaagagcacacagcagaaaaguauacucagggucggaacucugacguccgacgaucugcucaccuuagcggcugaccuggagaaguugaaaucuaaggugauccggacagaacgccccuugagcuccgguguuuauaugggcaaccugucaacucagcaacuagagcagagaagggcccuccugaauaugauugggauggugggaggcgcacaggguacccagccugggcgggauggagucgugcgcguaugggacguuaaaaacccagaucuucugaauaaccaauucggcacaaugccgaguuugacccucgccugucugacuaagcagggccagguggacuuaaaugaugcuguccuggcacucacagaccuugggcugaucuacaccgccaaguaucccaacagcucugacuuggaucgacuaucccaaucacauccuauucugaauaugguggacacgaaaaagagcagucucaacaucucuggauacaauuuuucccugggugcugccgugaaagcgggcgcaugcaugcuugaugggggaaacaugcuggagacuauaaaggucaccccacagacaauggacggcaucuugaaaagcauucucaagguuaaaagaucgcuggguauguucgugucugaugcccccggggaaaggaauccuuaugagaacaucuuauacaagauuugucuguccggagacggcuggccauauaucgcuucacggaccaguauaguaggccgugccugggaaaacaccacaguggaucuagagagcgacgggaagccccagaaagucggaaccgcagguuccaauaagucucuccagagcgcuggcuuuccuacggggcugacuuacucacaacuuaugacauugaaagauaguaugaugcagcuggacccauccgccaagaccuggauugauaucgagggacgcccggaagaccccguggagauugcgcucuaccagccuaugagcggcugcuauauccacuucuuuagagaaccaacugaccugaaacaguucaagcaagaugccaaguacucucaugguaucgacguugcagaucuuuuucccgcucagccugggcugacaucagccgugauugaggcuuugccaaggaacaugguccucaccugucagggcagugacgauauaaaacggcuguuagacagccagggacgacgcgauaucaagcugauugacaucgcccuauccaaagcagauucuagaagguucgaaaaugccgugugggaccaaugcaaggaucucugucacaugcauacgggcguaguuguggagaaaaagaagcgcgggggaaaagaggaaauaacuccccacugcgcucugauggacuguauuauguaugaugcggcagucucggguggccuuaacaucccgguguugcgggccguccugccuagagacaugguguuuaggacaagcucccccaagguugugcucuga

SEQ ID NO: 1827 - RNA, 1710 nt, Artificial Sequence
  derived and/or modified CDS sequence (opt3) from Lassa virus__AIT17635__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauaacgaccucaagcgucugagagaucuuaaucaagccgugaacaaucuggucgaauugaagucgacacagcagaaaucaauucucagggugggaacucugacgagcgacgaucugcucaccuuagcggcugaccuggagaaacuuaagaguaagguuauacggacagaacgccccuuguccucugguguguauaugggcaaccugaauacucagcaacuagagcagagaagggcccuccugaacaugaucgggauggucggaggcgcacaggguacccagccugggcgggauggagugguacgcguuugggacgugaaaaauccagaucuucugaacaaucaauucggcacaaugccgagcuugacccucgccugucugacuaagcagggccaggucgacuuaaacgaugcugugcuggcacucacagaccuugggcugauuuacaccgccaaguaucccaauuccucagacuuggaucgacuaagucaaagccauccuauccugaacaugguggacacgaaaaagucuucccucaauauuucaggauacaacuuuagccugggugcugccgucaaagcgggcgcaugcaugcuugaugggggaaacaugcuggagacuaucaagguuaccccacagacaauggacggcauauugaaaaguauccucaaggugaaaaagucucuggguauguucguauccgauacucccggggaaagaaauccuuaugagaacauuuuauacaagaucugucugagcggagacggcuggccauauauugccucgaggaccucuaucgugggccgggcuugggaaaauacaaccgucgaucuagaguccgacgggaaaccccagaaggugggaacggccgguucaaacaaaagucuccagagcgcaggcuuuccuacugggcugacauacucccaacuuaugaccuugaaggauucuaugaugcagcuggacccaagcgcuaaaacuuggauagauauugagggacguccggaagaccccguugagaucgcccucuaccagccuaugucaggcugcuauauucacuucuuucgcgaaccaacagaccugaagcaguucaagcaagaugcgaaauacagucaugguaucgacguggccgaucuuuuucccgcacagccugggcugaccuccgcugucaucgaggccuugccaagaaauauggugcucacgugucagggcagcgacgauauuaagaggcuguuagacucucagggacggcgagauauaaaacugaucgacauugcucuaucaaaggccgauagucgcagauucgaaaacgcaguaugggaccaaugcaaagaucucugucacaugcauaccggcguuguggucgagaagaagaaaaggggagggaaggaggaaaucacaccccacugcgcccugauggacuguauaauguaugaugcugcggugagcgguggccuuaauauuccggucuugcgggcagugcugccucgcgacaugguuuuuagaacuuccucucccaaagugguacucuga

SEQ ID NO: 1828 - RNA, 1710 nt, Artificial Sequence
  derived and/or modified CDS sequence (opt3) from Lassa virus__AIT17639__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaacaugaucgggauggucggaggcgcacaggguacccagccugggcgggauggagugguacgcguuugggacgugaaaaauccagaucuucugaacaaucaauucggcacaaugccgucauugacccucgccugucugacuaagcagggccaggucgacuuaaacgaugcugugcuggcacucacagaccuugggcugauuuacaccgccaaguaucccaauaguagcgacuuggaucgacuaucucaaucccauccuauccugaacaugguggacauuaaaaagucaagccucaauaucaguggauacaacuuuucucugggugcugccgucaaagcgggcgcaugcaugcuugaugggggaaauaugcuggagacgauaaagguuacuccacagaccauggacggcaucuugaaauccauucucaaggugaaaagaagccuggguauguucguaucggauacacccggggaaaggaacccuuaugagaacaucuuauacaagauuugucugucuggagacggcuggccauauaucgccucccggacuucaauagugggccgugcuugggaaaauaccacagucgaucuagagagugacgggaagccccagaaagugggaagcgccgguuccaacaagucucuccagagcgcaggcuuuccuaccgggcugacguacucacaacuuaugacuuugaaagauaguaugaugcagcuggacccauccgcuaagacauggauugauaucgagggacgcccggaagaccccguugagauugcccucuaccagccuaugagcggcugcuauauccacuucuuuagagaaccaaccgaccugaaacaguucaagcaagaugcgaaguacucucaugguaucgacguggccgaucuuuuucccgcacagccugggcugacuucagcugucauugaggccuugccaaggaauauggugcucacaugucagggcagugacgauauaaaacggcuguuagacagccagggacgacgcgauaucaagcugauugacaucgcucuauccaaagccgauucuagaagguucgaaaacgcaguaugggaccaaugcaaggaucucugucacaugcauaccggcguuguggucgagaaaaagaagcgcgggggaaaagaggaaauaacgccccacugcgcccugauggacuguauuauguaugaugcugcggugucggguggccuuaauaucccggucuugcgggcagugcugccuagagacaugguuuuuaggaccagcucccccaaggugguacucuga

SEQ ID NO: 1829 - RNA, 1710 nt, Artificial Sequence
  derived and/or modified CDS sequence (opt3) from Lassa virus__AIT17643__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccgcccagcaacuagagcagagaagggcacuccugaacaugaucgggauggucggaggcgcccaggguacucagccugggcgggauggagugguacgcguuugggacgugaaaaauccagaucuucugaacaaucaauucggcaccaugccgucauugacacucgcuugucugaccaagcagggccaggucgacuuaaacgaugcagugcuggcccucacugaccuugggcugauuuacacagcuaaguaucccaauaguagcgacuuggaucgacuaucucaaucccauccuauccugaacaugguggacaccaaaaagucaagccucaauauuaguggauacaacuuuucucugggugccgcggucaaagcaggcgccugcaugcuugaugggggaaauaugcuggagacgaucaagguuacuccacagaccauggacggcauauugaaauccauccucaaggugaaaaagagccuggguauguucguaucggauacacccggggaaagaaacccuuaugagaacauuuuauacaagaucugucugucuggagacggcuggccauauauugcuuccaggacuucaaucgugggccgggccugggaaaauaccacagucgaucuagagagugacgggaaaccccagaaggugggaaccgcagguagcaacaaaucccuccagucugcuggcuuuccuacggggcugacuuacagccaacuuaugacauugaaggauucaaugaugcagcuggacccaagugccaaaaccuggauagauauugagggacguccggaagaccccguugagaucgcgcucuaccagccuauguccggcugcuauauucacuucuuucgcgaaccaacugaccugaagcaguucaagcaagaugccaaauacagccaugguaucgacguggcagaucuuuuucccgcucagccugggcugacaucugccgucaucgaggcuuugccaagaaauauggugcucaccugucagggcucagacgauauuaagaggcuguuagacagucagggacggcgagauauaaaacugaucgacauugcccuaagcaaggcagauucccgcagauucgaaaacgccguaugggaccaaugcaaagaucucugucacaugcauacgggcguuguggucgagaagaagaaaaggggagggaaggaggaaaucacaccccacugcgcucugauggacuguauaauguaugaugcggcagugucugguggccuuaauauuccggucuugcgggccgugcugccucgcgacaugguuuuuagaaccucgagccccaaagugguacucuga

SEQ ID NO: 1830 - RNA, 1710 nt, Artificial Sequence
  derived and/or modified CDS sequence (opt3) from Lassa virus__AIT17651__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaagugugcucaggguuggaacucugacguccgacgaucugcucaccuuagcggcugaccuggagaaguugaaaucuaaggugauucggacagaacgccccuugagcuccggugucuauaugggcaaccugucagcccagcaacuagagcagagaagggcacuccugaauaugauagggauggugggaggcgcccaggguacucagccugggcgggauggaguaguucgcgugugggacgucaaaaacccagaucuucugaauaaccaauucggcaccaugccgaguuugacacucgcuugucugaccaagcagggccagguggacuuaaaugaugugguccuggcacucacugaccuugggcugaucuacacagccaaguaucccaacagcucugacuuggaucgacuaucccaaucacauccuauucugaauaugguugacaccaaaaagagcagucucaacaucucuggauacaauuuuucccugggugcugccgugaaagcgggcgcaugcaugcuugaugggggaaacaugcuggagacgauuaagguaacuccacagaccauggacggcaucuugaaaagcauacucaaggugaaaaagucgcuggguauguucgucucugauacacccggggaaagaaauccuuaugagaacaucuuauacaagauuugucuguccggagacggcuggccauauaucgccucaaggacuucaauugugggccgggcuugggaaaacaccacaguugaucuagagagcgacgggaaaccccagaaggugggaaccgccgguuccaauaaaucucuccagagcgcaggcuuuccuacggggcugacuuacucacaacuuaugacauugaaggauaguaugaugcagcuggacccauccgcuaaaaccuggaucgauauagagggacguccggaagaccccgucgagauugcccucuaccagccuaugagcggcugcuauauccacuucuuucgcgaaccaacugaccugaagcaguucaagcaagaugcgaaauacucucaugguauugacgugacagaucuuuuuagugcccagcccgggcugaccagugcaguaaucgaggcuuugccuagaaacaugguucucacgugucagggcagcgacgauaucaagaggcuguuagacucccagggacggcgagauauuaaacugauagacaucgcccuaucuaaggcugauucgcgcagauucgaaaaugccgugugggaccaaugcaaagaucucugucacaugcauaccggcgucguggucgagaagaagaaaaggggagggaaggaggaaauuacaccacacugcgcacugauggacuguaucauguaugaugccgcugugagcgguggccuuaacauacccguuuugcgggcggugcugccgcgcgacaugguauuuagaacuuccucaccuaaagucgugcucuga

SEQ ID NO: 1831 - RNA, 1710 nt, Artificial Sequence
  derived and/or modified CDS sequence (opt3) from Lassa virus__AIT17655__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaaaaacccuugucuagcgguguguauaugggcaaucuguccacucagcaacuagagcagcgcagagcccuccugaacaugaucgggauggucggaggcgcacaggguacccagccugggagggauggagugguacggguuugggacgugaagaauccagaucuucugaacaaucaauucggcacaaugccgucauugacccucgccugucugacuaagcagggccaggucgacuuaaacgaugcugugcuggcacucacagaccuugggcugauuuacaccgccaaauuucccaauaguagcgacuuggaucgccuaucucaaucccauccuauccugaacaugguggacacgaagaaaucaagccucaauauuaguggauauaacuucucucugggugcugccgucaaggcgggcgcaugcaugcuugaugggggaaauaugcuggagacuaucaaaguuaccccacagacaauggacggcauauugaaguccauccucaaagugaaaaagagccuggguauguuuguaucggauacucccggggaacgaaacccuuacgagaacauuuuauauaagaucugucugucuggagacggcuggccauacauugccuccagaaccucaaucgugggcagggcuugggaaaauacaaccgucgaucuagagagugacgggaagccccagaaagugggaacgacugguagcaacaagucccuccagucugccggcuucccuacagggcugaccuauagccaacuuaugacuuugaaagauucaaugaugcagcuggacccaagugcaaagacauggauagauauugagggacggccggaagaccccguugagaucgcucucuaccagccuauguccggcugcuacauucacuuuuuccgugaaccaaccgaccugaagcaguuuaaacaagaugccaaguauagccaugguaucgacguggcggaucuuuuccccgcccagccugggcugacgucugcagucaucgaggcuuugccacgcaauauggugcucaccugucagggcucagacgauauuaaaagacuguuagacagucagggaaggcgggauauaaagcugaucgacauugcccuaagcaaagcugauucccgacgcuuugaaaacgccguaugggaccaaugcaaggaucucugucacaugcauacaggcguuguggucgagaagaaaaagagagggggaaaagaggaaaucacuccccacugcgcacugauggacuguauaauguacgaugccgcugugucugguggccuuaauauuccggucuugagggcggugcugccucgggacaugguuuuccgcaccucgagccccaaggugguacucuga

SEQ ID NO: 1832 - RNA, 1710 nt, Artificial Sequence
  derived and/or modified CDS sequence (opt3) from Lassa virus__AIT17659__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaagugugcucaggguuggaacucugacguccgacgaucugcucaccuuagcggcugaccuggagaaguugaaaucuaaggugauucggacagaacgccccuugagcuccggugucuauaugggcaaccugucaacucagcaacuagagcagagaagggcccuccugaguaugauagggauggugggaggcgcacaggguacccagccugggcgggauggaguaguucgcgugugggacgucaaaaauccagaucuucugaacaaucaauucggcacaaugccgagcuugacccucgccugucugacuaagcagggccagguggacuuaaacgaugcugugcuggcacucacagaccuugggcugaucuacaccgccaaguaucccaauucuuccgacuuggaucgacuaucacaaagccauccuauucugaacauggucgacacgaaaaagaguucucucaauaucuccggauacaacuuuagccugggugcugccguuaaagcgggcgcaugcaugcuugaugggggaaauaugcuggagacuauuaaggugaccccacagacaauggacggcaucuugaaaucgauacucaagguaaaaagaucucuggguauguucguguccgauacucccggggaaaggaacccuuaugagaauaucuuauacaagauuugucugucaggagacggcuggccauauaucgccagucggaccagcauugucggccgugcuugggaaaacacaaccguggaucuagaguccgacgggaagccccagaaaguuggaacggccgguucuaacaagagccuccagucagcaggcuuuccuacugggcugacauacagucaacuuaugaccuugaaagauuccaugaugcagcuggacccaagcgcuaagacuuggaucgauauagagggacgcccggaagaccccguggagauugcccucuaccagccuaugucuggcugcuauauccacuucuuuagagaaccaacagaccugaaacaguucaagcaagaugcgaaguacucacaugguauugacgucgccgaucuuuuucccgcacagccugggcugaccagugcugugaucgaggccuugccaaggaauaugguacucacgugucagggcagcgacgauaucaaacggcuguuagacucccagggacgacgcgauauuaagcugauagacaucgcucuaaacaaagccgauucuagaagguucgaaaaugcaguuugggaccaaugcaaggaucucugucacaugcauaccggcguggucguggagaaaaagaagcgcgggggaaaagaggaaauuacaccccacugcgcccugauggacuguaucauguaugaugcugcggucucggguggccuuaacauaccgguguugcgggcaguucugccuagagacaugguguuuaggacuagcucccccaagguaguccucuga

SEQ ID NO: 1833 - RNA, 1710 nt, Artificial Sequence
  derived and/or modified CDS sequence (opt3) from Lassa virus__AIT17663__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucggaggcgcacaggguacccagccugggcgggauggagugguacgcguuugggacgugaaaaacccagaucuucugaauaaccaauucggcacaaugccgaguuugacccucgccugucugacuaagcagggccaggucgacuuaaaugaugcugugcuggcacucacagaccuugggcugauuuacaccgccaaguaucccaacagcucugacuuggaucgacuaucccaaucacauccuauccugaauaugguggacacgaaaaagagcagucucaacauuucuggauacaauuuuucccugggugcugccgucaaagcgggcgcaugcaugcuugaugggggaaacaugcuggagacuaucaagguuaccccacagacaauggacggcauauugaaaagcauccucaaggugaaaagaucgcuggguauguucguaucugauacucccggggaaaggaauccuuaugagaacauuuuauacaagaucugucuguccggagacggcuggccauauauugccucacggaccaguaucgugggccgugcuugggaaaacacaaccgucgaucuagagagcgacgggaagccccagaaagugggaacggccgguuccaauaagucucuccagagcgcaggcuuuccuacugggcugacauacucacaacuuaugaccuugaaagauaguaugaugcagcuggacccauccgcuaagacuuggauagauauugagggacgcccggaagaccccguugagaucgcccucuaccagccuaugagcggcugcuauauucacuucuuuagagaaccaacagaccugaaacaguucaagcaagaugcgaaguacucucaugguaucgacguggccgaucuuuuucccgcacagccugggcugaccucagcugucaucgaggccuugccaaggaacauggugcucacgugucagggcagugacgauauuaaaaagcuguuagacagccagggacggcgagauauaaaacugaucgacauugcucuauccaaggccgauucucgcagauucgaaaaugcaguaugggaccaaugcaaagaucucugucacaugcauaccggcguuguggucgagaagaagaaaaggggagggaaggaggaaaucacaccccacugcgcccugauggacuguauaauguaugaugcugcggugucggguggccuuaacauuccggucuugcgggcagugcugccucgcgacaugguuuuuagaacuagcucccccaaagugguacucuga

SEQ ID NO: 1834 - RNA, 1710 nt, Artificial Sequence
  derived and/or modified CDS sequence (opt3) from Lassa virus__AIT17667__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucggaggcgcacaggguacccagccugggcgggauggagugguacgcguuugggacgugaaaaacccagaucuucugaauaaccaauucggcacaaugccgaguuugacccucgccugucugacuaagcagggccaggucgacuuaaaugaugcugugcuggcacucacagaccuugggcugauuuacaccgccaaguaucccaacagcucugacuuggaucgacuaucccaaucacauccuauccugaauaugguggacacgaaaaagagcagucucaacauuucuggauacaauuuuucccugggugcugccgucaaagcgggcgcaugcaugcuugaugggggaaacaugcuggagacuaucaagguuaccccacagacaauagacggcaucuugaaaagcauucucaaggugaaaaagucgcuggguauguucguaucugauacucccggggaaagaaauccuuaugagaacaucuuauacaagauuugucuguccggagacggcuggccauauaucgccucaaggaccaguauagugggccgggcuugggaaaacacaaccgucgaucuagagagcgacgggaaaccccagaaggugggaacgacugguuccaauaaaucucuccagagcgccggcuuuccuacagggcugaccuacucacaacuuaugacuuugaaggauaguaugaugcagcuggacccauccgcaaaaacauggauugauaucgagggacguccggaagaccccguugagauugcucucuaccagccuaugagcggcugcuauauccacuucuuucgcgaaccaaccgaccugaagcaguucaagcaagaugccaaauacucucaugguaucgacgugacggaucuuuuucccgcgcagccugggcugaccucagccgucauugaggcauugccaagaaacauggugcucacaugucagggcagugaagacauaaagaggcuguuagauagccagggacggcgagacaucaaacugauugauaucgcucuauccaaggccgacucucgcagauucgagaaugcuguaugggaucaaugcaaagaccucugucacaugcauacuggcguuguggucgagaagaagaaaaggggagggaaggaagagauaacaccccacugcgcccugauggauuguauuauguaugacgcagccgugucggguggccuuaacaucccggucuugcgggcugugcugccucgcgauaugguuuuuagaaccagcucccccaaagugguacucuga

SEQ ID NO: 1835 - RNA, 1710 nt, Artificial Sequence
  derived and/or modified CDS sequence (opt3) from Lassa virus__AIT17671__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaagugugcucaggguuggaacucugacguccgacgaucugcucaccuuagcggcugaccuggagaaguugaaaucuaaggugauucggacagaacgccccuugagcuccggugucuauaugggcaaccugucaacucagcaacuagagcagagaagggcccuccugaauaugauagggauggugggaggcgcacaggguacccagccugggcgggauggaguaguucgcgugugggacgucaaaaacccagaucuucugaauaaccaauucggcacaaugccgaguuugacccucgccugucugacuaagcagggccagguggacuuaaaugaugugguccuggcucucacagaccuugggcugaucuacaccgcaaaguaucccaacagcucugacuuggaucgacuaucccaaucacauccuauucugaauaugguugacacgaaaaagagcagucucaacaucucuggauacaauuuuucccugggugccgcugugaaagccggcgcgugcaugcuugaugggggaaacaugcuggagacuauuaagguaaccccacagacaauggacggcaucuugaaaagcauacucaaggugaaaaagucgcuggguauguucgucucugauacucccggggaaagaaauccuuaugagaacaucuuauacaagauuugucuguccggagacggcuggccauauaucgcaucaaggaccaguauugugggccgggccugggaaaacacaaccguugaucuagagagcgacgggaaaccccagaaggugggaacggcugguuccaauaaaucucuccagagcgccggcuuuccuacugggcugacauacucacaacuuaugaccuugaaggauaguaugaugcagcuggacccauccgcaaaaacuuggaucgauauagagggacguccggaagaccccgucgagauugcucucuaccagccuaugagcggcugcuauauccacuucuuucgcgaaccaacagaccugaagcaguucaagcaagaugccaaauacucucaugguauugacgugaccgaucuuuuucccgcgcagccugggcugacgucagccguaaucgaggcauugccaagaaacaugguucucaccugucagggcagugacgauaucaagaggcuguuagacagccagggacggcgagauauuaaacugauagacaucgcucuauccaaggccgauucucgcagauucgaaaaugcugugugggaccaaugcaaagaucucugucacaugcauacaggcgucguggucgagaagaagaaaaggggagggaaggaggaaauuacuccccacugcgcccugauggacuguaucauguaugaugcagccgugucggguggccuuaacauaccgguuuugcgggcugugcugccucgcgacaugguauuuagaaccagcucccccaaagucgugcucuga

SEQ ID NO: 1836 - RNA, 1710 nt, Artificial Sequence
  derived and/or modified CDS sequence (opt3) from Lassa virus__AIT17675__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacucaagagcacacagcagaaaaguguguugaggguuggaacucugacguccgacgaucugcucaccuuagcggcugaccuggagaaacuuaaaucuaaggugauucggacagaacgccccuugagcuccggugucuauaugggcaaccugucaacucagcaacuagagcagagaagggcccuccugaauaugauagggauggugggaggcgcacaggguacccagccugggcgggauggaguaguucgcgugugggacgucaaaaacccagaucuucugaauaaccaauucggcacaaugccgaguuugacccucgccugucugacuaagcagggccagguggacuuaaaugaugcugugcuggcacucacagaccuugggcugaucuacaccgccaaguaucccaacagcucugacuuggaucgacuaucccaaucacauccuauucugaauauggucgacacgaaaaagagcagucucaacaucucuggauacaauuuuucccugggugcugccguuaaagcgggcgcaugcaugcuugaugggggaaacaugcuggagacuauuaaggugaccccacagacaauggacggcaucuugaaaagcauacucaagguaaagaagucgcuggguauguucgugucugauacucccggggaaagaaauccuuaugagaacaucuuauacaagauuugucuguccggagacggcuggccauauaucgccucaaggaccaguauugucggccgggcuugggaaaacacaaucguggaucuagagagcgacgggaaaccccagaagguuggaaccgccgguuccaauaaaucucuccagagcgcaggcuuuccuacggggcugacuuacucacaacuuaugacauugaaggauaguaugaugcagcuggacccauccgcuaaaaccuggauagauauugagggacguccggaagaccccguggagaucgcccucuaccagccuaugagcggcugcuauauucacuucuuucgcgaaccaacugaccugaagcaguucaagcaagaugcgaaauacucucaugguaucgacgucgccgaucuuuuucccgcacagccugggcugacaucagcugugaucgaggccuugccaagaaacaugguacucaccugucagggcagugacgauauuaagaggcuguuagacagccagggacggcgagauauaaaacugaucgacauugcucuauccaaggccgauucucgcagauucgaaaaugcaguuugggaccaaugcaaagaucucugucacaugcauacgggcguggucguggagaagaagaaaaggggagggaaggaggaaaucacaccccacugcgcccugauggacuguauaauguaugaugcugcggucucggguggccuuaacauuccgguguugcgggcaguucugccucgcgacaugguguuuagaaccagcucccccaaaguaguccucuga

SEQ ID NO: 1837 - RNA, 1710 nt, Artificial Sequence
  derived and/or modified CDS sequence (opt3) from Lassa virus__AIT17679__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucggaggcgcacagaguacccagccuggucgggauggggugguacgcguuugggacgugaaaaacccagaucuucugaauaaccaauucggaacaaugccgagcuugacccucgccugucugacuaagcagggccaggucgacuuaaaugaugcugugcuggcacucacagaccuuggccugauuuacaccgccaaguaucccaacucuuccgacuuggaucgacuaucacaaagccauccuauccugaauaugguggacacgaaaaagaguucucucaacauuuccggguacaauuuuagccugggagcugccgucaaagcgggugcaugcaugcuugauggcgggaacaugcuggagacuaucaagguuaccccacagacaauggacggaauauugaaaucgauccucaaggugaaaagaucucugggcauguucguauccgauacucccggugaaaggaauccuuaugagaacauuuuauacaagaucugucugucaggggacggauggccauauauugccagucggaccagcaucgugggccgugcuugggaaaacacaaccgucgaucuagaguccgacggcaagccccagaaaguggggacggccggaucuaauaagagccuccagucagcagguuuuccuacuggccugacauacagucaacuuaugaccuugaaagauuccaugaugcagcuggacccaagcgcuaagacuuggauagauauugaggggcgcccggaagaccccguugagaucgcccucuaccagccuaugucuggaugcuauauucacuucuuuagagaaccaacagaccugaaacaguucaagcaagaugcgaaguacucacauggcaucgacguggccgaucuuuuucccgcacagccuggucugaccagugcugucaucgaggccuugccaaggaacauggugcucacgugucaggggagcgacgauauuaaacggcuguuagacucccagggccgacgcgauauaaagcugaucgacauugcucuaucuaaagccgauucgagaagguucgaaaaugcaguaugggaccaaugcaaggaucucugucacaugcauaccggaguuguggucgagaaaaagaagcggggcgggaaagaggaaaucacaccccacugcgcccugauggacuguauaauguaugaugcugcggugagcggaggucuuaacauuccggucuugcgcgcagugcugccuagagacaugguuuuuaggacuuccucacccaaggugguacucuga

SEQ ID NO: 1838 - RNA, 1710 nt, Artificial Sequence
  derived and/or modified CDS sequence (opt3) from Lassa virus__AIT17683__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaacaugaucgggauggucggaggcgcacaggguacccagccugggcgggauggagugguacgcguuugggacgugaaaaauccagaucuucugaacaaucaauucggcacaaugccgucauugacccucgccugucugacuaagcagggccaggucgacuuaaacgaugcugugcuggcacucacagaccuugggcugauuuacaccgccaaguaucccaauaguagcgacuuggaucgacuaucucaaucccauccuauccugaacaugguggacacgaaaaagucaagccucaauauuaguggauuuaacuucucucugggugcugccgucaaagcgggcgcaugcaugcuugaugggggaaauaugcuggagacuaucaagguuaccccacagacaauggacggcauauugaaauccauccucaaggugaaaaagagccuggguauguuuguaucggauacucccggggaaagaaacccuuacgagaacauuuuauauaagaucugucugucuggagacggcuggccauacauugccuccaggaccucaaucgugggccgggcuugggaaaauacaaccgucgaucuagagagugacgggaaaccccagaaggugggaacggccgguagcaacaaaucccuccagucugcaggcuucccuacugggcugacauauagccaacuuaugaccuugaaggauucaaugaugcagcuggacccaagugcuaaaacuuggauagauauugagggacguccggaagaccccguugagaucgcccucuaccagccuauguccggcugcuacauucacuuuuuccgcgaaccaacagaccugaagcaguuuaagcaagaugcgaaauauagccaugguaucgacguggccgaucuuuuccccgcacagccugggcugaccucugcugucaucgaggccuugccaagaaauauggugcucacgugucagggcucagacgauauuaagaggcuguuagacagucagggacggcgagauauaaaacugaucgacauugcucuaagcaaggccgauucccgcagauuugaaaacgcaguaugggaccaaugcaaagaucucugucacaugcauaccggcguuguggucgagaagaagaaaaggggagggaaggaggaaaucacaccccacugcgcccugauggacuguauaauguacgaugcugcggugucugguggccuuaauauuccggucuugcgggcagugcugccucgcgacaugguuuucagaacuucgagccccaaagugguacucuga

SEQ ID NO: 1839 - RNA, 1710 nt, Artificial Sequence
  derived and/or modified CDS sequence (opt3) from Lassa virus__AIT17687__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucagcccagcaacuagagcagagaagggcacuccugaauaugaucgggauggucggaggcgcccaggguacucagccugggcgggauggagugguacgcguuugggacgugaaaaacccagaucuucugaauaaccaauucggcaccaugccgaguuugacacucgcuugucugaccaagcagggccaggucgacuuaaaugaugcagugcuggcccucacugaccuugggcugauuuacacagcuaaguaucccaacagcucugacuuggaucgacuaucccaaucacauccuauccugaauaugguggacaccaaaaagagcagucucaacauuucuggauacaauuuuucccugggugccgcggucaaagcaggcgccugcaugcuugaugggggaaacaugcuggagacgaucaagguuacuccacagaccauggacggcauauugaaaagcauccucaaggugaaaagaucgcuggguauguucguaucugauacacccggggaaaggaauccuuaugagaacauuuuauacaagaucugucuguccggagacggcuggccauauauugcuucacggaccaguaucgugggccgugccugggaaaacaccacagucgaucuagagagcgacgggaagccccagaaagugggaaccgcagguuccaauaagucucuccagagcgcuggcuuuccuacggggcugacuuacucacaacuuaugacauugaaagauaguaugaugcagcuggacccauccgccaagaccuggauagauauugagggacgcccggaagaccccguugagaucgcgcucuaccagccuaugagcggcugcuauauucacuucuuuagagaaccaacugaccugaaacaguucaagcaagaugccaaguacucucaugguaucgacguggcagaucuuuuucccgcucagccugggcugacaucagccgucaucgaggcuuugccaaggaacauggugcucaccugucagggcagugacgauauuaaacggcuguuagacagccagggacgacgcgauauaaagcugaucgacauugcccuauccaaagcagauucuagaagguucgaaaaugccguaugggaccaaugcaaggaucucugucacaugcauacgggcguuguggucgagaaaaagaagcgcgggggaaaagaggaaaucacuccccacugcgcucugauggacuguauaauguaugaugcggcagugucggguggccuuaacauuccggucuugcgggccgugcugccuagagacaugguuuuuaggacaagcucccccaaggugguacucuga

SEQ ID NO: 1840 - RNA, 1710 nt, Artificial Sequence
  derived and/or modified CDS sequence (opt3) from Lassa virus__AIT17695__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaaccuuaucgggauggucggaggcgcacaggguacccagccugggcgggauggagugguacgcguuugggacgugaaaaauccagaucuguugaacaaucaauucggcacaaugccgucacucacccuggccuguuuaacuaagcagggccaggucgaccugaacgauguggugcucgcucuuacagaccugggguugauuuacaccgcaaaguaucccaauaguagcgaccuagaucgacugucucaaucccauccuauccucaacauggucgacacgaaaaagucaagccugaauauuaguggauuuaacuucucucuuggugccgcuguuaaagccggcgcgugcaugcuggaugggggaaauauguuggagacuaucaaggugaccccacacacaauggacggcauacucaaauccauccugaaggugaaaaagagcuuagguauguuuguaucggauacucccggggaaagaaacccuuacgagaacauucuguauaagaucugucuaucuggagacggcuggccauacauugcauccaggaccucaaucgucggccgggccugggaaaauacaaccguggaucucgagagugacgggaaaccccauaagguuggaacggcugguagcaacaaaucccugcagucugccggcuucccuacugggcuuacauauagccaguugaugacccugaaggauucaaugaugcagcucgacccaagugcaaaaacuuggauagauauugagggacguccggaagaccccguggagaucgcucuguaccaaccuauguccggcugcuacauucacuuuuuccgcgaaccaacagaccuuaagcaguuuaagcaggaugccaaauauagccaugguaucgacgucgcggaucuguuccccgcccagccuggguugaccucugcagugaucgaggcucucccaagaaauaugguacugacgugucaaggcucagacgauauuaagagguuacuggacagucagggacggcgagauauaaaacuaaucgacauugcccucagcaaggcugauucccgcagauuugaaaacgccguuugggaccagugcaaagaucugugucacaugcacaccggcguggucguggagaagaagaaaaggggagggaaggaggaaaucacaccccauugcgcacuuauggacuguauaauguacgaugccgcugucucugguggcuugaauauuccggugcugcgggcgguucucccucgcgacaugguguucagaacuucgagccccaaaguaguccuguga

SEQ ID NO: 1841 - RNA, 1710 nt, Artificial Sequence
  derived and/or modified CDS sequence (opt3) from Lassa virus__AIT17705__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaaccuuaucgggauggucggaggcgcacaggguacccagccugggcgggauggagugguacgcguuugggacgugaaaaauccagaucuguugaacaaucaauucggcacaaugccgucacucacccuggccuguuuaacuaagcagggccaggucgaccugaacgaugcugugcucgcacuuacagaccugggguugauuuacaccgccaaguaucccaauaguagcgaccuagaucgacugucucaaucccauccuauccucaacaugguggacacgaaaaagucaagccugaauauuaguggauuuaacuucucucuuggugcugccgucaaagcgggcgcaugcaugcuggaugggggaaauauguuggagacuaucaagguuaccccacagacaauggacggcauacucaaauccauccugaaggugaaaaagagcuuagguauguuuguaucggauacucccggggaaagaaacccuuacgagaacauucuguauaagaucugucuaucuggagacggcuggccauacauugccuccaggaccucaaucgugggccgggcuugggaaaauacaaccgucgaucucgagagugacgggaaaccccacaaggugggaacggccgguagcaaccguucccugcagucugcaggcuucccuacugggcuuacauauagccaguugaugacccugaaagauucaaugaugcaacucgacccaagugcuaagacuuggauagauauugagggacgcccggaagaccccguugagaucgcccuguaccagccuauguccggcugcuacauucacuuuuucagagaaccaacagaccuuaaacaguuuaagcaggaugcgaaguauagccaugguaucgacguggccgaucuguuccccgcacaaccuggguugaccucugcugucaucgaggcccucccaaggaauauggugcugacgugucagggcucagacgauauuaaacgguuacuggacagucagggacgacgcgauauaaagcuaaucgacauugcucucagcaaagccgauuccagaagguuugaaaacgcaguaugggaccagugcaaggaucugugucauaugcacaccggcguuguggucgagaaaaagaagcgcgggggaaaagaggaaaucacaccccacugcgcccuuauggacuguauaauguacgaugcugcggugucugguggcuugaauauuccgguccugcgggcagugcucccuagagacaugguuuucaggacuucgagccccaaggugguacuguga

SEQ ID NO: 1842 - RNA, 1710 nt, Artificial Sequence
  derived and/or modified CDS sequence (opt3) from Lassa virus__AIT17711__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaaccuuaucgggauggucggaggcgcacaggguacccagccugggcgggauggagugguacgcguuugggacgugaaaaauccagaucuguugaacaaucaauucggcacaaugccgucacucacccuggccuguuuaacuaagcagggccaggucgaccugaacgaugcugugcucgcacuuacagaccugggguugauuuacaccgccaaguaucccaauaguagcgaccuagaucgacugucucaaucccauccuauccucaacaugguggacacgaaaaagucaagccugaauauuaguggauuuaacuucucucuuggugcugccgucaaagcgggcgcaugcaugcuggaugggggaaauauguuggagacuaucaagguuaccccacagacaauggacggcauacucaaauccauccugaaggugaaaaagagcuuagguauguuuguaucggauacucccggggaaagaaacccuuacgagaacauucuguauaagaucugucuaucuggagacggcuggccauacauugccuccaggaccucaaucgugggccgggcuugggaaaauacaaccgucgaucucgagagugacgggaaaccccacaaggugggaacggccgguagcuccaaaucucugcagagcgcaggcuucccuacugggcuuacauauucacaguugaugacccugaaggauaguaugaugcaacucgacccauccgcuaaaacuuggauagauauugagggacguccggaagaccccguugagaucgcccuguaccagccuaugagcggcugcuacauucacuuuuuccgcgaaccaacagaccuuaagcaguuuaagcaggaugcgaaauauucucaugguaucgacguggccgaucuguuccccgcacaaccuggguugaccucagcugucaucgaggcccucccaagaaacauggugcugacgugucagggcagugacgauauuaagagguuacuggacagccagggacggcgagauauaaaacuaaucgacauugcucucuccaaggccgauucucgcagauuugaaaaugcaguaugggaccagugcaaagaucugugucauaugcacaccggcguuguggucgagaagaagaaaaggggagggaaggaggaaaucacaccccacugcgcccuuauggacuguauaauguacgaugcugcggugucggguggcuugaacauuccgguccugcgggcagugcucccucgcgacaugguuuucagaacuagcucccccaaagugguacuguga

SEQ ID NO: 1843 - RNA, 1710 nt, Artificial Sequence
  derived and/or modified CDS sequence (opt3) from Lassa virus__AIT17713__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaacaugaucgggauggucggaggcgcacaggguacccagccugggcgggauggagugguacgcguuugggacgugaaaaauccagaucuucugaacaaucaauucggcacaaugccgucauugacccucgccugucugacuaagcagggccaggucgacuuaaacgaugcugugcuggcacucacagaccuugggcugauuuacaccgccaaguaucccaauaguagcgacuuggaucgacuaucucaaucccauccuauccugaacaugguggacauuaaaaagucaagccucaauaucaguggauacaacuuuucucugggugcugccgucaaagcgggcgcaugcaugcuugaugggggaaauaugcuggagacgauaaagguuacuccacagaccauggacggcaucuugaaauccauucucaaggugaaaaagagccuggguauguucguaucggauacacccggggaaagaaacccuuaugagaacaucuuauacaagauuugucugucuggagacggcuggccauauaucgccuccaggacuucaauagugggccgggcuugggaaaauaccacagucgaucuagagagugacgggaaaccccagaaggugggaaccgccgguagcaacaaaucccuccagucugcaggcuuuccuacggggcugacuuacagccaacuuaugacauugaaggauucaaugaugcagcuggacccaagugcuaaaaccuggauugauaucgagggacguccggaagaccccguugagauugcccucuaccagccuauguccggcugcuauauccacuucuuucgcgaaccaacugaccugaagcaguucaagcaagaugcgaaauacagccaugguaucgacguggccgaucuuuuucccgcacagccugggcugacaucugcugucauugaggccuugccaagaaauauggugcucaccugucagggcucagacgauauaaagaggcuguuagacagucagggacggcgagauaucaaacugauugacaucgcucuaaacaaggccgauagccgcagauucgaaaaugcaguaugggaccaaugcaaagaucucugucacaugcauacgggcguuguggucgagaagaagaaaaggggagggaaggaggaaauaacaccccacugcgcccugauggacuguauuauguaugaugcugcgguguccgguggccuuaacaucccggucuugcgggcagugcugccucgcgacaugguuuuuagaaccucuucgcccaaagugguacucuga

SEQ ID NO: 1844 - RNA, 1710 nt, Artificial Sequence
  derived and/or modified CDS sequence (opt3) from Lassa virus__AIT17719__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucaguggagcacagggcacccagccuggucgggauggggugguacgcguuugggacgugaaaaacccagagcuucugaauaaccaauucggaacaaugccgagcuugacccucgccugucugacuaagcagggccaggucgauuuaaaugacgcugugcuggcacucacagaucuuggccugauuuacaccgccaaguaucccaacucuuccgacuuggaccgacuaucacaaagccauccuauccugaauaugguggauacgaaaaagaguucucucaacauuuccggguacaauuuuagccugggagcugccgucaaagcgggugcaugcaugcuugacggcgggaacaugcuggaaacuaucaagguuaccccacagacaauggauggaauauugaaaucgauccucaaggugaaaaagucucugggcauguucguauccgacacucccggugagagaaauccuuaugaaaacauuuuauacaagaucugucugucaggggauggauggccauauauugccaguaggaccagcaucgugggccgggcuugggagaacacaaccgucgaccuagaguccgauggcaaaccccagaagguggggacggccggaucuaauaaaagccuccagucagcagguuuuccuacuggccugacauacagucaacuuaugaccuugaaggacuccaugaugcagcuggauccaagcgcuaaaacuuggauagacauugaagggcguccggaggaucccguugaaaucgcccucuaccagccuaugucuggaugcuauauucacuucuuucgcgagccaacagaccugaagcaguucaagcaagacgcgaaauacucacauggcaucgauguggccgaccuuuuucccgcacagccuggucugaccagugcugucaucgaagccuugccaagaaacauggugcucacgugucaggggagcgaugacauuaagaggcuguuagauucccagggccggcgagacauaaaacugaucgauauuucucuaucgaaggcugacagccgcagauucgagaaugccguaugggaucaaugcaaagaccucugucacaugcauaccggaguuguggucgagaagaagaaaaggggcgggaaggaagagaucacaccccacugcgcacugauggauuguauaauguaugacgccgcuguguccggaggucuuaacauuccggucuugcgggcggugcugccucgcgauaugguuuuuagaacuucaagucccaaagugguacucuga

SEQ ID NO: 1845 - RNA, 1710 nt, Artificial Sequence
  derived and/or modified CDS sequence (opt3) from Lassa virus__AIT17725__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccgcccagcaacuagagcagagaagggcacuccugaacaugaucgggauggucggaggcgcccaggguacucagcuugggcgggauggagugguacgcguuugggacgugaaaaauccugaucuguugaacaaucaauucggcaccaugccaucacucacacuggcuuguuuaaccaagcagggccaggucgaccugaacgaugcagugcucgcccuuacugaccugggguugauuuacacagcuaaguauccgaauaguagcgaccuagaucgacugucucaaucccaucccauccucaacaugguggacaccaaaaagucaagccugaauauuaguggauacaacuuuucucuuggugccgcggucaaagcaggcgccugcaugcuggaugggggaaauauguuggagacgaucaagguuacuccucagaccauggacggcauacucaaauccauccugaaggugaaaaagagcuuagguauguucguaucggauacaccaggggaaagaaaccccuaugagaacauucuguacaagaucugucuaucuggagacggcuggccuuauauugcuuccaggacuucaaucgugggccgggccugggaaaauaccacagucgaucucgagagugacgggaaaccacagaaggugggaaccgcagguagcaacaaaucccugcagucugcuggcuuucccacggggcuuacuuacagccaauugaugacacugaaggauucaaugaugcagcucgacccuagugccaaaaccuggauagauauugagggacguccagaagacccgguugagaucgcgcuguaccagcccauguccggcugcuauauucacuucuuucgcgaaccuacugaccuuaagcaguucaagcaagaugccaaauacagccaugguaucgacguggcagaucuguuuccagcucagcccggguugacaucugccgucaucgaggcucucccuagaaauauggugcugaccugucagggcucagaagacauuaagagguuacuggauagucagggacggcgagacauaaaacuaaucgauauugcccucagcaaggcagacucccgcagauucgagaacgccguaugggaucaaugcaaagaccugugucacaugcauacgggcguuguggucgagaagaagaaaaggggagggaaggaagagaucaccccacacugcgcucuuauggauuguauaauguaugacgcggcagugucugguggcuugaauauucccguccugcgggccgugcucccgcgcgauaugguuuuuagaacaucgagcccuaaagugguacuguga

SEQ ID NO: 1846 - RNA, 1710 nt, Artificial Sequence
  derived and/or modified CDS sequence (opt3) from Lassa virus__AIT17729__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagcgacgugacgauucagaccucaaaagacugagggaucuuaaucaagccgugaacaaucuggucgaacucaagagcacacagcagaagaguauuuugcgggugggaacucugacguccgacgaucugcucaccuuagcggcugaccuggagaaacuuaagucuaaaguuauacgcacagaaagacccuugagcuccgguguguauaugggcaaccugucaacucagcaacuagagcagaggcgggcccuccugaauaugaucgggauggucggaggcacccaggguacacagccugggcgcgauggagugguacgaguuugggacgugaagaacccagaucuucugaauaaccaauucggcaccaugccgaguuugacucucgcaugucugacaaaacagggccaggucgacuuaaaugaugccgugcuggcucucaccgaccuugggcugauuuacacggcaaaguaucccaacagcucugacuuggauagacuaucccaaucacauccuauccugaauaugguggacacuaagaaaagcagucucaacauuucuggauacaauuuuucccugggugccgcugucaaggccggcgcgugcaugcuugaugggggaaacaugcuggagaccaucaaaguuacaccacagacuauggacggcauacucaagagcaucuugaaagugaagaggucgcuggguauguucguaucugauacccccggggaacggaauccuuaugagaacauuuuauacaaaaucugucuguccggagacggcuggccauauauugcaucacguacaaguaucgugggccgcgccugggaaaacaccacggucgaucuagagagcgacgggaagccccagaaggugggaacugcugguuccaauaaaucucuccagagcgccggcuuuccuacagggcugaccuacucacaacuuaugacuuugaaggauaguaugaugcagcuggacccauccgcaaaaacauggauagauauugagggaagaccggaagaccccguugagaucgcucucuaccagccuaugagcggcugcuauauucacuucuuuagggaaccaaccgaccugaagcaguucaaacaagaugccaaguacucucaugguaucgacguggcggaucuuuuucccgcccagccugggcugacgucagcagucaucgaggcuuugccacggaacauggugcucaccugucagggcagugacgauauuaagcgacuguuagacagccagggacgcagagauauaaaacugaucgacauugcccuauccaaggcugauucuaggaaauucgaaaaugccguaugggaccaaugcaaggaucucugucacaugcauacaggcguuguggucgagaaaaagaagcgcgggggaaaagaggaaaucacuccccacugcgcacugauggacuguauaauguaugaugccgcugugucggguggccuuaacauuccggucuugcgggcggugcugccuagagacaugguuuuuaggaccagcucccccaaggugguacucuga

SEQ ID NO: 1847 - RNA, 1710 nt, Artificial Sequence
  derived and/or modified CDS sequence (opt3) from Lassa virus__AIT17733__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucauauuagcggcugaccuggagaaacuuaaguccaagguuauccggaccgaacgccccuugucuagcgguguguauaugggcaaucuguccacacagcaacuagagcagagaagggcccuccugaacaugauugggauggucggaggcgcacaggguacucagccugggcgggauggagugguacgcguuugggacgugaaaaauccagaucuucugaacaaucaauucggcaccaugccgucauugacacucgccugucugaccaagcagggccaggucgacuuaaacgaugcugugcuggcacucacugaccuugggcugaucuacacagccaaguaucccaauaguagcgacuuggaucgacuaucucaaucccauccuauucugaacaugguggacaccaaaaagucaagccucaauaucaguggauacaacuuuucucugggugcugccgucaaagcgggcgcaugcaugcuugaugggggaaauaugcuggagacgauaaagguuacuccacagaccauggacggcaucuugaaauccauucucaaggugaaaaagagccuggguauguucguaucggauacacccggggaaagaaacccuuaugagaacaucuuauacaagauuugucugucuggagacggcuggccauauaucgccuccaggacuucaauagugggccgggcuugggaaaauaccacagucgaucuagagagugacgggaaaccccagaaggugggaaccgccgguagcaacaaaucccuccagucugcaggcuuuccuacggggcugacuuacagccaacuuaugacauugaaggauucaaugaugcagcuggacccaagugcuaaaaccuggauugauaucgagggacguccggaagaccccguugagauugcccucuaccagccuauguccggcugcuauauccacuucuuucgcgaaccaacugaccugaagcaguucaagcaagaugcgaaauacagccaugguaucgacguggccgaucuuuuucccgcacagccugggcugacaucugcugucauugaggccuugccaagaaauauggugcucaccugucagggcucagacgauauaaagaggcuguuagacagucagggacggcgagauaucaaacugauugacaucgcucuaagcaaggccgauucccgcagauucgaaaacgcaguaugggaccaaugcaaagaucucugucacaugcauacgggcguuguggucgagaagaagaaaaggggagggaaggaggaaauaacaccccacugcgcccugauggacuguauuauguaugaugcugcggugucugguggccuuaauaucccggucuugcgggcagugcugccucgcgacaugguuuuuagaaccucgagccccaaagugguacucuga

SEQ ID NO: 1848 - RNA, 1710 nt, Artificial Sequence
  derived and/or modified CDS sequence (opt3) from Lassa virus__AIT17745__NP
augagcgccuccaaggagaucaaaucuuuccuguggacccagucacucagaagggaacuuaguggcuacugcagcuccauuaagcugcaaguggucaaagacgcucaggcauuguuacacgggcuggauuuuucugagguuucgaacgugcagcggcuaaugcgcaagcagaaacgagacgauucagaccucaagcgucugagagaucuuaaucaagccguaaacaaucugguggaacuuaagagcacacagcagaaaaguauacucagggucggaacucugacguccgacgaucugcucaccuuagcggcugaccuggagaaguugaaaucuaaggugauccggacagaacgccccuugagcuccgguguuuauaugggcaaccugucaacucagcaacuagagcagagaagggcccuccugaauaugauugggauggugggaggcgcacaggguacccagccugggcgggauggagucgugcgcguaugggacguuaaaaacccagaucuucugaauaaccaauucggcacaaugccgaguuugacccucgccugucugacuaagcagggccagguggacuuaaaugaugcuguccuggcacucacagaccuugggcugaucuacaccgccaaguaucccaacagcucugacuuggaucgacuaucccaaucacauccuauucugaauaugguggacacgaaaaagagcagucucaacaucucuggauacaauuuuucccugggugcugccgugaaagcgggcgcaugcaugcuugaugggggaaacaugcuggagacuauaaaggucaccccacagacaauggacggcaucuugaaaagcauucucaagguuaaaagaucgcuggguauguucgugucugaugcccccggggaaaggaauccuuaugagaacaucuuauacaagauuugucuguccggagacggcuggccauauaucgcuucacggaccaguauaguaggccgugccugggaaaacaccacaguggaucuagagagcgacgggaagccccagaaagucggaaccgcagguuccaauaagucucuccagagcgcuggcuuuccuacggggcugacuuacucacaacuuaugacauugaaagauaguaugaugcagcuggacccauccgccaagaccuggauugauaucgagggacgcccggaagaccccguggagauugcgcucuaccagccuaugagcggcugcuauauccacuucuuuagagaaccaacugaccugaaacaguucaagcaagaugccaaguacucucaugguaucgacguugcagaucuuuuucccgcucagccugggcugacaucagccgugauugaggcuuugccaaggaacaugguccucaccugucagggcagugacgauauaaaacggcuguuagacagccagggacgacgcgauaucaagcugauugacaucgcccuauccaaaguggauucuagaagguucgaaaaugcaguaugggaccaaugcaaggaucucugucacaugcauacgggcguuguggucgagaaaaagaagcgcgggggaaaagaggaaauaacuccccacugcgcccugauggacuguauuauguaugaugcugcggugucggguggccuuaacaucccggucuugcgggcagugcugccuagagacaugguuuuuaggacaagcucccccaaggugguacucuga

SEQ ID NO: 1849 - RNA, 1710 nt, Artificial Sequence
  derived and/or modified CDS sequence (opt3) from Lassa virus__AIT17753__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucggaggcgcacaggguacccagccugggcgggauggagugguacgcguuugggacgugaaaaacccagaucuucugaauaaccaauucggcacaaugccgaguuugacccucgccugucugacuaagcagggccaggucgacuuaaaugaugcugugcuggcacucacagaccuugggcugauuuacaccgccaaguaucccaacagcucugacuuggaucgacuaucccaaucacauccuauccugaauaugguggacacgaaaaagagcagucucaacauuucuggauacaauuuuucccugggugcugccgucaaagcgggcgcaugcaugcuugaugggggaaacaugcuggagacuaucaagguuaccccacagacaauggacggcauauugaaaagcauccucaaggugaaaagaucgcuggguauguucguaucugauacucccggggaaaggaauccuuaugagaacauuuuauacaagaucugucuguccggagacggcuggccauauauugccucacggaccaguaucgugggccgugcuugggaaaacacaaccgucgaucuagagagcgacgggaagccccagaaagugggaacgacugguuccaauaagucucuccagagcgccggcuuuccuacagggcugaccuacucacaacuuaugacuuugaaagauaguaugaugcagcuggacccauccgcaaagacauggauagauauugagggacgcccggaagaccccguugagaucgcucucuaccagccuaugagcggcugcuauauucacuucuuuagagaaccaaccgaccugaaacaguucaagcaagaugccaaguacucucaugguaucgacguggcggaucuuuuucccgcccagccugggcugacgucagcagucaucgaggcuuugccaaggaacauggugcucaccugucagggcagugacgauauuaaacggcuguuagacagccagggacgacgcgauauaaagcugaucgacauugcccuauccaaagcugauucuagaagguucgaaaaugccguaugggaccaaugcaaggaucucugucacaugcauacaggcguuguggucgagaaaaagaagcgcgggggaaaagaggaaaucacuccccacugcgcacugauggacuguauaauguaugaugccgcugugucggguggccuuaacauuccggucuugcgggcggugcugccuagagacaugguuuuuaggaccagcucccccaaggugguacucuga

SEQ ID NO: 1850 - RNA, 1710 nt, Artificial Sequence
  derived and/or modified CDS sequence (opt3) from Lassa virus__AIT17763__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucggaggcgcacaggguacccagccugggcgggauggagugguacgcguuugggacgugaaaaacccagaucuucugaauaaccaauucggcacaaugccgaguuugacccucgccugucugacuaagcagggccaggucgacuuaaaugaugcugugcuggcacucacagaccuugggcugauuuacaccgccaaguaucccaacagcucugacuuggaucgacuaucccaaucacauccuauccugaauaugguggacacgaaaaagagcagucucaacauuucuggauacaauuuuucccugggugcugccgucaaagcgggcgcaugcaugcuugaugggggaaacaugcuggagacuaucaagguuaccccacagacaguggacggcauauugaaaagcauccucaagguaaaaagaucgcuggguauguucgugucugauacucccggggaaaggaauccuuaugagaacauuuuauacaagaucugucuguccggagacggcuggccauauauugccucacggaccaguaucgucggccgugcuugggaaaacacaaccguggaucuagagagcgacgagaagccccagaaaguuggggccgcaggauccaauaagucucuccagagcgcugguuuuccuacgggccugacuuacucacaacuuaugacauugaaagauaguaugaugcagcuggacccauccgccaagaccuggauagauauugaagggcgcccggaggaccccguggaaaucgcgcucuaccagccuaugagcggaugcuauauucacuucuuuagagagccaacugaccugaaacaguucaagcaagaugccaaguacucucauggcaucgacgucacagaucuuuuucccgcacagccuggucugaccucagcugugaucgaagccuugccaaggaacaugguacucacgugucaggggagugacgauauuaaacggcuguuagacagccagggccgacgcgauauaaagcugaucgacauugcucuauccaaagccgauucuagaagguucgagaaugcaguuugggaccaaugcaaggaucucugucacaugcauaccggaguggucguggagaaaaagaagcggggcgggaaagaagagaucacaccccacugcgcccugauggacuguauaauguaugaugcugcggucucgggaggucuuaacauuccgguguugcgcgcaguucugccuagagacaugguguuuaggacuagcucccccaagguaguccucuga

SEQ ID NO: 1851 - RNA, 1710 nt, Artificial Sequence
  derived and/or modified CDS sequence (opt3) from Lassa virus__AIT17771__NP
augagcgccuccaaggaggugaaaucuuuccuguggacccagucacucagaagggaacuuaguggcuacugcagcuccaucaagcugcaagucguuaaagacgcucaggcauuguuacacgggcuggauuuuucugaggugucgaacguacagcggcuaaugcgcaagcagaaacgagacgauucagaccucaagcgucugagagaucuuaaucaagccgugaacaaucuggucgaacuuaagagcacacagcagaaaaguauucucagggugggaacucugacguccgacgaucugcucaccuuagcggcugaccuggagaaguugaaaucuaagguuauacggacagaacgccccuugagcuccgguguguauaugggcaaccugucaacucagcaacuagagcagagaagggcccuccugaauaugaucgggauggucggaggcgcacaggguacccagccugggcgggauggagugguacgcguuugggacgugaaaaacccagaucuucugaauaaccaauucggcacaaugccgaguuugacccucgccugucugacuaagcagggccaggucgacuuaaaugaugcugugcuggcacucacagaccuugggcugauuuacaccgccaaguaucccaacagcucugacuuggaucgacuaucccaaucacauccuauccugaauaugguggacacgaaaaagagcagucucaacauuucuggauacaauuuuucccugggugcugccgucaaagcgggcgcaugcaugcuugaugggggaaacaugcuggagacuaucaagguuaccccacagacaauggacggcauauugaaaagcauccucaaggugaaaagaucgcuggguauguucguaucugauacucccggggaaaggaauccuuaugagaacauuuuauacaagaucugucuguccggagacggcuggccauauauugccucacggaccaguaucgugggccgugcuugggaaaacacaaccgucgaucuagagagcgacgggaagacgcagaaaguguccacugccggaucuaauaagagccuccagucagcagguuuucccacaggccugaccuacagucaacuuaugacuuugaaagauuccaugaugcagcuggacccuagcgcuaagacauggauagauauugaggggcgcccagaagacccgguugagaucgcccucuaccagcccaugucuggaugcuauauucacuucuuuagagaaccuaccgaccugaaacaguucaagcaagaugcgaaguacucacauggcaucgacgugacggaucuuuuuccagcccagcccggucugaccagugcagucaucgaggcuuugccuaggaacauggugcucacaugucaggggagcgacgauauuaaacggcuguuagacucccagggccgacgcgauauaaagcugaucgacauugcccuaucuaaagcugauucgagaagguucgaaaaugccguaugggaccaaugcaaggaucucugucacaugcauacuggaguuguggucgagaaaaagaagcggggcgggaaagaggaaaucaccccacacugcgcacugauggacuguauaauguaugaugccgcugugagcggaggucuuaacauucccgucuugcgcgcggugcugccgagagacaugguuuuuaggacauccucaccuaaggugguacucuga

SEQ ID NO: 1852 - RNA, 1710 nt, Artificial Sequence
  derived and/or modified CDS sequence (opt3) from Lassa virus__AIT17779__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauggagaccucaagcgucugagagaucuuaaccaagccgugaauaaccuggucgaauugaagucgacacagcagaaaucaauucucaggguggguacucugacgagcgacgaucugcucaccuuagcggcugaccuggagaaacuuaagaguaagguuauacggacagaacgccccuuguccucuggcguguauauggggaaucugagcacucagcaacuagagcagagaagggcccuccugaacaugaucggaauggucggcggugcacaggggacccagccuggacgggauggcgugguacgcguuugggacgugaaaaauccagaucuucugaacaaucaauucggcacaaugccguccuugacccucgccugucugacuaagcaggggcaggucgacuuaaacgaugcugugcuggcacucacagaccuuggacugauuuacaccgccaaguaucccaauucaagugacuuggaucgacuaagccaaucucauccuauccugaacaugguggacacgaaaaaguccucacucaauauuagcgguuacaacuuuagucugggcgcugccgucaaagcgggggcaugcaugcuugauggaggcaauaugcuggagacuaucaagguuaccccacagacaauggacgguauauugaaaucuauccucaaggugaaaaagucccuggggauguucguaagcgauacucccggagaaagaaacccuuaugagaacauuuuauacaagaucugucugucgggcgacggcuggccauauauugccucuaggaccuccaucguggggcgggcuugggaaaauacaaccgucgaucuagagucagacggaaaaccccagaagguggguacggccggcaguaacaaaagccuccaguccgcaggguuuccuacuggacugacauacucucaacuuaugaccuugaaggauagcaugaugcagcuggacccaucagcuaaaacuuggauagauauugagggccguccggaagaccccguugagaucgcccucuaccagccuaugagugguugcuauauucacuucuuucgcgaaccaacagaccugaagcaguucaagcaagaugcgaaauacucccaugggaucgacgugaccgaucuuuuuagcgcccagcccggccugacgucugcagucaucgaggcuuugccuagaaauauggugcucaccugucagggaucagacgauauuaagaggcuguuagacagucagggccggcgagauauaaaacugaucgacauugcccuaagcaagacagauucccgcagauucgaaaacgcuguaugggaccaaugcaaagaucucugucacaugcauacugggguuguggucgagaagaagaaaaggggagguaaggaggaaaucaccccacacugcgcccugauggacuguauaauguaugaugcagccgugucuggcgggcuuaauauucccgucuugcgggcugugcugccgcgcgacaugguuuuuagaacaucgagcccuaaagugguacucuga

SEQ ID NO: 1853 - RNA, 1710 nt, Artificial Sequence
  derived and/or modified CDS sequence (opt3) from Lassa virus__AIT17783__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauucggaccucaagcgucugagagaucuuaaccaagccgugaauaaccuggucgaauugaagucaacacagcagaaaagcauucucagggugggaacucugacgagugacgaucugcucaccuuagcggcugaccuggagaaacuuaaguccaagguuauacggacagaacgccccuugucuagcgguguguauaugggcaaucuguccacucagcaacuagagcagagaagggcccuccugaacaugaucgggauggucggaggcgcacaggguacccagccugggcgggauggagugguacgcguuugggacgugaaaaauccagaucuucugaacaaucaauucggcacaaugccgucauugacccucgccugucugacuaagcagggccaggucgacuuaaacgauguggugcuggcucucacagaccuugggcugauuuacaccgcaaaguaucccaauaguagcgacuuggaucgacuaucucaaucccauccuauccugaacauggucgacacgaaaaagucaagccucaauauuaguggauacaacuuuucucugggugccgcuguuaaagccggcgcgugcaugcuugaugggggaaauaugcuggagacuaucaaggugaccccacagacaauggacggcauauugaaauccauccucaaggugaaaaagagccuggguauguucguaucggauacucccggggaaagaaacccuuaugagaacauuuuauacaagaucugucugucuggagacggcuggccauauauugcauccaggaccucaaucgucggccgggccugggaaaauacaaccguggaucuagagagugacgggaaaccccagaagguuggaacggcugguagcaacaaaucccuccagucugccggcuuuccuacugggcugacauacagccaacuuaugaccuugaaggauucaaugaugcagcuggacccaagugcaaaaacuuggauagauauugagggacguccggaagaccccguggagaucgcucucuaccagccugucuccggcugcuauauucacuucuuucgcgaaccaacagaccugaagcaguucaagcaagaugccaaauacagccaugguaucgacguggcggaucuuuuucccgcccagccugggcugaccucugcaguaaucgaggcuuugccaagaaauaugguucucacgugucagggcucagacgauauuaagaggcuguuagacagucagggacggcgagauauaaaacugaucgacauugcccuaagcaaggcugauucccgcagauucgaaaacgccgugugggaccaaugcaaagaucucugucacaugcauaccggcgucguggucgagaagaagaaaaggggagggaaggaggaaaucacaccccacugcgcacugauggacuguauaauguaugaugccgcugugucugguggccuuaauauuccgguuuugcgggcggugcugccucgcgacaugguauuuagaacuucgagccccaaagucgugcucuga

SEQ ID NO: 1854 - RNA, 1710 nt, Artificial Sequence
  derived and/or modified CDS sequence (opt3) from Lassa virus__AIT17787__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagaaacgagacgauggagaccucaagcgucugagagaucuuaaccaagccgugaauaaccuggucgaauugaagucgacacagcagaaaucaauucucaggguggguacucugacgagcgacgaucugcucaccuuagcggcugaccuggagaaacuuaagaguaagguuauacggacagaacgccccuuguccucuggcguguauauggggaaucugagcacucagcaacuagagcagagaagggcccuccugaacaugaucggaauggucggcggugcacaggggacccagccuggacgggauggcgugguacgcguuugggacgugaaaaauccagaucuucugaacaaucaauucggcacaaugccguccuugacccucgccugucugacuaagcaggggcaggucgacuuaaacgaugcugugcuggcacucacagaccuuggacugauuuacaccgccaaguaucccaauucaagugacuuggaucgacuaagccaaucucauccuauccugaacaugguggacacgaaaaaguccucacucaauauuagcgguuacaacuuuagucugggcgcugccgucaaagcgggggcaugcaugcuugauggaggcaauaugcuggagacuaucaagguuaccccacagacaauggacgguauauugaaaucuauccucaaggugaaaaagucccuggggauguucguaagcgauacucccggagaaagaaacccuuaugagaacauuuuauacaagaucugucugucgggcgacggcuggccauauauugccucuaggaccuccaucguggggcgggcuugggaaaauacaaccgucgaucuagagucagacggaaaaccccagaagguggguacggccggcaguaacaaaagccuccaguccgcaggguuuccuacuggacugacauacucucaacuuaugaccuugaaggauagcaugaugcagcuggacccaucagcuaaaacuuggauagauauugagggccguccggaagaccccguugagaucgcccucuaccagccuaugagugguugcuauauucacuucuuucgcgaaccaacagaccugaagcaguucaagcaagaugcgaaauacucccaugggaucgacgugaccgaucuuuuuagcgcccagcccggccugacgucugcagucaucgaggcuuugccuagaaauauggugcucaccugucagggaucagacgauauuaagaggcuguuagacagucagggccggcgagauauaaaacugaucgacauugcccuaagcaagguagauucccgcagauucgaaaacgcuguuugggaccaaugcaaagaucucugucacaugcauacagggguggucguggagaagaagaaaaggggagguaaggaggaaaucacuccacacugcgcccugauggacuguauaauguaugaugcagccgucucuggcgggcuuaauauucccguguugcgggcuguucugccgcgcgacaugguguuuagaaccucgagcccuaaaguaguccucuga

SEQ ID NO: 1855 - RNA, 1710 nt, Artificial Sequence
  derived and/or modified CDS sequence (opt3) from Lassa virus__AIT17803__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugauucgcaccgagagacccuuguccgccgguguuuauaugggcaaccugucuagccagcagcuagaucaaaggcgggcacuccuguccaugaucgggaugucaggaggcagucaggaggcccgcgcuggucgagacgggguggucagagugugggauguaaagaaugcagaacuucugaacaaucaguucggaacaaugccuagcuugacucucgccugucugaccaaacagggccaaguugacuuaaacgaugcugugcaggcccugacagaccucggccuuauuuacaccgcgaaguauccaaauacuucugaccuggauagguugacacagucccauccgauccuaaacaugauagacaccaagaaaucaagccugaauaucaguggguacaacuuuucucucggagcagccgucaaggcuggugccugcaugcuggauggcgggaauaugcuugagacgauuaaagugagcccccaaacuguggacggaauccugaaguccauuuugaaagucaagaaagcacucggcauguucaucucggauaccccuggugaacggaacccauaugagaacauacuguacaagauuuguuuaucuggggacggauggcccuauaucgcuucccguacaucaauuacuggccgcgccugggagaauaccguuguggaucuggaaagugacggcaagccucagaaagcggggagcaacaauuccaacaagucucuacagagcgccggauuuacagcaggucucaccuacucacagcugaugacgcuuaaagaugcuauguugcaacuggacccaaaugccaagacuuggauggauaucgagggcagacccgaagacccuguagagaucgcucucuaccagccaaguuccgggugcuauauucacuucuuuagggaaccgacagaccugaaacaguucaagcaggaugccaaguacagccauggaauagacgugaccgaucuuuuugcagcccaacccggccugacuucugcugucaucgacgcguugccucggaacauggugauuacaugucaggguucagaugacauccgaaaacuccuggagagucaggggcgcaaggauauaaaauuaauugacaucgcacugagcaagaccgauuccagaaaauaugagaaugccguuugggaccaguacaaggaucuaugccacaugcauacgggcguggucguggaaaagaaaaagaaaggaggcaaggaggaaaucaccccacacugugcucucauggacugcauuauguucgaugccgcaguaucugggggacugaacacaucgguucuuagggccguguugccccgggacauggucuuucgcacuagcaccccuagagugguccuguga

SEQ ID NO: 1856 - RNA, 1710 nt, Artificial Sequence
  derived and/or modified CDS sequence (opt3) from Lassa virus__AIT17811__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccugaauaugauugggauguccggaucaaaccagggcgcccgcgcuggucgagacgggguggucagagugugggauguaaagaaugcagagcuucugaacaaucaguucggaacuaugccuaguuugacccucgccugucugacaaaacagggccaaguugacuuaaacgaugcugugcaggcccugaccgaccucggccuuaucuacacugcgaaguauccaaauacaagcgaccuggauagguugacccagucucauccgauucuaaacaugaucgacacgaagaaauccucacugaauauaagcggguacaacuuuagucucggagcagccgucaaggcuggugccugcaugcuggauggcgggaacaugcuugaaacuaucaaagugucuccccaaaccauggacggcauucugaaguccaucuugaaagugaagaaagcacucggaauguucauuagcgauacaccuggugagcggaauccauaugaaaacauccuguacaagauauguuuaucgggggacggauggcccuauauugcuucucguacuuccaucaccggccgcgccugggagaauacagucguugaucuggagucagacggcaagccucagaaagcggggaguaacggaagcaauaagucccuacagucugccgguuuuaccgcaggccucacguacagccagcugaugacucuuaaagaugcuauguugcaacuggacccaaacgccaagacauggauggauauugaagggagacccgaggacccuguggaaaucgcuuucuaccagccaucaaguggaugcuauauccacuuuuucagggagccgaccgaccucaaacaguuuaagcaggaugccaaguacucccauggcauugacguaacugaucuguucgcagcccaacccggucuuacaagcgcugugauagacgcgcugccucggaauuuggucaucaccugucaggggucugaugacauucgaaaacucuuugaaucacagggccgcaaggauaucaaacugauagacauugcauuaaguaagacggauagcagaaaauaugagaacgccgugugggaccaguacaaggaucugugccacaugcauaccggaaucguuguggagaagaaaaagaggggcgggaaagaagagaucacaccacacugugcucuaauggacugcauuauguucgaugccgcagucuccggaggucucaaugccucugugcugcgggcuguacuuccccgcgacaugguuuuuagaacuucgaccccuaggguggucuuguga

SEQ ID NO: 1857 - RNA, 1710 nt, Artificial Sequence
  derived and/or modified CDS sequence (opt3) from Lassa virus__AIT17815__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccuggacaugauugggauguccggaucaaaucagggcgcccgcgcuggucgagaugggguggucagagugugggacguaaagaacgcagagcuucugaauaaccaguucggaacuaugccuaguuugacccucgccugucugacaaaacagggccaaguugauuuaaaugacgcugugcaggcccugaccgaccucggccuuaucuacacugcgaaguauccaaacacaagcgaucuggacagguugacccagucucauccgauucuaaauaugaucgauacgaagaaauccucacugaacauaagcggguacaauuuuagucucggagcagccgucaaggcuggugccugcaugcuggacggcgggaacaugcuugaaacuaucaaagugucuccccaaaccauggauggcauucugaaguccaucuugaaagugaagaaagcacucggaauguucauuagcgacgcuccuggugagcggaacccauaugaaaauauccuguacaagauauguuuaucgggggauggauggcccuauauugccucucguacauccaucacuggccgcgcgugggagaacaccgucguugaccuggagucagauggcaagccucagaaagccgggaguaauggaagcaacaagucccuacagucugcagguuuuacagcuggccucaccuacagccagcugaugacgcuuaaagacgccauguugcaacuggauccaaaugcuaagacuuggauggacauugaagggagacccgaggacccuguggaaaucgcccucuaccagccaucaaguggaugcuauauccacuucuuuagggagccgacagaucugaaacaguucaagcaggacgcaaaguacucccauggcauugauguaaccgaccuuuuugccgcucaacccggucugacuagcgcggugauagaugcauugccucggaacauggucaucacaugucaggggucugacgauauucgaaaacucuucgaaucacagggccgcaaggacaucaaacugauagauauugccuuaaguaagaccgacagcagaaaauaugagaaugcugugugggaucaguacaaggaccugugccacaugcauacgggaaucguuguggagaagaaaaagaggggcgggaaagaagagaucaccccacacugugcccuaauggauugcauuauguuugacgcagccgucuccggaggucucaacacaucugugcugcgggcuguacuuccccgcgacaugguuuucagaacuucgaccccuaggguggucuuguga

SEQ ID NO: 1858 - RNA, 1710 nt, Artificial Sequence
  derived and/or modified CDS sequence (opt3) from Lassa virus__AIT17821__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugauucgcaccgagagacccuuguccgccgguguuuauaugggcaaccugucuagccagcagcuagaucaaaggcgggcacuccuguccaugaucgggaugucaggaggcaaucagggugcccgcgcugggcgagacggaguggucagagugugggauguaaagaacgcagagcuucugaauaaccaguucggcacaaugccuaguuugacucucgccugucugaccaaacagggccaaguugacuuaaaugaugcugugcaggcccugacagaccucgggcuuauuuacaccgcgaaguauccaaacacuagcgaccuggauagguugacacagucucauccgauccuaaauaugauagacaccaagaaauccucacugaacaucagcggauacaauuuuagucucggugcagccgucaaggcuggcgccugcaugcuggaugggggaaacaugcuugaaacgauuaaagugucuccccaaacuguggacggcauccugaaguccauuuugaaagucaagaaagcacucgguauguucaucagcgauaccccuggggagcggaacccauaugaaaauauacuguacaagauuuguuuaucgggagacggcuggcccuauaucgcuucucguacauccauuacuggccgcgccugggagaacaccguuguggaucuggagucagacgggaagccucagaaaacaggaaguaauaacagcaauaagucccuacagucugcggguuuuaccgccggccucacguacagccagcugaugacucuuaaagaugcaauguugcaacuggacccaaacgcuaagacauggauggauaucgaagggagacccgaggacccuguagaaguggcccucuaccagccaucaaguggaugcuauauccacuucuuuagggagccgaccgaccugaaacaguucaagcaggaugcuaaguacucccauggcauugacgucacugaucuuuuugccgcacaacccggucugacaagcgccgugauagacgcuuugccucggaauaugguuaucaccugucaggggucugaugacauucgaaaacuccuggaaucacagggccgcaaggauaucaaauuaauagacauugcgcugaguaagacggauagcagaaaauaugagaacgcagugugggaccaguacaaggaucuaugccacaugcauaccggagucgugguagagaagaaaaagaggggcgggaaagaagagaucacaccacacugugcccucauggacugcaucauguucgaugcugccguuuccggaggucugaauacuucugugcuucgggcagucuugccccgcgacaugguguuuagaaccucgacaccuagggucgugcuguga

SEQ ID NO: 1859 - RNA, 1710 nt, Artificial Sequence
  derived and/or modified CDS sequence (opt3) from Lassa virus__AIT17837__NP
augagcaacuccaaggagaucaaaucuuuccuguggacccagucacucagaagggaacuuaguggcuacugcagcaauauuaagcugcaaguggucaaagacgcccaggcuuuguuacacgggcuggauuuuuccgagguuucuaacgugcagcggcuaaugcgcaagcagaaacgagacgaugcagaccucaagcgucugagagaucuuaaucaagccguaaacaaucugguggaauugaagucgacacagcagaaaaacguccucagggugggaacucugucaagcgacgaucugauaacgcucgcggcugacuuagagaagcugaaaaguaagguuauccggaccgaacgcccccuuuccucugguguguauaugggcaauuugagcucccagcaacuggaucagagaagggcccuacucucaaugauugggaugaguggaggcccucaggguaaccggacagggggagacggcgucgugcgcguaugggauguuaaaaaugcagagcugcuuaacaaucaguucggcacuaugccaagccugaccuuggccugucucacaaagcaaggacagguggaccugaacgaugcuguccaggcauuaaccgaccuggggcucaucuacacugccaaguaucccaauucuuccgaccuugauaugcugacacaaucacauccgauuuuggguaugguggacaccaaaaagagcagucuaaacaucucuggcuacaauuuuucccugggggcugccgugaaagcgggagcaugcaugcucgauggcgguaacaugcuggagacgauaaaggucagcccucagacuauggacgggauccuuaaaucgauucugaagguuaaacgaucuuugggaauguucaucuccgauaccccaggcgaaagaaaccccuaugagaauauucucuacaagaucugucugucaggcgaaggguggccuuauauagccaguaggacaagcauuacuggacgggcuugggagaacaccuuaguggaccuggaguccgauaauaagccacccaaacuaaacucugccgguagcaauaagucacuccaggcagcuggccugaacgccgggcuuacauacagucaguugaugacccugaaagacugcaugcuccaacuggauccuuccagcaagacguggaucgacauugaaggacguccagaggauccgguagaaaucgcgcuuuuucagcccucuucaggcuguuacauccacuucuuucgcgagccuacugaccugaaacaguucaagcaggacgccaaguauagucaugguauugaugugacagacuuguuuagcacccaaccagggcucacuuccgcagucauagaagcucugcccagaaauaugguguuaacaugccagggcucugaugacaucaaaaagcugcuagagucgcagggaaggcgggauauuaaacucaucgacauaagccuguccaaggccgauucacgaaaauucgagaacgcuguuugggaccaguacaaggaucuuugucacaugcauaccggcguggucguggaaaagaaaaagcgcgggggaaaagaggaaauuacgccucacugcgccuugcuggacuguaucauguuugaugcagccaccacagguagucucaauaucacuacccugagagcuguauuaccaagggacaugguuuuccggacaucuacucccaaggugguccuguga

SEQ ID NO: 1860 - RNA, 1710 nt, Artificial Sequence
  derived and/or modified CDS sequence (opt3) from Lassa virus__AIT17841__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccugaauaugauugggauguccggaucaaaccagggcgcccgcacuggucgagacgggguggucagagugugggauguaaagaaugcugagcuucugaacaaucaguucggaaccaugccuaguuugacacucgcaugucugaccaaacagggccaaguugacuuaaacgaugccgugcaggcucugacugaccucggccuuaucuacacagccaaguauccaaauaccagcgaccuggauagguugacgcagucucauccgauucuaaacaugaucgacacuaagaaauccucacugaauauaagcggguacaacuuuagucucggagcggcagucaaggccggugcuugcaugcuggauggcgggaacaugcuugaaaccaucaaagugucuccccaaacaauggacggcauucugaaguccaucuugaaagugaagaaagcccucggaauguucauuagcgaugcaccuggugagcggaauccauaugaaaacauccuguacaagauauguuuaucgggggacggauggcccuauauugcuucucguacuuccaucaccggccgcgccugggagaauacagucguugaucuggagucagacggcaagccucagaaagcggggaguaacggaagcaauaagucccuacagucugccgguuuuaccgcaggccucacguacagccagcugaugacucuuaaagaugcuauguugcaacuggacccaaacgccaagacauggauggauauugaagggagacccgaggacccuguggaaaucgcucucuaccagccaucaaguggaugcuauauccacuucuuuagggagccgaccgaccugaaacaguucaagcaggaugccaaguacucccauggcauugacguaacugaucuuuuugcagcccaacccggucugacaagcgcugugauagacgcguugccucggaauauggucaucaccugucaggggucugaugacauucgaaaacucuucgaaucacagggccgcaaggauaucaaacugauagacauugcauuaaguaagacggauagcagaaaauaugagaacgccgugugggaccaguacaaggaucugugccacaugcauaccggaaucguuguggagaagaaaaagaggggcgggaaagaagagaucacaccacacugugcucuaauggacugcauuauguuugaugccgcagucuccggaggucucaauacuucugugcugcgggccguacuuccccgcgacaugguuuucagaaccucgacaccuaggguggucuuguga

SEQ ID NO: 1861 - RNA, 1710 nt, Artificial Sequence
  derived and/or modified CDS sequence (opt3) from Lassa virus__AIT17845__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugacccgcacagagagacccuuguccgccgguguuuauaugggcaaccugucuagccagcagcuagaucaaaggcgggcacuccugaauaugauugggauguccggaucaaaccagggcgcccagacuggucgcgacggggugguccgagugugggauguaaagaaugcugagcuucugaacaaucaguucggaaccaugccuaguuugacacucgcaugucugaccaaacaaggccagguugacuuaaacgaugccgugcaggcucugacugaccucggccuuaucuacacagccaaguauccaaauaccagcgaccuggauagauugacgcaaucucauccgauucuaaacaugaucgacacuaagaaauccucacugaauauaagcggguacaacuuuagucucggagcggcagucaaggccggugcuugcaugcuggauggcgggaacaugcuugaaaccaucaaagugucuccccagacaauggacggcauucugaaguccaucuugaaagugaagaaagcccucggaauguucauuagcgaugcaccuggugagaggaauccauaugaaaacauccuguacaagauauguuuaucgggggacggauggcccuauauugcuucucggacuuccaucaccggccgugccugggagaauacagucguugaucuggagucagacggcaagccucagaaagcggggaguaacggaagcaauaagucccuacagucugccgguuuuaccgcaggccucacguacagccaacugaugacucuuaaagaugcuauguugcagcuggacccaaacgccaagacauggauggauauugaagggcgccccgaggacccuguggaaaucgcucucuaccagccaucaaguggaugcuauauccacuucuuuagagagccgaccgaccugaaacaguucaagcaagaugccaaguacucccauggcauugacguaacugaucuuuuugcagcccagcccggucugacaagcgcugugauagacgcguugccuaggaauauggucaucaccugucaggggucugaugacauucggaaacucuucgaaucacagggccgaaaggauaucaaacugauagacauugcauuaaguaagacggauagccgcaaauaugagaacgccgugugggaccaauacaaggaucugugccacaugcauaccggaaucguuguggagaagaaaaagagaggcgggaaagaagagaucacaccacacugugcucuaauggacugcauuauguuugaugccgcagucuccggaggucucaauacuucugugcugagggccguacuuccccgggacaugguuuuccgcaccucgacaccuagaguggucuuguga

SEQ ID NO: 1862 - RNA, 1710 nt, Artificial Sequence
  derived and/or modified CDS sequence (opt3) from Lassa virus__ANH09723__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauaacgaccucaaaagacugagggaucuuaaucaagccguaaacaaucugguggaauugaagucgacacagcagaagucaguccuccgggugggaacucugacgagcgacgaucugcucaccuuagcggcugaccuggagaaacuuaagaguaaaguuacacgcacugaaagacccuugaccgccgguguguauaugggcaaccuguccucucagcaacuagaucagaggcgggcacuccugaauaugauagggaugagcggaggcaaccagggugcccgcacagggcgagacggagucgugagaguaugggauguuaagaaugcugagcuucugaacaaucaguucggcaccaugccuuccuugacucucgcaugucugacaaaacaaggccagguggacuuaaacgaugucgugcaggcccugaccgaccucgggcuuaucuacacggcuaaguauccaaauacuucagaccuggauagguugacccaaagucauccgauucuaaacaugaucgacacaaauaagagcucucugaacauuuccggauacaacuuuucacucggugccgcggugaaagcaggcgccugcaugcuggaugggggaaauaugcuugagacuaucaaggucagcccccagaccauggacggcauacugaaaaguaucuugaagguuaaaaagucucucgguauguucauuuccgauacaccuggggaacggaacccauaugagaauauccuguacaaaauuuguuuaagcggagacggcuggcccuauaucgcuucgcguaccucuauaacgggccgcgccugggaaaacacugugguagaucuggaguccgggggaaagccucagaaggcagguucaaauaacaguaauaaaagccuacaguccgcuggcuuugccgcggggcucacauacucucaacugaugacccuuaaggacgccauguugcagcuggauccaaacgcaaaaacuuggauggacauugagggaagacccgaagauccuguggagaucgcucucuaccagccaauuagcggcugcuauauccacuucuuuagggaaccgacagaccugaagcaguucaaacaagacgccaaguacucacaugguaucgaugucaccgaccuuuuugcugcccagcccgggcugacgagugcagugauugaggccuugccucggaauaugguuauaaccugucagggcuccgaugacauccgaaaacucuucgaaagccagggacgcaaggauauuaagcugaucgacauagcuuuaucuaaaacagauucaagaaaguaugagaacgcggugugggaccaauacaaagaucugugccacaugcauacuggcgucgugguagagaagaagaaaaagggagggaaagaagagauuaccccacacugugcacuaauggacugcaucauguuugaugccgcuguuagugguggccucaauacacuggugcuuagggccgucuugccccgggacaugguguuccgcacuagcaccccuaaggucgugcuguga

SEQ ID NO: 1863 - RNA, 1710 nt, Artificial Sequence
  derived and/or modified CDS sequence (opt3) from Lassa virus__ANH09725__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauaacgaccucaaaagacugagggaucuuaaucaagccguaaacaaucugguggaauugaagucgacacagcagaagucaguccuccgggugggaacucugacgagcgacgaucugcucauauuagcggcugaccuggagaaacuuaagaguaaaguuacccgcacagaaagacccuuguccgccgguguguauaugggcaaccugucuagccagcaacuagaucagaggcgggcacuccugaauaugaucgggauguccggaggcaaccagggugcccgcgcugggcgagacggagucgugagaguaugggauguuaagaaugcagaccuucugaacaaucaguucggcacuaugccuucauugacccucgccugucugacaaaacaaggccagguggauuuaaacgacgucgugcaggcucugaccgaccucgggcuuauuuacacugccaaguauccaaauacaagugaucuggacagguugacccaaagccauccgauccuaaacaugauugauacgaauaagucuucccugaacaucucaggauacaacuuuagccucggugcggcagugaaagccggcgcuugcaugcuggacgggggaaauaugcuugagacuauaaaggucaguccccagaccauggauggcauccugaaaucuauuuugaagguuaaaaagucccucgguauguucaucagcgacacaccuggggagcggaacccauaugaaaauauucuguacaaaaucuguuuaucgggagauggcuggcccuauauagccucucguacuuccauuaccggccgcgcaugggagaacacagugguagaccuggaaucagggggaaagccucagaaggcugguaguaauaacagcaauaaaucccuacagucugccggcuuugcggccgggcucaccuacagccaacugaugacgcuuaaggaugcaauguugcagcuggacccaaacgcuaaaacuuggauggauaucgagggaagacccgaggacccuguggaaauugcccucuaccagccaaucucaggcugcuauauccacuucuuuagggagccgacagaccugaagcaguucaaacaagaugcuaaguacagucaugguauugacgucaccgaucuuuuugccgcacagcccgggcugacuuccgccgugauagaggcuuugccucggaauaugguuaucacaugucagggcagcgacgauauucgaaagcuccuggaaucucagggacgcaaagacaucaaguuaauagauauugcgcugucaaaaaccgacaguagaaaguaugaaaacgcagugugggaucaauacaaagaccuaugccacaugcauacgggcgucgugguagagaagaagaaaaggggagggaaggaggaaaucaccccacacugugcccucauggauugcaucauguucgacgcugccguuagcgguggccugaauacacuuguguugcgggcaguccugccccgcgauaugguguuuagaacuuccaccccuaaagucgugcucuga

SEQ ID NO: 1864 - RNA, 1710 nt, Artificial Sequence
  derived and/or modified CDS sequence (opt3) from Lassa virus__ANH09729__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauucggaccucaaaagacugagggaucuuaaccaagccguaaauaaccugguggaauugaagucaacacagcagaagaguguccuccgggugggaacucugacgagugacgaucugcucaccuuagcggcugaccuggagaaacuuaaguccaaaguuacacgcacugaaagacccuugucugccgguguguauaugggcaaucugagcucccagcaacuagaucagaggcgggcacuccugaacaugauagggaugucaggaggcaaucagggugcccgcaccgggcgagacggagucgugagaguaugggauguuaagaacgcugaccuucugaauaaccaguucggcacaaugccuaguuugacccucgcaugucugacuaaacaaggccagguggauuuaaaugacgucgugcaggcccugacagaccucgggcuuaucuacaccgcuaaguauccaaacacgagcgaucuggacagguugacucaaucucauccgauucuaaauaugaucgauaccaacaaguccucacugaauauuagcggauacaacuuuagucucggugccgcggugaaagcaggcgccugcaugcuggacgggggaaacaugcuugagacaaucaaggucucuccccagacuauggauggcauacugaaauccaucuugaagguuaaaaagagccucgguauguucauuucggacaccccuggggagcggaauccauaugaaaacauccuguacaaaauuuguuuaucuggagauggcuggcccuauaucgcuucccguacaucaauaaccggccgcgccugggagaauacggugguagaccuggaaagugggggaaagccucagagagcagguagcaacaauuccaacaagucucuacagagcgcuggcuuugccgcggggcucacuuacucacaacugaugacacuuaaagaugccauguugcagcuggacccaaaugcaaagaccuggauggauauugagggaaggcccgaggacccuguggaaaucgcucucuaccagccaacuagcggcugcuauauucacuucuuucgggagccgacagaccugaaacaguucaagcaagaugccaaauacucccaugguaucgacgucaccgaucuuuuugcugcccagcccgggcugacgagcgcagugaucgaagccuugccucgaaacaugguuauuaccugucagggcucugacgauauacgcaagcuccuggagucacagggaagaaaggacaucaaauuaauugauaucgcucugaguaagacagacagcaggaaauaugaaaaugcggugugggaucaauacaaggaccuaugccacaugcauacuggcgucgugguagagaaaaagaagaaagggggaaaggaggaaauaaccccacacugugcacucauggauugcauuauguucgacgccgcuguuuccgguggccugaacacacuuguguugcgggccguccugccccgcgauaugguguuuagaacuucuaccccuaaagucgugcucuga

SEQ ID NO: 1865 - RNA, 1710 nt, Artificial Sequence
  derived and/or modified CDS sequence (opt3) from Lassa virus__ANH09731__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauaacgaccucaaaagacugagggaucuuaaucaagccguaaacaaucugguggaauugaagucgacacagcagaagucaguccuccgggugggaacucugacgagcgacgaucugcucaccuuagcggcugaccuggagaaacuuaagaguaaaguuacacgcacugaaagacccuuguccgccgguguguauaugggcaaccugucuagccagcaacuagaucagaggcgggcacuccugaauaugauagggaugaccggaggcaaccagggugcccgcacagggcgagacggagucgugagaguaugggauguuaagaaugcugaccuucugaacaaucaguucggcaccaugccuuccuugacucucgcaugucugacaaaacaaggccagguggauuuaaacgacgucgugcaggcccugaccgaccucgggcuuaucuacacggcuaaguauccaaauacuucagaucuggacagguugacccaaagucauccgauucuaaacaugaucgauacaaauaagagcucucugaacauuuccggauacaacuuuucacucggugccgcggugaaagcaggcgccugcaugcuggacgggggaaauaugcuugagacuaucaaggucagcccccagaccauggauggcauacugaaaaguaucuugaagguuaaaaagucucucgguauguucauuuccgacacaccuggggagcggaacccauaugaaaauauccuguacaaaauuuguuuaagcggagauggcuggcccuauaucgcuucgcguaccucuauaacgggccgcgccugggagaacacugugguagaccuggaauccgggggaaagccucagagagcagguucaaauaacaguaauaagagccuacaguccgcuggccucgccgcggggcugacauacucucaacuuaugaccuugaaagaugccaugcugcagcucgacccaaacgcaaagacuuggauggauauugagggaaggcccgaggacccuguggaaaucgcucuguaccagccaacaagcggcugcuauauucacuuuuuccgggagccgaccgaccuuaaacaguuuaagcaagaugccaaauacucacaugguaucgacgucacggaucuguucgcugcccagcccggguugaccagugcagugaucgaagcccucccucgaaauaugguuauuacaugucagggcuccgacgauauacgcaagcuguuagagagccagggaagaaaggacaucaaacugauugauaucgcucuaucuaagacugacucaaggaaauaugaaaacgcggugugggaucaauacaaggaccucugccacaugcauaccggcgucgugguagagaaaaagaagaaagggggaaaggaggaaauaacaccacacugugcacugauggauugcauuauguuugacgccgcuguuagugguggccuuaauacuuuggugcugcgggccguccucccccgcgauaugguguucagaaccagcacaccuaaagucgugcuguga

SEQ ID NO: 1866 - RNA, 1710 nt, Artificial Sequence
  derived and/or modified CDS sequence (opt3) from Lassa virus__ANH09733__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaagcagcgacgugacgauaacgaccucaaaagacugagggaucuuaaucaagccguaaacaaucugguggaauugaagucgacacagcagaagucaguccuccgggugggaacucugacgagcgacgaucugcucaccuuagcggcugaccuggagaaacuuaagaguaaaguuacacgcacugaaagacccuuguccgccgguguguauaugggcaaccugucuagccagcaacuagaucagaggcgggcacuccugaauaugauagggauguccggaggcaaccagggugcccgcaccgggcgagacggagucgugagaguaugggauguuaagaaugcugaccuucugaacaaucaguucggcacaaugccuucauugacccucgcaugucugacuaaacaaggccagguggauuuaaacgacgucgugcaggcccugacagaccucgggcuuaucuacaccgcuaaguauccaaauacgagugaucuggacagguugacucaaagccauccgauucuaaacaugaucgauaccaauaagucuucccugaacauuucaggauacaacuuuagccucggugccgcggugaaagcaggcgccugcaugcuggacgggggaaauaugcuugagacaaucaaggucaguccccagacuauggauggcauacugaaaucuaucuugaagguuaaaaagucccucgguauguucauuagcgacaccccuggggagcggaacccauaugaaaauauccuguacaaaauuuguuuaucgggagauggcuggcccuauaucgcuucucguacauccauaaccggccgcgccugggagaacacggugguagaccuggaaucagggggaaagccucagagagcagguaguaauaacagcaauaagucccuacagucugcuggcuuugccgcggggcucacuuacagccaacugaugacacuuaaagaugccauguugcagcuggacccaaacgcaaagaccuggauggauauugagggaaggcccgaggacccuguggaaaucgcuuucuaccagccaauuucaggcugcuauauccacuuuuuccgggagccgacugaccucaaacaguuuaagcaagaugccaaauacagucaugguaucgacgucacagaucuguucgcugcccagcccgggcuuaccuccgcagugauugaagcccugccucgaaauaugguuauaacgugucagggcagcgacgauauccgcaaguugcucgagucucagggaagaaaggacauuaaacugaucgauauagcuuuaucaaagaccgacaguaggaaauaugaaaacgcggugugggaucaauacaaggaccugugccacaugcauacaggcgucgugguagagaaaaagaagaaagggggaaaggaggaaauuacuccacacugugcacuaauggauugcaucauguuugacgccgcuguuagcgguggccucaauacccuggugcuucgggccgucuugccccgcgauaugguguucagaacauccacuccuaaagucgugcuguga

SEQ ID NO: 1867 - RNA, 1710 nt, Artificial Sequence
  derived and/or modified CDS sequence (opt3) from Lassa virus__ANH09735__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauauucagcggcuaaugcgcaaggaacgacgugacgauucggaccucaaaagacugagggaucuuaaccaggccguaaauaaccugguggaguugaagucaacacaacagaaguccguccuccgggugggaacucugaguuccgacgaucugcucacguuagcggcugaccuggaaaaacuuaagucuaaaguuauacgcaccgagagacccuugagcuccgguguguauaugggcaaucugucaacacagcagcuagaucaaaggcgggcccuccugaacaugaucgggaugacuaauggaggccagggugcaaacgccgggcgcgacggaauuguccgagugugggauguaaagaaugcugagcuucugaacaaucaguucggcaccaugccuaguuugacacucgcaugucugaccaaacagggccaaguugacuuaaacgaugccgugcaggcucugacugaccucgggcuuaucuacacagccaaguauccaaauagcucugaccuggauagauugucccagaaccauccgauucuaaauaugaucgacaccaagaaaucaagccugaacauaaguggauacaacuuuucucucggugcggcagucaaggccggcgcuugcaugcuggaugggggaaauaugcuugaaacgaucaaagugagcccccaaacuauggacggcauucugaaaagcaucuugaaggugaagaggucgcucgguauguucgucucugauaccccuggggagcggaacccauaugaaaauauucuguacaaaaucuguuuauccggagacggcuggcccuauguugccucacguacaaguauaauuggccgcgcaugggagaacacugugguagaucuggagagcgacuccaagccucagagaccagggucuaaggaaagcaauaggucacuacagaccgcuggauuucccgccggucucacauacagucagcugaugacccuuaaagauuccauguugcaacuggacccuaacgcgaagacguggauggauaucgagggccggccagacgacccgguggaaauugcccucuaccagcccagcucugggugcuauauccacuucuuucgagagccuacugaucugaaacaguucaagcaggacgcaaaauacucacauggaaucgauauuggcgaccuuuuugcugcccaaccaggucugacaagugcugucauagaagccuugccccgcaauauggugaucaccugucaggggagcgaggauauuaagagacuccuggagucccagggcaggaaggacauccgguuaguugauauaucucugucgaaagcagacagccgcaaguucgaaaacgccgugugggaucaguuuaaagaccuaugcaauaugcacacuggagucgugguagagaagaaaaagaagggcgggaaagaagagauuacaccucauugugcucucauggauugcaucauguucgacgcggcaguuaugggaggucuggaugccaaggugcuuagagcugucuugccaaaagacaugguguuuaggaccuccacgccccgugucgugcuguga

SEQ ID NO: 1868 - RNA, 1710 nt, Artificial Sequence
  derived and/or modified CDS sequence (opt3) from Lassa virus__ANH09737__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauauucagcggcuaaugcgcaaggaacgacgugacgauucggaccucaaaagacugagggaucuuaaccaggccguaaauaaccugguggaguugaagucaacacaacagaaguccguccuccgggugggaacucugaguuccgacgaucugcucacguuagcggcugaccuggaaaaacuuaagucuaaaguuauacgcaccgagagacccuugagcuccgguguguauaugggcaaucugucaacacagcagcuagaucaaaggcgggcccuccugaacaugaucgggaugacuaauggaggccagggugcaaacgccgggcgcgacggaauuguccgagugugggauguaaagaaugcugagcuucugaacaaucaguucggcaccaugccuaguuugacacucgcaugucugaccaaacagggccaaguugacuuaaacgaugccgugcaggcucugacugaccucgggcuuaucuacacagccaaguauccaaauagcucugaccuggauagauugucccagaaccauccgauucuaaauaugaucgacaccaagaaaucaagccugaacauaaguggauacaacuuuucucucggugcggcagucaaggccggcgcuugcaugcuggaugggggaaauaugcuugaaacgaucaaagugagcccccaaacuauggacggcauucugaaaagcaucuugaaggugaagaggucgcucgguauguucgucucugauaccccuggggagcggaacccauaugaaaauauucuguacaaaaucuguuuauccggagacggcuggcccuauguugccucacguacaaguauaauuggccgcgcaugggagaacacugugguagaucuggagagcgacuccaagccucagagaccagggucuaaggaaagcaauaggucacuacagaccgcuggauuucccgccggucucacauacagucagcugaugacccuuaaagauuccauguugcaacuggacccuaacgcgaagacguggauggauaucgagggccggccagacgacccgguggaaauugcccucuaccagcccagcucugggugcuauauccacuucuuucgagagccuacugaucugaaacaguucaagcaggacgcaaaauacucacauggaaucgauaugggcgaccuuuuugcugcccaaccaggucugacaagugcugucauugaagccuugccccgcaauauggugauaaccugucaggggagcgaggauaucaagagacuccuggagucccagggcaggcgggacauucgcuuaguugauaucucucugucgaaggcagacagcagaaaauucgaaaacgccgugugggaucaguuuaaggaccuaugcaauaugcacacuggagucgugguagagaaaaagaaaaagggcgggaaggaagagauaacaccucauugugcucucauggauugcauuauguucgacgcggcaguuaugggaggucuggaugccaaagugcuuagggcugucuugccaaaggacaugguguuucguaccuccacgccccgggucgugcuguga

SEQ ID NO: 1869 - RNA, 1710 nt, Artificial Sequence
  derived and/or modified CDS sequence (opt3) from Lassa virus__ANH09739__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauauucagcggcuaaugcgcaaggaacgacgugacgauucggaccucaaaagacugagggaucuuaaccaggccguaaauaaccugguggaguugaagucaacacaacagaagaguguccuccgggugggaacucugaguuccgacgaucugcucacguuagcggcugaccuggaaaaacuuaagucuaaaguuauacgcaccgagagacccuugagcuccgguguguauaugggcaaucugucaacacagcagcuagaucaaaggcgggcccuccugaacaugaucgggaugacuagcggaggccagggugcaaaugccgggcgcgacggaauuguccgagugugggauguaaagaacgcugagcuucugaauaaccaguucggcaccaugccuagcuugacacucgcaugucugaccaaacagggccaaguugacuuaaaugaugccgugcaggcucugacugaccucgggcuuaucuacacagccaaguauccaaacucuuccgaccuggauagauugucacagaaucauccgauucuaaacaugaucgacaccaagaaaagcagucugaauauaucuggauacaacuuuucccucggugcggcagucaaggccggcgcuugcaugcuggaugggggaaacaugcuugaaacgaucaaagugagcccccaaacuauggacggcauucugaagucgaucuugaaagugaagaggucucucgguauguucgucuccgauaccccuggggagcggaauccauaugaaaacauucuguacaaaaucuguuuaucaggagacggcuggcccuauguugccagucguacaagcauaauuggccgcgcaugggagaauacugugguagaucuggaguccgacucuaagccucagagaccagggagcaaggaaucaaacaggagucuacagaccgcuggauuucccgccggucucacauacucccagcugaugacccuuaaagauagcauguugcaacuggacccuaaugcgaagacguggauggauaucgagggccggccagacgacccgguggaaauugcccucuaccagcccucuucagggugcuauauccacuucuuucgagagccuacugaucugaaacaguucaagcaggacgcaaaauacagucauggaaucgauauuggcgaccuuuuugcugcccaaccaggucugacaagcgcugucauagaagccuugccccgcaacauggugaucaccugucagggguccgaggauauuaagagacuccuggagucucagggcaggcgggacauccgcuuaguugauauaucgcugagcaaggcagacuccagaaaauucgaaaaugccgugugggaucaguuuaaggaccuaugcaacaugcacacuggagucgugguagagaaaaagaaaaagggcgggaaggaagagauuacaccucauugugcucucauggauugcaucauguucgacgcggcaguuaugggaggucuggaugccaaagugcuuagggcugucuugccaaaggacaugguguuucguaccucaacgccccgggucgugcuguga

SEQ ID NO: 1870 - RNA, 1710 nt, Artificial Sequence
  derived and/or modified CDS sequence (opt3) from Lassa virus__ANH09741__NP
augagcaacuccaaggaggugaaaucuuuccuguggacccagucacucagaagggaacuuaguggcuacugcacaaauaucaagcugcaagucguuaaagacgcccaggcuuuguuacacgggcuggauuuuagcgagguguccaacguacagcggcuaaugcgcaagcagaaacgagacgauaaugaccucaagcgucugagagaucuuaaccaagcagugaauaaccuggucgaauugaagucugugcagcagaaaucgguucucaaggugggaacucucaauucagacgaucugcugacguuagccgcggaccuggagaaacuuaagagcaaagucgugaggaccgaacggcccuugaguuccgguguauauaugggcaaccugucuagccagcaacuagaucagcgcagagcucuccugaauaugauugggauggccggaggcucccaggguaaccagccuucaagggacgggguugugcgggucugggaugugaagaaugcagaccuucugaacaaucaauucggaacaaugccaaguuugacucucgccugucugaccaagcagggccagguggauuuaaacgacgucguucuggcucucacagaccuuggccugauauacaccgcaaaauauccgaauagcucugauuuggaccgccuaucccaaaaccaucccgugcugaacaugaucgauguaaauaagucaagccucaacauuaguggguacaauuuuucucugggagccgcugugaaagccggugcgugcaugcuugacggcgggaacaugcuggagacuaucaagauuuccccucagacagucgauggaaucuugaaaagcauacucaaggugaaacgagcacugggcauguucguuucggacaccccaggugagagaaaucccuaugaaaacaucuuauacaaggugugucugucugggaauggauggccuuauauugccuccaggacgucaaucgucggccgggcuugggagaacacugugguagaucuagaaaguaauaagaaccagccaaaaguuggcaauaacgggagcaauaagaugcuccaguccucuggauuugccaccggucugacauacagccaacuuaugacuuugcgugacucaaugcugcagcucgaucccaccgcaaaaacauggauugacaucgagggccgcccugaggauccaguggaacuggcucuuuuccagccgaguuccgggugcuacauacacuuuuucagagagcccaccgaccugaagcaguuuaaacaagacgccaaguauagccauggaauugaugucaacgacuuguucucugcgcagccuggccucacgucagccgugcuggaagcauuaccaaggaauaugguccugacuugucaggguagugaugacauccggaagcuacucgauagccaggaccgaaaagauauuaagcugaucgacaucucccuuucuaaagcugaugcccgcaaguuugagaacgacgugugggaucaauucaaagacuugugccacaugcauacagggauuguuguggaaaagaagaaaaagggcggaaaacaggagaugacuccccacugugcucugcucgauugcauaauguuugacgccgcaguaucgggcgggcugaacgucccuaccuuaagagccgugcugccaacagacaugguuuucaggaccaucacgaccaaggugguccuuuga

SEQ ID NO: 1871 - RNA, 1713 nt, Artificial Sequence
  derived and/or modified CDS sequence (opt3) from Lassa virus__CAA36646__NP
augagcgccuccaaggaggugagaucuuuccuguggacccagucacucaggcgggaacuuaguggcuacugcagcaacaucaaacugcaagucguuaaggacgcucaggcauuguuacacgggcuggauuuuuccgaggugucuaauguacagcgccuaaugcgaaaacagaagcgugacgauggagaccucaaaagacugagggaucuuaaccaagccgugaauaaccuggucgaauugaagucgacacagcagaagucagugcuccggguugguacucugagcagugacgaucugcucauuuuagcggcugaccuggagaaacuuaaguccaaagugacgcgcaccgaaagacccuugucuagcggcgucuauauggggaaucuguccucacagcaacuagaucagaggcgggcccuccugaacaugauaggaaugacaggcgugaguggugggggaaagggcgcaagcgacggcaucguacgcguuugggaugugaaaaaugccgagcuucugaacaaucaguucgggacuaugccuucuuugacccucgcuugucugacaaagcagggacaagucgacuuaaacgaugcagugcaggcccugaccgaccucggucuuauuuacacugcuaaguauccaaauuccucagaccuggaucgauugagccagagucauccgauccuaaacaugauugacacuaaaaagucuucccugaauaucagcggcuacaacuuuucgcucggggccgcggugaaagcaggagccugcaugcuggauggcgguaauaugcuugagaccauaaaggucucuccccaaacgauggacgggauccugaaauccauuuugaagguuaaaaagucacucggaauguucgugagugauacuccuggcgaaagaaacccauaugagaacauccuguacaagauuuguuuaagcggcgacggguggcccuauaucgcuuccaggaccucuauaguaggacgggccugggaaaauacaguggucgaucuggagcaggacaacaaaccucagaagauugguaauggcgggagcaacaaaucacuacagagugcaggauuugcugccggccucacuuacucccaacugaugacccuuaaggauuucaaaugcuuuaauuugaucccaaacgcgaagacauggauggacauugagggucgucccgaagauccuguggagaucgcccuguaccagccaagcucuggguguuauguucacuucuuucgcgaaccgaccgaccucaagcaguucaaacaggacgcaaaguacucacauggcaucgaugugacggaccuguuugcugcccaacccggacuuacaagugcugucauugaggcccugccuagaaauauggugauaacaugccagggcagcgaagauaucaggaaauugcucgagucccaggggcggcgagacauuaagcugaucgauauaaccuuaucuaaagcagacucgcgcaaguucgagaacgccguaugggaucaguuuaaggaccugugucacaugcauacuggaguuguggucgagaaaaagaaaagagguggcaaggaagaaauuacaccacacugcgcucuaauggauuguaucauguucgacgcggcagugagcgggggacucgaugccaaaguccugagggugguucuuccccgggacaugguguuccgcaccuccacgccuaagguagucuuguga

SEQ ID NO: 1872 - RNA, 1710 nt, Artificial Sequence
  derived and/or modified CDS sequence (opt3) from Lassa virus__CCA30315__NP
augagcgccuccaaggaggugaaaucuuuccuguggacccagucacucagaagggaacuuaguggcuacugcagcaacaucaagcugcaagucguuaaagacgcucaggcauuguuacacgggcuggauuuuuccgaggugucuaauguacagcggcuaaugcgcaagcagcgacgugacgauucggaccucaaaagacugagggaucuuaaccaagccgugaauaaccuggucgaauugaagucaacacagcaaaagagcgugcuccggguuggaacucugaguuccgacgaucugcucacguuagcggcugaccuggagaaacuuaagucuaaagugacccgcacagaaagacccuugagcuccggugucuauaugggcaaucugucaagucagcagcuagaucagaggcgggcccuccugaaccuuauugggaugacuaauggaagccagggcucucaggcaggucgcgacggggugguacgaguuugggaugugaagaacgccgagcuguugaauaaccaauucggaaccaugccuucccucacacuggcuuguuuaaccaaacagggccaggucgaccugaaugauguggugcaagcacucacugaccuuggccugauauacacagccaaguauccaaacaccucagacuuggauagacuaacgcagagccauccgauccugaauaugauugacacuaagaaaaguucucucaacaucuccggguacaauuuuagccugggagcugccgucaaggcgggugcaugcaugcuugauggcgggaacaugcuggagaccauuaaaguuucgccccagucuauggacggaaucuugaaguccauacucaaagugaagagggcccugggcauguucguaucagauacaccuggugaacggaacccauaugagaauaucuuauacaaaauuugucugaguggggacggauggcccuauaucgcuagccguacuuccauugugggccgcgccugggaaaacaccgucguggaucuagagacagacggcaagccucagaagaucgggucuggaaauagcaacaaaucacuccaaagugcagguuuuuccgcuggccugaccuacagccagcuuaugacguugaaggaugccaugcugcagcucgacccaaaugcgaaaacuuggauggauauagaggggagacccgaagacccuguugagguggcccuguaccagccaauuucuggaugcuauauccacuucuuuagggaaccgacagaccuuaagcaauucaaacaggaugcaaaguacucacauggcauugacaucgcugaucuguuugccgcucagcccgguuugaccagugccgucaucgaggcacucccucggaacauggugauuacuugucaggggagcgaagacauaaagaaacuguuagagucccaaggccgaaaggauaucaaacugauugacaucgcccuaucuaagauagauucgcgcaaauucgagaaugcuguaugggaccaguauaaggaucucugccacaugcauacaggaguuguggucgaaaagaaaaagagaggcgggaaagaggaaauuaccccacacugugcgcugauggacugcaucauguuugaugcagccgugagcggaggucuuaacacguugguccugagggcugugcucccccgggacaugguuuuccgcaccuccacaccuagagugguacuguga

SEQ ID NO: 1873 - RNA, 1710 nt, Artificial Sequence
  derived and/or modified CDS sequence (opt3) from Lassa virus__JX985061__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuucgcaguaaggugauuagaaccgagaggcccuuguccgccgguguuuauaugggcaaccugucuagccagcagcuagaucaacggcgcgcacuccugaauaugaucgggauguccggaggcaaccagggugcccgagcugggagagacggaguggucagggugugggauguuaaaaaugcagagcuucugucaaaccaguucggcacaauuccuaguuugacucucgccugucugaccaagcagggccaaguagacuuaaaugaugcugugcaggcccugacagaccucgggcuuaucuacaccgcgaaauauccaaacacuagcgaccuggaucgguugacacagucucauccgauacuaaauaugaucgacaccaagaaguccucacugaacauuagcggauacaauuuuagucucggugcagccgucaaagcuggcgccugcaugcuggaugggggaaacaugcuugaaacgaucaaggugucuccccaaacuauggacggcauucugaaauccaucuugaaggugaaaaaggcacucgguauguucauaagcgauaccccuggggagcguaacccauaugaaaauauucuguacaaaaucuguuuaucgggagacggcuggcccuauauugcuucucgcacauccaucacuggcagagccugggagaacaccgucguugaucuggagucagacgggaagccucagaaggcggauaguaauaacagcuccaaaucucuacagagcgccggauuuacagcaggucucaccuacucacagcugaugacgcuuaaggacgcuauguugcaacuggauccaaaugccaaaacuuggauggacaucgaaggcaggcccgaggacccuguggaaauugcucucuaccagccaaguuccgggugcuauauacacuucuuucgggagccgacagaucugaagcaguucaaacaggacgccaaguacagccauggaaucgauguaaccgaccuuuuugcaacucaacccggccugacaucugccgugauugaugcuuugccucgaaacauggucaucaccugucaggguucagacgauauacgcaagcuccuggaaagucaggggagaaaagacauuaaguuaaucgauaucgaccugagcaaaacggauuccaggaaguaugagaaugcggugugggaccaguacaaagaucuaugccacaugcauaccggcguuguggucgagaagaagaaacggggaggcaaggaagagauuacaccacacugugcacucauggacugcaucauguucgacgccgcugugucugggggacugaacacuucgguacuucgcgccguuuugcccagagauaugguguuuaggaccagcacaccucgugucgugcuguga

SEQ ID NO: 1874 - RNA, 1710 nt, Artificial Sequence
  derived and/or modified CDS sequence (opt3) from Lassa virus__NP_694869__NP
augagcgccuccaaggagaucaaaucuuuccuguggacccagucacucagaagggaacuuaguggcuacugcagcaacauuaagcugcaaguggucaaagacgcucaggcauuguuacacgggcuggauuuuuccgagguuucuaaugugcagcggcuaaugcgcaaggaacgacgugacgauaacgaccucaaaagacugagggaucuuaaucaggccguaaacaaucugguggaguugaagucgacacaacagaagucaauacuccgggucggaacucugacgagcgacgaucugcucaucuuagcggcugaccuggaaaaacuuaagaguaaagugauucgcaccgagagacccuuguccgccgguguuuauaugggcaaccugucuagccagcagcuagaucaaaggcgggcacuccugaauaugaucgggauguccggaggcaaccagggugcccgcgcugggcgagacggaguggucagagugugggauguaaagaaugcagagcuucugaacaaucaguucggcacaaugccuucauugacucucgccugucugaccaaacagggccaaguugacuuaaacgaugcugugcaggcccugacagaccucgggcuuauuuacaccgcgaaguauccaaauacaagugaccuggauagguugacucagagccauccgauccuaaacaugauagacaccaagaaaucuucccugaauaucucaggauacaacuuuagccucggugcagccgucaaggcuggcgccugcaugcuggaugggggaaacaugcuugaaacgauuaaagugaguccccaaacuauggacggcauccugaagucuauuuugaaagugaagaaagcacucgguauguucaucuccgauaccccuggggagcggaauccauaugaaaacauacuguacaagauuuguuuaagcggagacggcuggcccuauaucgcuucgcguacaucuauuacuggccgcgccugggagaauaccgucguugaucuggaguccgacgggaagccucagaaagcggauucaaacaauaguagcaagucccuacagucugccggauuuacagcaggucucaccuacagccagcugaugacgcuuaaagacgcuauguugcaacuggauccaaacgccaagacuuggauggacaucgaaggcagacccgaggacccuguggaaaucgcucucuaccagccaucaagugggugcuauauucacuucuuuagggagccgacagaucugaaacaguucaagcaggacgccaaguacucccauggaauagauguaaccgaccuuuuugcaacucaacccggccugacaagcgccgugaucgaugcuuugccucggaauauggucauuaccugucaggguucugacgauauccgaaaacuccuggaaucacaggggcgcaaggacauaaaauuaauugauaucgcgcugaguaagacggacagcagaaaauaugagaacgcagugugggaucaguacaaggaccuaugccacaugcauaccggcguuguggucgagaagaaaaagaggggaggcaaagaagagaucacaccacacugugcccucauggauugcauuauguucgacgcugccguguccgggggacugaauacuucuguacuucgggcaguuuugccccgcgacaugguguuuagaaccucgacaccuagggucgugcuguga

SEQ ID NO: 1875 - RNA, 1710 nt, Artificial Sequence
  derived and/or modified CDS sequence (opt3) from Lassa virus__SCA79106__NP
augagcaacuccaaggaggugaaaucuuuccuguggacccagucacucagaagggaacuuaguggcuacugcagcaauaucaagcugcaagucguuaaagacgcccaggcuuuguuacacgggcuggauuuuuccgaggugucuaacguacagcggcuaaugcgcaagcagaaacgagacgauggagaccucaagcgucugagagaucuuaaucaagcagugaacaaucuggucgaauugaagucggugcagcagaaaucaauucucaggguugguacacugacuagcgacgaucugcucacguuagccgcggaccuggagaaacuuaaaaguaaggugacccggacagaacgccccuuguccucuggcgucuauauggggaaccugagcucccagcaacuagaucagagaagggcucuccugucaaugauaggaaugaguggcgguaaucagaacagccagccuaaaggggacggagugguacggguuugggaugugaagaaugccgaccuucugaacaaucaauucggcacuaugccaucuuugacccucgcaugucugacaaagcagggccaggucgauuuaaacgacgccgugcaagcucugaccgaccucgggcuuaucuacacugcaaaauaucccaauuccucagaucuggaccgcuugagccagagucauccgauucuaaacaugaucgauacaaagaaaucuucccugaauauuagcggauacaacuuuucgcucggugccgcuaucaagaccggcgccugcaugcuggacgggggaaacaugcuugagacgauaaaagugacuccucagaccauggauggcauccugaagucuauuuugaaagucaagcgaucccucgguauguucaucucagacacaccaggggagagaaaucccuaugaaaacauucuguacaagaucuguuuaaguggagauggcuggccuuauauagcgagcaggacugcaauuaucggccgggccugggagaauaccguuguggaccuggaauccgauucuaaaccacagaagauugggagcaacggaucaaauaaaagucuacaauccgcugguuuugcccccggccucacauacagccagcugaugacccuuaaggacucuauguugcagcuggauccuaacgcaaaaacguggaucgacaucgaggggcguccagaggacccgguagaaguggcucucuuccagcccauuucaggaugcuacauacacuuuuuccgcgagccuacugaucugaagcaauuuaagcaggacgccaaauauagucauggcaucgaugucacagaccuuuucgcggcccagccaggucugaccagcgcagugauugaggcuuugcccagaaauaugguucucacuugucagggguccgaugacaucaagaaacuguuagauucucaaggcaggcgggacauaaagcugauugaugugucgcuaaacaaaaucgacagccgaaaguuugaaaaugccgucugggaucaguacaaggaccucugccacaugcauacaggagugguaguugaaaagaagaaaaagggcgggaaagaggagaucaccccucacugugcucugcuugauugcauuauguucgacgccgcaguguccggagguuugaacgccacgguccugcgcgcugugcucccaagagacauggucuuuaggaccucaagucccaaggugguucuguga

SEQ ID NO: 1876 - RNA, 1473 nt, Artificial Sequence
  derived and/or modified CDS sequence (opt4) from Lassa virus__AAF86703__GPC
augggccagaucaucaccuucuuccaggaggugccccacgugaucgaggaggugaugaacaucgugcugaucgcccugagccugcuggccauccugaagggcaucuacaacguggccaccugcggccuguucggccugaucagcuuccugcugcugugcggcagaagcugcagcgugaccuacaagggcguguacgagcugcagacccuggagcugaacauggccaaccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuucgccguggacgccgccaaccacugcggcaccaucgccaacggcgugcugcagaccuucaugagaauggccuggggcggcagcuacaucgcccuggacagcggcaagggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgaggcccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucaagagacugaagaccgaggcccagaugagcauccagcugaucaacaaggccgugaacgcccugaucaacgaccagcugaucaugaagaaccaccugagagacaucaugggcauccccuacugcaacuacagcagauacugguaccugaaccacaccgugaccggcaagaccagccugcccagaugcuggcuggugagcaacggcagcuaccugaacgagacccacuucagcgacgacaucgagcagcaggccgacaacaugaucaccgagaugcugcagaaggaguacauggacagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcaccccggcgugcccgugaaguggaagagauga

SEQ ID NO: 1877 - RNA, 1476 nt, Artificial Sequence
  derived and/or modified CDS sequence (opt4) from Lassa virus__AAG41802__GPC
augggccagaucgugaccuucuuccaggaggugccccacgugaucgaggaggugaugaacaucgugcugaucgcccugagcauccuggccgugcugaagggccuguacaacaucgccaccugcggccugaucggccugaucaccuuccugcugcugugcggcagaagcugcagcagcaaccuguacaagggcguguacgagcugcagagccuggaccugaacauggagacccugaacaugaccaugccccugagcugcaccaagaacaacagccaccacuacaucagagugggcaacgacaccggccuggagcugacccugaccaacaccagcauccugaaccacaaguucugcaaccugagcgacgcccacaagaaggaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccaucgacgccgccaaccacugcggcaccguggccaacggcauccugcagaccuucaugagaauggccuggggcggcagcuacaucgcccuggacagcggcagaggcaacugggacugcaucaugaccagcuaccaguaccugaucauccagaacaccaccugggagaaccacugccaguucagcagacccagccccaucggcuaccugggccugcugagccagagaaccagagacaucuacaucagcagaagacugcugggcaccuucaccuggacccugagcgacagcgagggcaacgccacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagcagacugaagagcgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaucaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugagacuggugaagauccccacccacagacacaucgugggcaagcccugccccaagccccacagacugaaccacaugggcaucugcagcugcggccuguacaagcagcccggcgugcccgugagauggaagagauga

SEQ ID NO: 1878 - RNA, 1473 nt, Artificial Sequence
  derived and/or modified CDS sequence (opt4) from Lassa virus__AAL13212__GPC
augggccagaucgugaccuucuuccaggaggugccccacgugaucgaggagaucaugaacaucgugcugaucacccugagccugcuggccauccugaagggcguguacaaccuggccaccugcggccugaucggccugaucaccuuccuguuccugugcggcagaagcugcagcaugaccuacaagggcagcuaccagcuggagacccuggagcugaacauggagacccugaacaugaccaugccccugagcugcaccaagaacaccagccaccacuacaucagagugggcaacgagaccggccuggagcugacccugaccaacaccagcaucaucaaccacaaguucugcaaccugagcgacgcccacaagaagaaccuguacgaccacagccugaugagcaucaucagcaccuuccaccugagcauccccaacuucaaccaguacgaggccaugagcugcgacuucaacggcggcaagaucagcauccaguacaaccugagccacaccuacgccggcgacgccgccaagcacugcggcacccuggccaacggcauccugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagagaucuacaucagcagaagacugcugggcaccuucaccuggacccugagcgacagcgagggcaacgagaaccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcagaaccagccugcccagaugcuggcuggugagcaacggcagcuaccugaacgagaccagauucagcgacgacaucgagcagcaggccgacaacaugaucaccgagaugcugcagaaggaguacaucgacagacagggcaagaccccccugggccugguggaccuguucguguucagcaccagcuucuaccugaucagcaucuuccugcaccugaucaagauccccacccacagacacaucgugggcggccccugccccaagccccacagacugaaccacaagggcaucugcagcugcggccuguacaagagacccggcgugagcgugagauggaagagauga

SEQ ID NO: 1879 - RNA, 1476 nt, Artificial Sequence
  derived and/or modified CDS sequence (opt4) from Lassa virus__AAO59512__GPC
augggccagaucgugaccuucuuccaggaggugccccacgugaucgaggaggugaugaacaucgugcugaucgcccugagcauccuggccgugcugaagggccuguacaacuucgccaccugcggccuggugggccugguggccuuccugcugcugugcggcagaagcugcaccagcagccuguacaagggcguguacgagcugcagacccuggagcugaacauggagacccugaacaugaccaugccccugagcugcaccaagaacaacagccaccacuacaucagagugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccguggacgccgccaagcacugcggcaccguggccaacggcgugcugcagaccuucaugagaauggccuggggcggcagcuacaucgcccuggacagcggccacggcagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaagaccgaggcccagaugagcauccagcugaucaacaaggccgugaacgcccugaucaacgaccagcugaucaugaagaaccaccugagagacaucaugggcauccccuacugcaacuacagcagauacugguaccugaaccacaccaccaccggcaagaccagccugcccaagugcuggcuggugagcaacggcagcuaccugaacgagaccagauucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1880 - RNA, 1476 nt, Artificial Sequence
  derived and/or modified CDS sequence (opt4) from Lassa virus__AAT49000__GPC
augggccagaucgugaccuucuuccaggaggugccccacgugaucgaggaggugaugaacaucgugcugaucgcccugagcauccuggccgugcugaagggccuguacaacguggccaccugcggccugaucggccuggugaccuuccuguuccugugcggcagaagcugcagcaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacacccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggcagaggcaacugggacugcaucaugaccagcuaccaguaccuggugauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccaagugcuggcuggugagcaacggcagcuaccugaacgagacccacuucagcgacgacaucgagcagcaggccgacaaccugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggcguguacaagcagcccggcgugcccgugagauggaagagauga

SEQ ID NO: 1881 - RNA, 1476 nt, Artificial Sequence
  derived and/or modified CDS sequence (opt4) from Lassa virus__AAT49004__GPC
augggccagaucgugaccuucuuccaggaggugccccacgugaucgaggaggugaugaacaucgugcugaucgcccugagcgugcuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcagaaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1882 - RNA, 1476 nt, Artificial Sequence
  derived and/or modified CDS sequence (opt4) from Lassa virus__AAT49008__GPC
augggccagaucgugaccuucuuccaggaggugccccacgugaucgaggaggugaugaacaucgugcugaucgcccugagcauccuggccgugcugaagggccuguacaacguggccaccugcggccugaucggccuggugaccuuccuguuccugugcggcagaagcugcagcaccacccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacacccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcagauacugguaccugaaccacaccgugaccggcaagaccagccugcccaagugcuggcuggugagcaacggcagcuaccugaacgagacccacuucagcgacgacaucgagcagcaggccgacaaccugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggcguguacaagcagcccggcgugcccgugagauggaagagauga

SEQ ID NO: 1883 - RNA, 1473 nt, Artificial Sequence
  derived and/or modified CDS sequence (opt4) from Lassa virus__AAT49010__GPC
augggccagaucgugaccuucuuccaggaggugccccacgugaucgaggaggugaugaacaucgugcugaucgcccugagcgugcuggccauccugaagggccuguacaacuucgccaccugcggccugaucggccuggugaccuuccugcugcugagcggcagaagcugcagcaugaucuacaagggcguguacgagcugcagacccuggagcugaacauggagacccugaacaugaccaugccccugagcugcaccaagaacaccagccaccacuacaucagagugggcaacgacaccggccuggagcugacccugaccaacgagacccugcugcaccacaaguucugcaaccugagcgacgcccacaagagaaaccuguacgaccacgcccugaugagcaucaucagcaccuuccaccugagcauccccaacuucaaccaguacgaggccaugagcugcgacuucaacggcggcaagaucaccgugcaguacaaccugagccacagcuacgccguggacgccgccaagcacugcggcaccguggccaacggcgugcugcagaccuucaugagaauggccuggggcggcagcuacaucgcccuggacagcagacacggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccagcaccggcaagaccagccugcccagaugcuggcuggugagcaacggcagcuaccugaacgagacccacuucagcgacgacaucgagcagcaggccgacaacaugaucaccgagaugcugcagaaggaguaccuggacagacagggcaagaccccccugggccugguggaccuguucguguucagcaccagcuucuaccugaucagcaucuuccugcaccugaucaagauccccacccacagacacaucgugggcaagcccugccccaagccccacagacugaaccacaugggcaucugcagcugcggccuguacaagcagcccggcgugcccgugagauggaagagauga

SEQ ID NO: 1884 - RNA, 1473 nt, Artificial Sequence
  derived and/or modified CDS sequence (opt4) from Lassa virus__AAT49014__GPC
augggccagaucaucaccuucuuccaggaggugccccacgugaucgaggaggugaugaacaucgugcugaucgcccugagccugcuggccauccugaagggccuguacaacaucgccaccugcggcaucaucggccugguggccuuccuguuccugugcggcaagagcugcagccugacccugaagggcggcuacgagcugcagacccuggagcugaacauggagacccugaacaugaccaugccccugagcugcaccaagaacagcagccaccacuacaucagagugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccgagcacugcggcaccguggccaacggcgugcugcagaccuucaugagaauggccuggggcggcagauacaucgcccuggacagcggcaagggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccagcagcggcagaaccagccugcccaagugcuggcugaucagcaacggcagcuaccugaacgagacccaguucagcgacgacaucgagcagcaggccgaccacaugaucaccgagaugcugcagaaggaguacaucgagagacagggcaagaccccccugggccugguggacaucuucaucuucagcaccagcuucuaccugaucagcaucuuccugcaccugaucaagauccccacccacagacacaucgugggcaagcccugccccaagccccacagacugaaccacaugggcgugugcagcugcggccuguacaagcaccccggcgugcccaccaaguggaagagauga

SEQ ID NO: 1885 - RNA, 1476 nt, Artificial Sequence
  derived and/or modified CDS sequence (opt4) from Lassa virus__AAV54104__GPC
augggccagaucgugaccuucuuccaggaggugccccacgugaucgaggaggugaugaacaucgugcugaucgcccugagcgugcuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcgaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcagaaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1886 - RNA, 1476 nt, Artificial Sequence
  derived and/or modified CDS sequence (opt4) from Lassa virus__ADI39451__GPC
augggccagaucgugaccuucuuccaggaggugccccacgugaucgaggaggugaugaacaucgugcugaucgcccugagcgugcuggccgugcugaagggccuguacaacguggccaccugcggccugaucggccugaucgccuuccugcugcugugcggcagaagcugcaccaccacccuguacaagggcguguacgagcugcaggcccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccguggccaacggcgugcugcagaccuucaugagaauggccuggggcggcagcuacaucgcccuggacagcggcagaggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaucaccggcagaaccagccugcccaagugcuggcuggugagcaacggcagcuaccugaacgagacccacuucagcgacgacaucgagcagcaggccgacaacaugaucaccgagaugcugcagaaggaguacaucgagagacagggcaagaccccccugggccugguggaccuguucguguucagcaccagcuucuaccugaucagcaucuuccugcaccugaucaagauccccacccacagacacaucgugaacaagcccugccccaagccccacagacugaaccacaugggcgugugcagcugcggccuguacaagcagcccggcgugcccgugagauggaagagauga

SEQ ID NO: 1887 - RNA, 1473 nt, Artificial Sequence
  derived and/or modified CDS sequence (opt4) from Lassa virus__ADU56610__GPC
augggccagaucgugaccuucuuccaggaggugccccacgugaucgaggaggugaugaacaucgugcugaucgcccugagccugcuggccauccugaagggcaucuacaacguggccaccugcggccuguucggccugaucagcuuccugcugcugugcggcagaagcugcagcaccaccuacaagggcguguacgagcugcagacccuggagcuggacauggccaaccugaacaugaccaugccccugagcugcaccaagaacagcagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccaaccacugcggcaccaucgccaacggcgugcugcagaccuucaugagaauggccuggggcggcagcuacaucgcccuggacagcggcaagggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgaggcccccggcggcuacugccugaccagauggaugcugaucgaggccgagcugaagugcuucggcaacaccgccaucgccaagugcaacgagaagcacgacgaggaguucugcgacaugcugagacuguucgacuucaacaagcaggccaucaagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcugaucagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacaucgugggcagacccugccccaagccccacagacugaaccacaugggcaucugcagcugcggccuguacaagcaccccggcgugcccgugaaguggaagagauga

SEQ ID NO: 1888 - RNA, 1473 nt, Artificial Sequence
  derived and/or modified CDS sequence (opt4) from Lassa virus__ADU56618__GPC
augggccagaucgugaccuucuuccaggaggugccccacgugaucgaggaggugaugaacaucgugcugaucgcccugagcauccuggccauccugaagggccuguacaacaucgccaccugcggccugaucggccuggugaccuuccugcugcugagcggcagaagcugcagcaugaccuacaagggcguguacgagcugcagacccuggagcugaacaugaacacccugaacaugaccaugccccugagcugcaccaagaacaacagccaccacuacaucauggugggcaacgagaccggccuggagcugacccugaccaacaccagccugcugcaccacaaguucugcaaccugagcgacgcccacaagaagaaccuguacgaccacacccugaugagcaucaucagcaccuuccaccugagcauccccaacuucaaccaguacgaggccaugagcugcgacuucaacggcggcaagaucaccgugcaguacaaccugagccacagcuacgccaucgacgccgccaaccacugcggcaccguggccaacggcgugcugcagaccuucaugagaauggccuggggcggcagcuacaucgcccuggacagcggcagaggcaagugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccagcaccggcagaaccagccugcccagaugcuggcuggugagcaacggcagcuaccugaacgagacccacuucagcgacgacaucgagcagcaggccgacaacaugaucaccgagaugcugcagaaggaguaccuggacagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugagauggaagagauga

SEQ ID NO: 1889 - RNA, 1473 nt, Artificial Sequence
  derived and/or modified CDS sequence (opt4) from Lassa virus__ADU56622__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1890 - RNA, 1473 nt, Artificial Sequence
  derived and/or modified CDS sequence (opt4) from Lassa virus__ADU56626__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcugaacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagagaaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaagcacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1891 - RNA, 1473 nt, Artificial Sequence
  derived and/or modified CDS sequence (opt4) from Lassa virus__ADU56630__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugagaauccccacccacagacacgugaucggcaagcccugccccaagccccacagacugaaccacaugggcaucugcagcugcggccuguacaagcaccccggcgugcccgugaaguggaagagauga

SEQ ID NO: 1892 - RNA, 1476 nt, Artificial Sequence
  derived and/or modified CDS sequence (opt4) from Lassa virus__AFY05588__GPC
augggccagaucgugaccuucuuccaggaggugccccacgugaucgaggaggugaugaacaucgugcugaucgcccugagcgugcuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagaccuguacaucagcagaagacugcugggcaccuucaccuggacccugagcgacagcgagggcgaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcagaaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1893 - RNA, 1476 nt, Artificial Sequence
  derived and/or modified CDS sequence (opt4) from Lassa virus__AFY05590__GPC
augggccagaucgugaccuucuuccaggaggugccccacgugaucgaggaggugaugaacaucgugcugaucgcccugagcgugcuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacauguacaucagcagaagacugcugggcaccuucaccuggacccugagcgacagcgagggcgaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcagaaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1894 - RNA, 1476 nt, Artificial Sequence
  derived and/or modified CDS sequence (opt4) from Lassa virus__AHC95553__GPC
augggccagaucgugaccuucuuccaggaggugccccacgugaucgaggaggugaugaacaucgugcugaucgcccugagcauccuggccgugcugaagggccuguacaacaucgccaccugcggccugaucggccuggugaccuucuuccugcugugcggcagaagcugcagcagcaaccuguacaagggcguguacgagcugcagagccuggaccugaacauggagacccugaacaugaccaugccccugagcugcaccaagaacaacagccaccacuacaucagagugggcaacgagaccggccuggagcugacccugaccaacaccagccugcuggaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucaccgugcaguacaaccugagccacagcuacgccggcgacgccgccagacacugcggcaccaucgccaacggcgugcugcagaccuucaugagaauggccuggggcggcagcuacaucgcccuggacagcggccacggcaacugggacugcaucaugaccagcuaccaguaccugaucauccagaacaccaccugggaggaccacugccaguucagcagacccagccccaucggcuaccugagccugcugagccagagaaccagagacaucuacaucagcagaagacugcugggcaccuucaccuggacccugagcgacagcgagggcaacgccacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagcagacugagaagcgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcagaaccagccugcccaagugcuggcuggugagcaacggcagcuaccugaacgagacccacuucagcgacgacaucgagcagcaggccgacaacaugaucaccgagaugcugcagaaggaguacauggacagacagggcaagaccccccugggccugguggaccuguucguguucagcaccagcuucuaccugaucagcaucuuccugcaccuggugaagauccccacccacagacacaucgugggcaagcccugccccaagccccacagacugaacagaaugggcaucugcagcugcggccuguacaagcagcccggcgugcccgugaaguggaagagauga

SEQ ID NO: 1895 - RNA, 1476 nt, Artificial Sequence
  derived and/or modified CDS sequence (opt4) from Lassa virus__AHC95555__GPC
augggccagaucgugaccuucuuccaggaggugccccacgugaucgaggaggugaugaacaucgugcugaucgcccugagcauccuggccgugcugaagggccuguacaacaucgccaccugcggccugaucggccuggugaccuuccugcugcugugcggcagaagcugcagcagcaaccuguacaagggcguguacgagcugcagagccuggaccugaacauggagacccugaacaugaccaugccccugagcugcaccaagaacaacagccaccacuacaucagagccggcaacgagaccggccuggagcugacccugaccaacaccagccugaucaaccacaaguucugcaaccugagcgacgcccacaagaagaaccuguacgaccacacccugaugagcaucaucagcaccuuccaccugagcauccccaacuucaaccaguacgaggccaugagcugcgacuucaacggcggcaagaucagcgugcaguacaaccugagccacgccuacgccaucgacgccgccgagcacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgccacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagcagacugaagagcgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaucaccggcagaaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugccccugaaguggaagagauga

SEQ ID NO: 1896 - RNA, 1476 nt, Artificial Sequence
  derived and/or modified CDS sequence (opt4) from Lassa virus__AHC95557__GPC
augggccagaucgugaccuucuuccaggaggugccccacgugaucgaggaggugaugaacaucgugcugaucgcccugagcauccuggccgugcugaagggccuguacaacaucgccaccugcggccugaucggccuggugaccuucuuccugcugugcggcagaagcugcagcagcaaccuguacaagggcguguacgagcugcagagccuggaccugaacauggagacccugaacaugaccaugccccugagcugcaccaagaacaacagccaccacuacaucagagugggcaacgagaccggccuggagcugacccugaccaacaccagccugcugaaccacaaguucugcaaccugagcgacgcccacaagagaaaccuguacgaccacgcccugaugagcaucaucagcaccuuccaccugagcauccccaacuucaaccaguacgaggccaugagcugcgacuucaacggcggcaagaucaccgugcaguacaaccugagccacagcuacgccggcgacaccgccaagcacugcggcaccaucgccaacggcgugcugcagaccuucaugagaauggccuggggcggcagcuacaucgcccuggacagcggccacggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgccacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagcagacugagaagcgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcagaaccagccugcccaagugcuggcuggugagcaacggcagcuaccugaacgagacccacuucagcgacgacaucgagcagcaggccgacaacaugaucaccgagaugcugcagaaggaguacauggacagacagggcaagaccccccugggccugguggaccuguucguguucagcaccagcuucuaccugaucagcaucuuccugcaccuggugaagauccccacccacagacacaucgugggcaagcccugccccaagccccacagacugaacagaaugggcaucugcagcugcggccuguacaagcagcccggcgugcccgugaaguggaagagauga

SEQ ID NO: 1897 - RNA, 1476 nt, Artificial Sequence
  derived and/or modified CDS sequence (opt4) from Lassa virus__AHC95559__GPC
augggccagaucaucaccuucuuccaggaggugccccacgugaucgaggaggugaugaacaucgugcugaucgcccugagcauccuggccgugcugaagggccuguacaacaucgccaccugcggccugaucggccuggugaccuuccugcugcugugcggcagaagcugcagcagcagccuguacaagggcguguacgagcugcagagccuggaccugaacauggagacccugaacaugaccaugccccugagcugcaccaagaacaacagccaccacuacaucagagugggcaacgagaccggccuggagcugacccugaccaacaccagccugaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccaucgacgccgccagccacugcggcaccguggccaacggcgugcugcagaccuucaugagaauggccuggggcggcagcuacaucgcccuggacagcggccacggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgccacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagcagacugaagagcgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugaaguggaagagauga

SEQ ID NO: 1898 - RNA, 1476 nt, Artificial Sequence
  derived and/or modified CDS sequence (opt4) from Lassa virus__AIT17126__GPC
augggccagaucgugaccuucuuccaggaggugccccacgugaucgaggaggugaugaacaucgugcugaucgcccugagcauccuggccgugcugaagggccuguacaacuucgccaccugcggccuggugggccugcugaccuuccugcugcugugcggcagaagcugcaccaccggccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccgaccacugcggcaccguggccaacggcgugcugcagaccuucaugagaauggccuggggcggcagcuacaucgcccuggacagcggcagaggcagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcuggugaugaagaaccaccugagagacaucaugggcauccccuacugcaacuacagcagauacugguaccugaaccacaccaccaccggcagaaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1899 - RNA, 1476 nt, Artificial Sequence
  derived and/or modified CDS sequence (opt4) from Lassa virus__AIT17130__GPC
augggccagaucgugaccuucuuccaggaggugccccacgugaucgaggaggugaugaacaucgugcugaucgcccugagcauccuggccgugcugaagggccuguacaacuucgccaccugcggcuucgugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucagagugggcaacgacaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccguggacgccgccagccacugcggcaccaucgccaacggcgugcugcagaccuucaugagaauggccuggggcggcagcuacaucgcccuggacagcggcagagacagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1900 - RNA, 1476 nt, Artificial Sequence
  derived and/or modified CDS sequence (opt4) from Lassa virus__AIT17134__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1901 - RNA, 1476 nt, Artificial Sequence
  derived and/or modified CDS sequence (opt4) from Lassa virus__AIT17138__GPC
augggccagaucgugaccuucuuccaggaggugccccacgugaucgaggaggugaugaacaucgugcugaucgcccugagcauccuggccgugcugaagggccuguacaaccuggccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagccugaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccguggacgccgccagccacugcggcaccguggccaacggcgugcugcagaccuucaugagaauggccuggggcggcagcuacaucgcccuggacagcggcagaggcggcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcagaaccagccugcccagaugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1902 - RNA, 1476 nt, Artificial Sequence
  derived and/or modified CDS sequence (opt4) from Lassa virus__AIT17142__GPC
augggccagaucgugaccuucuuccaggaggugccccacgugaucgaggaggugaugaacaucgugcugaucgcccugagcgugcuggccgugcugaagggccuguacaacuucgccaccugcggcaucgugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgacaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccgaccacugcggcaccguggccaacggcgugcugcagaccuucaugagaauggccuggggcggcagcuacaucgcccuggacagcggcagaggcagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugaaguggaagagauga

SEQ ID NO: 1903 - RNA, 1476 nt, Artificial Sequence
  derived and/or modified CDS sequence (opt4) from Lassa virus__AIT17146__GPC
augggccagaucgugaccuucuuccaggaggugccccacgugaucgaggaggugaugaacaucgugcugaucgcccugagcauccuggccgugcugaagggccuguacaaccuggccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcagaugggacugcaucaugaccagcuaccaguaccugaucauccagaacaccaccugggaggaccacugcagcuucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggcuucuacaagcagcccggcgugcccgugaaguggaagagauga

SEQ ID NO: 1904 - RNA, 1476 nt, Artificial Sequence
  derived and/or modified CDS sequence (opt4) from Lassa virus__AIT17154__GPC
augggccagaucgugaccuucuuccaggaggugccccacgugaucgaggaggugaugaacaucgugcugaucgcccugagcauccuggccgugcugaagggccuguacaacuucgccaccugcggcaucgugggccuggugagcuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccaucgccaacggcgugcugcagaccuucaugagaauggccuggggcggcagcuacaucgcccuggacagcggcagagacagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacguggugggcaagagcugccccaagccccacagacugaaccacaugggcaucugcagcugcggccuguacggccagcccggcgugcccgugaaguggaagagauga

SEQ ID NO: 1905 - RNA, 1476 nt, Artificial Sequence
  derived and/or modified CDS sequence (opt4) from Lassa virus__AIT17158__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagagacagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1906 - RNA, 1476 nt, Artificial Sequence
  derived and/or modified CDS sequence (opt4) from Lassa virus__AIT17164__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccagcagccuguacaagggcguguacgagcugcagacccuggagcugaacauggagacccugaacaugaccaugccccugagcugcaccaagaacaacagccaccacuacaucagagugggcaacgagaccggccuggagcugacccugaccaacaccagcaucaucgaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaagcacugcggcaccguggccaacggcgugcugcagaccuucaugagaauggccuggggcggcagcuacaucgcccuggacagcggccacggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgacgcccccggcggcuacugccugaccagauggaugcugauccaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcagaaccagccugcccagaugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguucaagcagcccggcgugcccgugaaguggaagagauga

SEQ ID NO: 1907 - RNA, 1476 nt, Artificial Sequence
  derived and/or modified CDS sequence (opt4) from Lassa virus__AIT17168__GPC
augggccagaucgugaccuucuuccaggaggugccccacgugaucgaggaggugaugaacaucgugcugaucgcccugagcauccuggccgugcugaagggccuguacaacuucgccaccugcggccuggugggccugcugaccuuccugcugcugugcggcagaagcugcaccgccagcagauacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggccacggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1908 - RNA, 1476 nt, Artificial Sequence
  derived and/or modified CDS sequence (opt4) from Lassa virus__AIT17172__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccagaccccacagacugaaccacaugggcaucugcagcugcggccuguacaagcagcccggcgugcccgugaaguggaagagauga

SEQ ID NO: 1909 - RNA, 1476 nt, Artificial Sequence
  derived and/or modified CDS sequence (opt4) from Lassa virus__AIT17176__GPC
augggccagaucgugaccuucuuccaggaggugccccacgugaucgaggaggugaugaacaucgugcugaucgcccugagccugcuggccgugcugaagggccuguacaacguggccaccugcggccugaucggccugaucaccuuccugcugcugugcggcagaagcugcaccaccaaccuguacaagggcguguacgagcugcaggcccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcagaaucagcgugcaguacaaccugagccacagcuacgccggcgacgccgccagccacugcggcaccaucgccaacggcgugcugcagaccuucaugagaauggccuggggcggcagcuacaucgcccuggacagcggccacggcggcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacguggugggcaagcccugccccaagccccacagacugaaccacaugggcaucugcagcugcggccuguacaagcagcccggcgugcccgugagauggaagagauga

SEQ ID NO: 1910 - RNA, 1476 nt, Artificial Sequence
  derived and/or modified CDS sequence (opt4) from Lassa virus__AIT17180__GPC
augggccagaucgugaccuucuuccaggaggugccccacgugaucgaggaggugaugaacaucgugcugaucgcccugagcauccuggccgugcugaagggccuguacaacguggccaccugcggccugaucggccuggugaccuuccugcugcugugcggcagaagcugcaccaccacccuguacaagggcguguacgagcugcagacccuggagcugaacauggagacccugaacaugaccaugccccugagcugcaccaagaacaacagccaccacuacaucagagugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggacgaccacugccaguucagcagacccagccccaucggcuaccugggccugcugagccagagaaccagagacguguacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaacaacaccgccaccggcaagaccagccugcccaagugcuggcugaucagcaacggcagcuaccugaacgagacccacuucagcgacgacaucgagcaggaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugagauggaagagauga

SEQ ID NO: 1911 - RNA, 1476 nt, Artificial Sequence
  derived and/or modified CDS sequence (opt4) from Lassa virus__AIT17184__GPC
augggccagaucgugaccuucuuccaggaggugccccacgugaucgaggaggugaugaacaucgugcugaucgcccugagcauccuggccgugcugaagggccuguacaacguggccaccugcggccugaucggccuggugaccuuccugcugcugugcggcagaagcugcaccaccacccuguacaagggcguguacgagcugcaggcccuggagcugaacauggagacccugaacaugaccaugccccugagcugcaccaagaacaacagccaccacuacaucagagugggcaacgagaccggccuggagcugacccugaccaacaccagcaucaucgaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaaacggcugggacugcaucaugaccagcuaccaguaccugaucauccagaacaccaccugggacgaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaacaacaccgccaccggcaagaccagccugcccagaugcuggcuggugagcaacggcagcuaccugaacgagacccacuucagcgacgacaucgagcagcaggccgacaacaugaucaccgagaugcugcagagagaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugaaguggaagagauga

SEQ ID NO: 1912 - RNA, 1476 nt, Artificial Sequence
  derived and/or modified CDS sequence (opt4) from Lassa virus__AIT17188__GPC
augggccagaucgugaccuucuuccaggaggugccccacgugaucgaggaggugaugaacaucgugcugaucgcccugagcauccuggccgugcugaagggccuguacaacuucgccaccugcggcuucgugggccuggugagcuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggccacggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugagagccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcagaaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacggccagcccggcgugcccgugaaguggaagagauga

SEQ ID NO: 1913 - RNA, 1476 nt, Artificial Sequence
  derived and/or modified CDS sequence (opt4) from Lassa virus__AIT17192__GPC
augggccagaucgugaccuucuuccaggaggugccccacgugaucgaggaggugaugaacaucgugcugaucgcccugagcauccuggccgugcugaagggccuguacaacuucgccaccugcggcuucaucggccuggugagcuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguucgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggccacggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcagaaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacggccagcccggcgugcccgugaaguggaagagauga

SEQ ID NO: 1914 - RNA, 1476 nt, Artificial Sequence
  derived and/or modified CDS sequence (opt4) from Lassa virus__AIT17196__GPC
augggccagaucgugaccuucuuccaggaggugccccacgugaucgaggaggugaugaacaucgugcugaucgcccugagcauccuggccgugcugaagggccuguacaaccuggccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugaacauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccagaugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggcuucuacaagcagcccggcgugcccgugaaguggaagagauga

SEQ ID NO: 1915 - RNA, 1476 nt, Artificial Sequence
  derived and/or modified CDS sequence (opt4) from Lassa virus__AIT17204__GPC
augggccagaucgugaccuucuuccaggaggugccccacgugaucgaggaggugaugaacaucgugcugaucgcccugagcauccuggccgugcugaagggccuguacaaccuggccaccugcggccuggugggccuggugaccuuccugcugcugugcggcagaagcugcaccagcagccuguacaagggcguguacgagcugcagacccuggagcugaacauggagacccugaacaugaccaugccccugagcugcaccaagaacagcagccaccacuacaucagagugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggccacgacagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaucaccggcaagaccagccugcccaagugcuggcuggugagcaacggcagcuaccugaacaagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccugaucaagauccccacccacagacacaucgugggcaagcccugccccaagccccacagacugaaccacaugggcaucugcagcugcggccuguacaagcagcccggcgugcccgugaaguggaagagauga

SEQ ID NO: 1916 - RNA, 1476 nt, Artificial Sequence
  derived and/or modified CDS sequence (opt4) from Lassa virus__AIT17208__GPC
augggccagaucgugaccuucuuccaggaggugccccacgugaucgaggaggugaugaacaucgugcugaucgcccugagcauccuggccgugcugaagggccuguacaacuucgccaccugcggccugaucggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggccagugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1917 - RNA, 1476 nt, Artificial Sequence
  derived and/or modified CDS sequence (opt4) from Lassa virus__AIT17210__GPC
augggccagaucgugaccuucuuccaggaggugccccacgugaucgaggaggugaugaacaucgugcugaucgcccugagcauccuggccgugcugaagggccuguacaaccuggccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagagacagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugagacuggugaagauccccacccacagacacaucgugggcaagcccugccccaagccccacagacugaaccacaugggcaucugcagcugcggccuguacaagcagcccggcgugcccgugaaguggaagagauga

SEQ ID NO: 1918 - RNA, 1476 nt, Artificial Sequence
  derived and/or modified CDS sequence (opt4) from Lassa virus__AIT17212__GPC
augggccagaucgugaccuucuuccaggaggugccccacgugaucgaggaggugaugaacaucgugcugaucgcccugagcauccuggccgugcugaagggccuguacaaccuggccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacagaaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcaagugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccagaugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugaaguggaagagauga

SEQ ID NO: 1919 - RNA, 1476 nt, Artificial Sequence
  derived and/or modified CDS sequence (opt4) from Lassa virus__AIT17216__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggccacggcagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaacuacaugggcaucugcagcugcggccuguacaagcagcccggcgugcccgugagauggaagagauga

SEQ ID NO: 1920 - RNA, 1476 nt, Artificial Sequence
  derived and/or modified CDS sequence (opt4) from Lassa virus__AIT17224__GPC
augggccagaucgugaccuucuuccaggaggugccccacgugaucgaggaggugaugaacaucgugcugaucgcccugagcauccuggccgugcugaagggccuguacaacguggccaccugcggccugaucggccuggugaccuuccugcugcugugcggcagaagcugcaccaccacccuguacaagggcguguacgagcugcaggcccuggagcugaacauggagacccugaacaugaccaugccccugagcugcaccaagaacaacagccaccacuacaucagagugggcaacgacaccggccuggagcugacccugaccaacaccagcaucauccagcacaaguucugcaaccugagcgacgcccacaagaagaaccuguacgaccacacccugaugagcaucaucagcaccuuccaccugagcauccccaacuucaaccaguacgaggccaugagcugcgacuucaacggcggcaagaucagcgugcaguacaaccugagccacagcuacgccggcgacgccgccagccacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcagagacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaacaacaccaucaccggcaagagcagccugcccaagugcuggcuggugagcaacggcagcuaccugaacgagacccacuucagcgacgacaucgagcaggaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcgugugcagcugcggccuguacaagcagcccggcgugcccgugagauggaagagauga

SEQ ID NO: 1921 - RNA, 1476 nt, Artificial Sequence
  derived and/or modified CDS sequence (opt4) from Lassa virus__AIT17228__GPC
augggccagaucgugaccuucuuccaggaggugccccacgugaucgaggaggugaugaacaucgugcugaucgcccugagcauccuggccgugcugaagggccuguacaacuucgccaccugcggccuggugggccugcugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucgaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcggcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1922 - RNA, 1476 nt, Artificial Sequence
  derived and/or modified CDS sequence (opt4) from Lassa virus__AIT17232__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucagagugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacgagggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcaagugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucgagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1923 - RNA, 1476 nt, Artificial Sequence
  derived and/or modified CDS sequence (opt4) from Lassa virus__AIT17236__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcagaaucagcgugcaguacaaccugagccacagcuacgccggcgaggccgccaaccacugcggcaccguggccaacggcgugcugcagaccuucaugagaauggccuggggcggcagcuacaucgcccuggacagcggcagaggcaagugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcagauacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1924 - RNA, 1476 nt, Artificial Sequence
  derived and/or modified CDS sequence (opt4) from Lassa virus__AIT17240__GPC
augggccagaucgugaccuucuuccaggaggugccccacgugaucgaggaggugaugaacaucgugcugaucgcccugagcauccuggccgugcugaagggccuguacaaccuggccaccugcggccuggugggccuggugaccuuccugcugcugugcggcagaagcugcaccaccagccuguacaagggcuucuacgagcugcagacccuggagcugaacauggagacccugaacaugaccaugccccugagcugcaccaagaacaacagccaccacuacaucagagugggcaacgagaccggccuggagcugacccugaccaacaccagcaucaucgaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcagaugggacugcaucaugaccagcuaccaguaccugaucauccagaacaccaccugggaggaccacugccaguucagcagacccagccccaucggcuaccugggccugcugagccagaagaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1925 - RNA, 1476 nt, Artificial Sequence
  derived and/or modified CDS sequence (opt4) from Lassa virus__AIT17244__GPC
augggccagaucgugaccuucuuccaggaggugccccacgugaucgaggaggugaugaacaucgugcugaucgcccugagcauccuggccgugcugaagggccuguacaaccuggccaccugcggccuggugggccuggugaccuuccugcugcugugcggcagaagcugcaccaccaaccuguacaagggcguguacgagcugcagacccuggagcugaacauggagacccugaacaugaccaugccccugagcugcaccaagaacagcagccaccacuacaucagagugggcaacgagaccggccuggagcugacccugaccaacaccagcaucaucgaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgugggcgacgccgccgaccacugcggcaccguggccaacggcgugcugcagaccuucaugagaauggccuggggcggcagcuacaucgcccuggacagcggcagaggcaagugggacugcaucaucaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaucaccggcaagaccagccugcccagaugcuggcuggugagcaacggcagcuaccugaacgagaccagauucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugaaguggaagagauga

SEQ ID NO: 1926 - RNA, 1476 nt, Artificial Sequence
  derived and/or modified CDS sequence (opt4) from Lassa virus__AIT17246__GPC
augggccagaucgugaccuucuuccaggaggugccccacgugaucgaggaggugaugaacaucgugcugaucgcccugagccugcuggccgugcugaagggccuguacaacguggccaccugcggccugaucggccugaucaccuuccugcugcugugcggcagaagcugcaccaccaaccuguacaagggcguguacgagcugcagacccuggagcugaacauggagacccugaacaugaccaugccccugagcugcaccaagaacagcagccaccacuacaucauggugggcaacgagaccggccuggagcugacccugaccaacaccagcaucaucaaccacaaguucugcaaccugagcgacgcccacaagaagaaccuguacgaccacacccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcauccugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugagauggaagagauga

SEQ ID NO: 1927 - RNA, 1476 nt, Artificial Sequence
  derived and/or modified CDS sequence (opt4) from Lassa virus__AIT17250__GPC
augggccagaucgugaccuucuuccaggaggugccccacgugaucgaggaggugaugaacaucgugcugaucgcccugagccugcuggccgugcugaagggccuguacaacguggccaccugcggccugaucggccuggugaccuuccugcugcugugcggcagaagcugcaccaccaaccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacacccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugagauggaagagauga

SEQ ID NO: 1928 - RNA, 1476 nt, Artificial Sequence
  derived and/or modified CDS sequence (opt4) from Lassa virus__AIT17254__GPC
augggccagaucgugaccuucuuccaggaggugccccacgugaucgaggaggugaugaacaucgugcugaucgcccugagcauccuggccgugcugaagggccuguacaacuucgccaccugcggcaucgugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagagacagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaagaacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcaucagccugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccagaugcuggcuggugagcaacggcagcuaccugaacgagacccacuucagcgacgacaucgagcagcaggccgacaacaugaucaccgagaugcugcagaaggaguacauggacagacagggcaagaccccccugggccugguggaccuguucguguucagcaccagcuucuaccugaucagcaucuuccugcaccuggugaagauccccacccacagacacaucgugggcaagaccugccccaagccccacagacugaaccacaugggcaucugcagcugcggccuguacaagcagcccggcgugcccgugaaguggaagagauga

SEQ ID NO: 1929 - RNA, 1476 nt, Artificial Sequence
  derived and/or modified CDS sequence (opt4) from Lassa virus__AIT17258__GPC
augggccagaucgugaccuucuuccaggaggugccccacgugaucgaggaggugaugaacaucgugcugaucgcccugagcauccuggccgugcugaagggccuguacaacaucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucgugagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggcagaggcggcugggacugcaucaugaccagcuaccaguaccugaucauccagaacgugaccugggaggaccacugccaguucagcagacccagccccaucggcuaccugggccugcugagccagagaaccagagacguguacaucagcagaagacugcugggcaccuucaccuggacccugagcgacagcgagggcaacgacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugaaguggaagagauga

SEQ ID NO: 1930 - RNA, 1476 nt, Artificial Sequence
  derived and/or modified CDS sequence (opt4) from Lassa virus__AIT17262__GPC
augggccagaucgugaccuucuuccaggaggugccccacgugaucgaggaggugaugaacaucgugcugaucgcccugagcauccuggccgugcugaagggccuguacaaccuggccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccacccacugcggcaccguggccaacggcgugcugcagaccuucaugagaauggccuggggcggcagcuacaucgcccuggacagcggcagaggcaagugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccagaugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugaaguggaagagauga

SEQ ID NO: 1931 - RNA, 1476 nt, Artificial Sequence
  derived and/or modified CDS sequence (opt4) from Lassa virus__AIT17266__GPC
augggccagaucgugaccuucuuccaggaggugccccacgugaucgaggaggugaugaacaucgugcugaucgcccugagcauccuggccgugcugaagggccuguacaaccuggccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagccugaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggcagaggcggcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcagaaccagccugcccagaugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1932 - RNA, 1476 nt, Artificial Sequence
  derived and/or modified CDS sequence (opt4) from Lassa virus__AIT17270__GPC
augggccagaucgugaccuucuuccaggaggugccccacgugaucgaggaggugaugaacaucgugcugaucgcccugagcgugcuggccgugcugaagggccuguacaacuucgccaccugcggccuggugggccuggugaccuuccugcugcugugcggcagaagcugcagcaccagcguguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggccacggcggcugggacugcaucaugaccaacuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcagaaccagccugcccaagugcuggcuggugagcaacggcagcuaccugaacgagacccacuucagcgacgacaucgagcagcaggccgacaacaugaucaccgagaugcugcagagagaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1933 - RNA, 1476 nt, Artificial Sequence
  derived and/or modified CDS sequence (opt4) from Lassa virus__AIT17274__GPC
augggccagaucgugaccuucuuccaggaggugccccacgugaucgaggaggugaugaacaucgugcugaucgcccugagcauccuggccgugcugaagggccuguacaacguggccaccugcggccugaccggccugguggccuuccugcugcugugcggcagaagcugcaccaccacccuguacaagggcguguacgagcugcaggcccuggagcugaacauggagacccugaacaugaccaugccccugagcugcaccaagaacaacagccaccacuacaucagagugggcaacgagaccggccuggagcugacccugaccaacaccagcaucaucgagcacagauucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggcagaaacggcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaacaacaccgccaccggcaagaccagccugcccagaugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgcccccgugagauggaagagauga

SEQ ID NO: 1934 - RNA, 1476 nt, Artificial Sequence
  derived and/or modified CDS sequence (opt4) from Lassa virus__AIT17276__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggccacggcaagugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugagauggaagagauga

SEQ ID NO: 1935 - RNA, 1473 nt, Artificial Sequence
  derived and/or modified CDS sequence (opt4) from Lassa virus__AIT17280__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucagagugggcaacgagaccggccuggagcugacccugaccaacaccagcaucaucgaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggccacgagugggacugcaucaugaccagcuaccaguaccugaucauccagaacaccaccugggacaaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaagguggaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggcuucuacaagcagcccggcgugcccgugaaguggaagagauga

SEQ ID NO: 1936 - RNA, 1476 nt, Artificial Sequence
  derived and/or modified CDS sequence (opt4) from Lassa virus__AIT17288__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcggcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugagauggaagagauga

SEQ ID NO: 1937 - RNA, 1476 nt, Artificial Sequence
  derived and/or modified CDS sequence (opt4) from Lassa virus__AIT17292__GPC
augggccagaucgugaccuucuuccaggaggugccccacgugaucgaggaggugaugaacaucgugcugaucgcccugagcaucauggccgugcugaagggccuguacaacaucgccaccugcggccuggugggccuggugaccuuccugcugcugugcggcagaagcugcaccaccacccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggccacggcggcugggacugcaucaugaccagcuaccaguaccugaucauccagaacaccaccugggaggaccacugccaguucaccagacccagccccaucggcuaccugggccugcugagccagagaaccagagacaucuacaucagcagaagacugcugggcaccuucaccuggacccugagcgacagcgagggcaacgacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugagagccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcagaaccagccugcccagaugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccugaucaagauccccacccacagacacaucgugggcaagcccugccccaagccccacagacugaaccacaugggcgugugcagcugcggccuguacaagcagcccggcgugcccgugagauggaagagauga

SEQ ID NO: 1938 - RNA, 1476 nt, Artificial Sequence
  derived and/or modified CDS sequence (opt4) from Lassa virus__AIT17294__GPC
augggccagaucgugaccuucuuccaggaggugccccacgugaucgaggaggugaugaacaucgugcugaucgcccugagcauccuggccgugcugaagggccuguacaaccuggccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucgaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcggcugggacugcaucaugaccagcuaccaguaccugaucauccagaacaccaccugggaggaccacugccaguucagcagacccagccccgugggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccagaugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugaaguggaagagauga

SEQ ID NO: 1939 - RNA, 1476 nt, Artificial Sequence
  derived and/or modified CDS sequence (opt4) from Lassa virus__AIT17298__GPC
augggccagaucgugaccuucuuccaggaggugccccacgugaucgaggaggugaugaacaucgugcugaucgcccugagcauccuggccgugcugaagggccuguacaacaucgccaccugcggccugcugggccuggugugcuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccguggacgccgccagccacugcggcaccaucgccaacggcgugcugcagaccuucaugagaauggccuggggcggcagcuacaucgcccuggacagcggccacggcggcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacguggugggcaagcccugccccaagccccacagacugaaccacaugggcaucugcagcugcggccuguacggccagcccggcgugcccgugaaguggaagagauga

SEQ ID NO: 1940 - RNA, 1476 nt, Artificial Sequence
  derived and/or modified CDS sequence (opt4) from Lassa virus__AIT17302__GPC
augggccagaucgugaccuucuuccaggaggugccccacgugaucgaggaggugaugaacaucgugcugaucgcccugagccugcuggccgugcugaagggccuguacaacguggccaccugcggccugaucggccuggugaccuuccugcugcugugcggcagaagcugcaccaccaaccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucagccacaaguucugcaaccugagcgacgcccacaagaagaaccuguacgaccacacccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugagauggaagagauga

SEQ ID NO: 1941 - RNA, 1476 nt, Artificial Sequence
  derived and/or modified CDS sequence (opt4) from Lassa virus__AIT17310__GPC
augggccagaucgugaccuucuuccaggaggugccccacgugaucgaggaggugaugaacaucgugcugaucgcccugagcauccuggccgugcugaagggccuguacaaccuggccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccacccacugcggcaccguggccaacggcgugcugcagaccuucaugagaauggccuggggcggcagcuacaucgcccuggacagcggcagaggcaagugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccagaugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaacuacaugggcaucugcagcugcggccuguacaagcagcccggcgugcccgugaaguggaagagauga

SEQ ID NO: 1942 - RNA, 1476 nt, Artificial Sequence
  derived and/or modified CDS sequence (opt4) from Lassa virus__AIT17314__GPC
augggccagaucgugaccuucuuccaggaggugccccacgugaucgaggaggugaugaacaucgugcugaucacccugagcauccuggccgugcugaagggccuguacaacguggccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaaggaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggcagaggcggcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugaaguggaagagauga

SEQ ID NO: 1943 - RNA, 1476 nt, Artificial Sequence
  derived and/or modified CDS sequence (opt4) from Lassa virus__AIT17318__GPC
augggccagaucgugaccuucuuccaggaggugccccacgugaucgaggaggugaugaacaucgugcugaucgcccugagccugcuggccgugcugaagggccuguacaacguggccaccugcggccugaucggccuggugaccuuccugcugcugugcggcagaagcugcaccaccaaccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggcagaggcaacugggacugcaucaugaccagcuaccaguaccugaucauccagaacaucaccugggaggaccacugccaguucagcagacccagccccaucggcuaccugggccugcugagccagagaaccagagacaucuacaucagcagaagacugcugggcaccuucaccuggacccugagcgacagcgagggcaacgacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugagauggaagagauga

SEQ ID NO: 1944 - RNA, 1476 nt, Artificial Sequence
  derived and/or modified CDS sequence (opt4) from Lassa virus__AIT17322__GPC
augggccagaucgugaccuucuuccaggaggugccccacgugaucgaggaggugaugaacaucgugcugaucgcccugagccugcuggccgugcugaagggccuguacaacguggccaccugcggccugaucggccuggugaccuuccugcugcugugcggcagaagcugcaccaccaaccuguacaagggcgccuacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacacccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugagauggaagagauga

SEQ ID NO: 1945 - RNA, 1476 nt, Artificial Sequence
  derived and/or modified CDS sequence (opt4) from Lassa virus__AIT17328__GPC
augggccagaucgugaccuucuuccaggaggugccccacgugaucgaggaggugaugaacaucgugcugaucacccugagcauccuggccgugcugaagggccuguacaacaucgccaccugcggccuggugggccuggugaccuuccugcugcugugcggcaagagcugcaccaccagccuguacaagggcguguacgagcugcagacccuggagcugaacauggagacccugaacaugaccaugccccugagcugcaccaagaacaacagccaccacuacaucagagugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggccacggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgacgcccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacguggugggcaagagcugccccaagccccacagacugaaccacaugggcaucugcagcugcggccuguacaagcagcccggcgugcccgugaaguggaagagauga

SEQ ID NO: 1946 - RNA, 1476 nt, Artificial Sequence
  derived and/or modified CDS sequence (opt4) from Lassa virus__AIT17332__GPC
augggccagaucgugaccuucuuccaggaggugccccacgugaucgaggaggugaugaacaucgugcugaucgcccugagcauccuggccgugcugaagggccuguacaaccuggccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucagagugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggccacggcagaugggacugcaucaugaccagcuaccaguaccugaucauccagaacaccaccugggaggaccacugccuguucagcagacccagccccaucggcuaccugggccugcugagccagagaaccagagacaucuacaucagcagaagacugcugggcaccuucaccuggacccugagcgacagcgagggcagagacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcagaaccagccugcccagaugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1947 - RNA, 1476 nt, Artificial Sequence
  derived and/or modified CDS sequence (opt4) from Lassa virus__AIT17340__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaucagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcgagugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccagaccccacagacugaaccacaugggcaucugcagcugcggccuguacaagcagcccggcgugcccgugaaguggaagagauga

SEQ ID NO: 1948 - RNA, 1476 nt, Artificial Sequence
  derived and/or modified CDS sequence (opt4) from Lassa virus__AIT17344__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacaaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccagccacugcggcaccguggccaacggcgugcugcagaccuucaugagaauggccuggggcggcagcuacaucgcccuggacagcggcuacggcaagugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugagauggaagagauga

SEQ ID NO: 1949 - RNA, 1476 nt, Artificial Sequence
  derived and/or modified CDS sequence (opt4) from Lassa virus__AIT17348__GPC
augggccagaucgugaccuucuuccaggaggugccccacgugaucgaggaggugaugaacaucgugcugaucgcccugagcauccuggccgugcugaagggccuguacaacaucgccaccugcggccugaucggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugaaguggaagagauga

SEQ ID NO: 1950 - RNA, 1476 nt, Artificial Sequence
  derived and/or modified CDS sequence (opt4) from Lassa virus__AIT17350__GPC
augggccagaucgugaccuucuuccaggaggugccccacgugaucgaggaggugaugaacaucgugcugaucgcccugagcauccuggccgugcugaagggccuguacaacguggccaccugcggccugaucggccuggugaccuuccugcugcugugcggcagaagcugcaccaccacccuguacaagggcguguacgagcugcaggcccuggagcugaacauggagacccugaacaugaccaugccccugagcugcaccaagaacaacagccaccacuacaucauggugggcaacgagaccggccuggagcugacccugaccaacaccagcaucaucgaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaagcacugcggcaccguggccaacggcgugcugcagaccuucaugagaauggccuggggcggcagcuacaucgcccuggacagcggcagaaacggcugggacugcgugaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagaugcugcagaaggaguacaucgagagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcaucugcagcugcggccuguacaagcagcccggcgugcccgugagauggaagagauga

SEQ ID NO: 1951 - RNA, 1476 nt, Artificial Sequence
  derived and/or modified CDS sequence (opt4) from Lassa virus__AIT17354__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaucagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggccacggcggcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccagaccccacagacugaaccacaugggcaucugcagcugcggccuguacaagcagcccggcgugcccgugaaguggaagagauga

SEQ ID NO: 1952 - RNA, 1476 nt, Artificial Sequence
  derived and/or modified CDS sequence (opt4) from Lassa virus__AIT17360__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucagagugggcaacgagaccggccuggagcugacccugaccaacaccagcaucaucaaccacagauucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggccacggcaagugggacugcaucaugaccagcuaccaguaccugaucauccagaacaccaccugggacgaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccagaugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggcuucuacaagcagcccggcgugcccgugaaguggaagagauga

SEQ ID NO: 1953 - RNA, 1476 nt, Artificial Sequence
  derived and/or modified CDS sequence (opt4) from Lassa virus__AIT17364__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagagacagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacaucgagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugagcgugaaguggaagagauga

SEQ ID NO: 1954 - RNA, 1476 nt, Artificial Sequence
  derived and/or modified CDS sequence (opt4) from Lassa virus__AIT17368__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguucgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggccacagcaagugggacugcaucaugaccagcuaccaguaccugaucauccagaacaccaccugggacgaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaacuacaugggcaucugcagcugcggcuucuacaagcagcccggcgugcccgugaaguggaagagauga

SEQ ID NO: 1955 - RNA, 1476 nt, Artificial Sequence
  derived and/or modified CDS sequence (opt4) from Lassa virus__AIT17370__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagagacagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugagcgugaaguggaagagauga

SEQ ID NO: 1956 - RNA, 1476 nt, Artificial Sequence
  derived and/or modified CDS sequence (opt4) from Lassa virus__AIT17378__GPC
augggccagaucgugaccuucuuccaggaggugccccacgugaucgaggaggugaugaacaucgugcugaucgcccugagcauccuggccgugcugaagggccuguacaaccuggccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacacccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggcagaagcggcugggacugcaucaugaccagcuaccaguaccuggugauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaagaacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcagaaccagccugcccagaugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggcuucuacaagcagcccggcgugcccgugaaguggaagagauga

SEQ ID NO: 1957 - RNA, 1476 nt, Artificial Sequence
  derived and/or modified CDS sequence (opt4) from Lassa virus__AIT17388__GPC
augggccagaucgugaccuucuuccaggaggugccccacgugaucgaggaggugaugaacaucgugcugaucgcccugagcauccuggccgugcugaagggccuguacaacguggccaccugcggccugaucggccuggugaccuuccugcugcugugcggcagaagcugcaccaccacccuguacaagggcguguacgagcugcaggcccuggagcugaacauggagacccugaacaugaccaugccccugagcugcaccaagaacaacagccaccacuacaucagagugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaucaucagcgugcaguacaaccugagccacagcuacgccggcgacgccgccaaccacugcggcaccguggccaacggcgugcugcagaccuucaugagaauggccuggggcggcagcuacaucgcccuggacagcggcagaaacggcugggacugcaucaugaccagcuaccaguaccugaucauccagaacaccaccugggacgaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaagaccgaggcccagaugaacauccagcugaucaacaaggccgugaacgcccugaucaacgaccagcugaucaugaagaaccaccugagagacaucaugggcauccccuacugcaacuacagcaaguacugguaccugaacaacaccgccaccggcaagaccagccugcccagaugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaucggcaucugcagcugcggccuguacaagcagcccggcgugcccgugaaguggaagagauga

SEQ ID NO: 1958 - RNA, 1473 nt, Artificial Sequence
  derived and/or modified CDS sequence (opt4) from Lassa virus__AIT17404__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccugaucaagauccccacccacagacacaucaccggcaagcccugccccaagccccacagacugaaccacaugggcaucugcagcugcggccuguacaagcaccccggcgugcccgugaaguggaagagauga

SEQ ID NO: 1959 - RNA, 1473 nt, Artificial Sequence
  derived and/or modified CDS sequence (opt4) from Lassa virus__AIT17408__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccguggccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1960 - RNA, 1473 nt, Artificial Sequence
  derived and/or modified CDS sequence (opt4) from Lassa virus__AIT17412__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccagcugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1961 - RNA, 1473 nt, Artificial Sequence
  derived and/or modified CDS sequence (opt4) from Lassa virus__AIT17416__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacagaaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccagcugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1962 - RNA, 1473 nt, Artificial Sequence
  derived and/or modified CDS sequence (opt4) from Lassa virus__AIT17420__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccugaucaagauccccacccacagacacaucaccggcaagcccugccccaagccccacagacugaaccacaugggcaucugcagcugcggccuguacaagcaccccggcgugcccgugaaguggaagagauga

SEQ ID NO: 1963 - RNA, 1473 nt, Artificial Sequence
  derived and/or modified CDS sequence (opt4) from Lassa virus__AIT17424__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacaugaccaaccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacaaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaccaacauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcaucugcagcugcggccuguacaagcaccccggcgugcccgugaaguggaagagauga

SEQ ID NO: 1964 - RNA, 1473 nt, Artificial Sequence
  derived and/or modified CDS sequence (opt4) from Lassa virus__AIT17428__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgccgccgaccugaagugcuucggcaacaccgccguggccaagugcaacgagaagcacgacgaggaguucugcgacaugcugagacuguucgacuucaacaagcaggccaucgagagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcagaaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugagaauccccacccacagacacgugaucggcaagcccugccccaagccccacagacugaaccacaugggcaucugcagcugcggccuguacaagcaccccggcgugcccgugaaguggaagagauga

SEQ ID NO: 1965 - RNA, 1473 nt, Artificial Sequence
  derived and/or modified CDS sequence (opt4) from Lassa virus__AIT17430__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcagaaucagcgugcaguacaaccugagccacaccuacgccguggacgccgccaagcacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1966 - RNA, 1473 nt, Artificial Sequence
  derived and/or modified CDS sequence (opt4) from Lassa virus__AIT17438__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccaaccugaacaugaccaugccccugagcugcaccaagaacaacagccaccacuacaucagagugggcaacgagaccggccuggagcugacccugaccaacaccagcaucaucagccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugaacauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccagaugggcaucugcagcugcggccuguacaagcagcccggcgugcccgugaaguggaagagauga

SEQ ID NO: 1967 - RNA, 1473 nt, Artificial Sequence
  derived and/or modified CDS sequence (opt4) from Lassa virus__AIT17442__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacagaaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccagcugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagaaucaaccacaugggcaucugcagcugcggccuguacaagcaccccggcgugcccgugaaguggaagagauga

SEQ ID NO: 1968 - RNA, 1473 nt, Artificial Sequence
  derived and/or modified CDS sequence (opt4) from Lassa virus__AIT17446__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccagccacugcggcaccguggccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1969 - RNA, 1473 nt, Artificial Sequence
  derived and/or modified CDS sequence (opt4) from Lassa virus__AIT17450__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcaucugcagcugcggccuguacaagcaccccggcgugcccgugaaguggaagagauga

SEQ ID NO: 1970 - RNA, 1473 nt, Artificial Sequence
  derived and/or modified CDS sequence (opt4) from Lassa virus__AIT17454__GPC
augggccagaucaucaccuucuuccaggaggugccccacgugaucgaggaggugaugaacaucgugcugaucgccuucagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagagaaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccggccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaucaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcaucugcagcugcggccuguacaagcaccccggcgugcccgugagauggaagagauga

SEQ ID NO: 1971 - RNA, 1473 nt, Artificial Sequence
  derived and/or modified CDS sequence (opt4) from Lassa virus__AIT17458__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccaucgacgccgccaaccacugcggcaccaucgccaacggcgugcugcagaccuucaugagaauggccuggggcggcagcuacaucgcccuggacagcggcaagggcagcugggacugcaucaugaccaccuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1972 - RNA, 1473 nt, Artificial Sequence
  derived and/or modified CDS sequence (opt4) from Lassa virus__AIT17462__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccaagugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1973 - RNA, 1473 nt, Artificial Sequence
  derived and/or modified CDS sequence (opt4) from Lassa virus__AIT17466__GPC
augggccagaucaucaccuucuuccaggaggugccccaggugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaaccagagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuucgccguggacgccgccaaccacugcggcaccaucgccaacggcgugcugcagaccuucaugagaauggccuggggcggcagcuacaucgcccuggacagcggcagaggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaucaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1974 - RNA, 1473 nt, Artificial Sequence
  derived and/or modified CDS sequence (opt4) from Lassa virus__AIT17470__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacagaaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1975 - RNA, 1473 nt, Artificial Sequence
  derived and/or modified CDS sequence (opt4) from Lassa virus__AIT17474__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcauccaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaucaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacaucaccggcaagcccugccccaagccccacagacugaaccacaugggcaucugcagcugcggccuguacaagcaccccggcgugcccgugagauggaagagauga

SEQ ID NO: 1976 - RNA, 1473 nt, Artificial Sequence
  derived and/or modified CDS sequence (opt4) from Lassa virus__AIT17478__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccgaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagcagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagaugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1977 - RNA, 1473 nt, Artificial Sequence
  derived and/or modified CDS sequence (opt4) from Lassa virus__AIT17482__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaucaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacguggugggcaagcccugccccaagccccacagacugaaccacaugggcaucugcagcugcggccuguacaagcaccccggcgugcccgugaaguggaagagauga

SEQ ID NO: 1978 - RNA, 1473 nt, Artificial Sequence
  derived and/or modified CDS sequence (opt4) from Lassa virus__AIT17486__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccgugggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1979 - RNA, 1473 nt, Artificial Sequence
  derived and/or modified CDS sequence (opt4) from Lassa virus__AIT17490__GPC
augggccagaucaucaccuucuuccaggaggugccccacgugaucgaggaggugaugaacaucgugcugaucacccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccaaccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuucgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcaucugcagcugcggccuguacaagcaccccggcgugcccgugaaguggaagagauga

SEQ ID NO: 1980 - RNA, 1473 nt, Artificial Sequence
  derived and/or modified CDS sequence (opt4) from Lassa virus__AIT17494__GPC
augggccagaucaucaccuucuuccaggaggugccccacgugaucgaggaggugaugaacaucgugcugaucgcccugagccugcuggccauccugaagggcguguacaacguggccaccugcggccuguucggccuggugagcuuccugcugcugugcggcagaagcugcagcaccaucuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccagcugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1981 - RNA, 1473 nt, Artificial Sequence
  derived and/or modified CDS sequence (opt4) from Lassa virus__AIT17498__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgagaccgagcugaagugcuucggcaacaccgccguggccaagugcaacgagaagcacgacgaggaguucugcgacaugcugagacuguucgacuucaacaagcaggccaucagcagacugagaagcgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccaagugcuggcuggugagcaacggcagcuaccugaacgagacccacuucagcgacgacaucgagcagcaggccgacaacaugaucaccgagaugcugcagaaggaguacaucgacagacagggcaagaccccccugggccugguggaccuguucguguucagcaccagcuucuaccugaucagcaucuuccugcaccuggugaagauccccacccacagacacaucaccggcaagcccugccccaagccccacagacugaaccacaugggcaucugcagcugcggccuguacaagcaccccggcgugcccgugaaguggaagagauga

SEQ ID NO: 1982 - RNA, 1473 nt, Artificial Sequence
  derived and/or modified CDS sequence (opt4) from Lassa virus__AIT17502__GPC
augggccagaucaucaccuucuuccaggagaucccccacgugaucgaggaggugaugaacaucgugcugaucacccugagccugcuggccauccugaagggcaucuacaacguggccaccugcggccuguucggccuggugagcuuccugcugcugugcggcaagagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacagaaagaaccuguacgaccacacccugaugagcaucaucagcaccuuccaccugagcauccccaacuucaaccaguacgaggccaugagcugcgacuucaacggcggcaagaucagcgugcaguacaaccugagccacgccuacgccaucgacgccgccacccacugcggcaccaucgccaacggcgugcugcagaccuucaugagaauggccuggggcggcagcuacaucgcccuggacagcggcaagggcggcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugagaaaccaccugagagacaucaugggcauccccuacugcaacuacagcaaguacugguaccugaaccacaccgugaccggcaagaccagccugcccaagugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcgugugcagcugcggccuguacaagcaccccggcgugcccgugaaguggaagagauga

SEQ ID NO: 1983 - RNA, 1473 nt, Artificial Sequence
  derived and/or modified CDS sequence (opt4) from Lassa virus__AIT17506__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccgagcacugcggcaccaucgccaacggcgugcugcagaccuucaugagaauggccuggggcggcagcuacaucgcccuggacagcggcaagggcagcugggacugcgugaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucgagagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagaugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1984 - RNA, 1473 nt, Artificial Sequence
  derived and/or modified CDS sequence (opt4) from Lassa virus__AIT17510__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccaaggacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1985 - RNA, 1473 nt, Artificial Sequence
  derived and/or modified CDS sequence (opt4) from Lassa virus__AIT17514__GPC
augggccagaucaucaccuucuuccaggaggugccccacgugaucgaggaggugaugaacaucgugcugaucgcccugagccugcuggccgugcugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacagacaccccggcgugcccgugaaguggaagagauga

SEQ ID NO: 1986 - RNA, 1473 nt, Artificial Sequence
  derived and/or modified CDS sequence (opt4) from Lassa virus__AIT17518__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1987 - RNA, 1473 nt, Artificial Sequence
  derived and/or modified CDS sequence (opt4) from Lassa virus__AIT17524__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccaucgacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagaugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1988 - RNA, 1473 nt, Artificial Sequence
  derived and/or modified CDS sequence (opt4) from Lassa virus__AIT17528__GPC
augggccagaucaucaccuucuuccaggaggugccccacgugaucgaggaggugaugaacaucgugcugaucgcccugagccugcuggccaugcugaagggcaucuacaacaucgccaccugcggccuguucggccugaucagcuuccugcugcugugcggcagaagcugcagcaccaccuacaagggcguguacgagcugcaggcccuggagcuggacauggccaaccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccggcgacgccgccaagcacugcggcaccaucgccaacggcgugcugcagaccuucaugagaauggccuggggcggcagcuacaucgcccuggacagcggcaagggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacagcgugaccggcagaaccagccugcccagaugcuggcuggugagcaacggcagcuaccugaacgagacccaguucagcgacgacaucgagcagcaggccgacaacaugaucaccgagaugcugcagaaggaguacaucgacagacagggcaagaccccccugggccugguggaccuguucguguucagcaccagcuucuaccugaucagcaucuuccugcaccugaucaagauccccacccacagacacaucgugggcaagcccugccccaagccccacagacugaaccacaugggcaucugcagcugcggccuguacaagcaccccggcauccccgugaaguggaagagauga

SEQ ID NO: 1989 - RNA, 1473 nt, Artificial Sequence
  derived and/or modified CDS sequence (opt4) from Lassa virus__AIT17538__GPC
augggccagaucaucaccuucuuccaggaggugccccacgugaucgaggaggugaugaacaucgugcugaucgcccugagccugcuggccauccugaagggcaucuacaacaucgccaccugcggccuguucggccugaucagcuuccugcugcugugcggcagaagcugcagcaccaccuacaagggcguguacgagcugcagacccuggagcuggacauggccaaccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacgagggcaagaucagcgugcaguacaaccugagccacagcuacgccaucgacgccgccggccacugcggcaccaucgccaacggcgugcugcagaccuucaugagaauggccuggggcggcagcuacaucgcccuggacagcggcaagggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgaggcccccggcggcuacugccugaccagauggaugcugaucgaggccgagcugaagugcuucggcaacaccgccaucgccaagugcaacgagaagcacgacgaggaguucugcgacaugcugagacuguucgacuucaacaagcaggccaucaagagacugaaggccgaggcccagaugagcauccaccugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccaagugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacaucgugggcagacccugccccaagccccacagacugaaccacaugggcaucugcagcugcggccuguacaagcaccccggcgugcccgugaaguggaagagauga

SEQ ID NO: 1990 - RNA, 1473 nt, Artificial Sequence
  derived and/or modified CDS sequence (opt4) from Lassa virus__AIT17540__GPC
augggccagaucgugaccuucuuccaggaggugccccacgugaucgaggagaucaugaacaucgugcugaucacccugagccugcuggccauccugaagggcaucuacaacuucgccaccugcggccugaucggccugaucaccuuccuguuccugugcggcagaagcugcagcaccaucuacaagggcagcuaccagcugcagacccuggagcugaacauggagacccugaacaugaccaugccccugagcugcaccaagaacaacagccaccacuacaucagagugggcaacgagaccggccuggagcugacccugaccaacaccagcaucaucaaccacaaguucugcaaccugagcgaggcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccagcaccggcagaaccagccugcccaagugcuggcuggugagcaacggcagcuaccugaacgagacccacuucagcgacgacaucgagcagcaggccgacaacaugaucaccgagaugcugcagaaggaguacaucgacagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 1991 - RNA, 1473 nt, Artificial Sequence
  derived and/or modified CDS sequence (opt4) from Lassa virus__AIT17544__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacaugggcagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcaucugcagcugcggccuguacaagcaccccggcgugcccgugaaguggaagagauga

SEQ ID NO: 1992 - RNA, 1473 nt, Artificial Sequence
  derived and/or modified CDS sequence (opt4) from Lassa virus__AIT17548__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccuguuccugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagagaaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccggcgacgccgccaagcacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugagaaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccaagugcuggcuggugagcaacggcagcuaccugaacgagacccacuucagcgacgacaucgagcagcaggccgacaacaugaucaccgagaugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1993 - RNA, 1473 nt, Artificial Sequence
  derived and/or modified CDS sequence (opt4) from Lassa virus__AIT17552__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccgugaacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagaaguga

SEQ ID NO: 1994 - RNA, 1473 nt, Artificial Sequence
  derived and/or modified CDS sequence (opt4) from Lassa virus__AIT17556__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcagaggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaucaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacaucaccggcaagcccugccccaagccccacagacugaaccacaugggcaucugcagcugcggccuguacaagcaccccggcgugcccgugagauggaagagauga

SEQ ID NO: 1995 - RNA, 1473 nt, Artificial Sequence
  derived and/or modified CDS sequence (opt4) from Lassa virus__AIT17560__GPC
augggccagaucaucaccuucuuccaggaggugccccacgugaucgaggaggugaugaacaucgugcugaucgcccugagccugcuggccgugcugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaccaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccggcgaggccgccaaccacugcggcaccaucgccaacggcgugcugcagaccuucaugagaauggccuggggcggcagcuacaucgcccuggacagcggcaagggcagcugggacugcaucaugaccagcuacaaguaccugaucauccagaacaccaccuggggcgaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaaagcugaagaccgaggcccagaugagcauccagcugaucaacaaggccgugaacgcccugaucaacgaccagcugaucaugaagaaccaccugagagacaucaugggcauccccuacugcaacuacagcagauacugguaccugaaccacaccgugaccggcagaaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcaucugcagcugcggccuguacaagcaccccggcgugcccgugaaguggaagagauga

SEQ ID NO: 1996 - RNA, 1473 nt, Artificial Sequence
  derived and/or modified CDS sequence (opt4) from Lassa virus__AIT17564__GPC
augggccagaucaucaccuucuuccaggaggugccccacgugaucgaggaggugaugaacaucgugcugaucgcccugagccugcuggccauccugaagggcaucuacaacguggccaccugcggccuguucggccugcugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaaggaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccaagcacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccagcugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucaagagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 1997 - RNA, 1473 nt, Artificial Sequence
  derived and/or modified CDS sequence (opt4) from Lassa virus__AIT17572__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccaaccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaacuacgccguggacgccgccaaccacugcggcaccaucgccaacggcgugcugcagaccuucaugagaauggccuggggcggcagcuacaucgcccuggacagcggcaagggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgacaugcccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugaacauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcaucugcagcugcggccuguacaagcaccccggcgugcccgugaaguggaagagauga

SEQ ID NO: 1998 - RNA, 1473 nt, Artificial Sequence
  derived and/or modified CDS sequence (opt4) from Lassa virus__AIT17576__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagcagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagaugcugcagaaggaguacaucgacagacagggcaagaccccccugggccugguggaccuguucguguucagcaccagcuucuaccugaucagcaucuuccugcaccuggugaagauccccacccacagacacaucaccggcaagcccugccccaagccccacagacugaaccacaugggcaucugcagcugcggccuguacaagcaccccggcgugcccgugaaguggaagagauga

SEQ ID NO: 1999 - RNA, 1473 nt, Artificial Sequence
  derived and/or modified CDS sequence (opt4) from Lassa virus__AIT17580__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagagcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcagaaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2000 - RNA, 1473 nt, Artificial Sequence
  derived and/or modified CDS sequence (opt4) from Lassa virus__AIT17584__GPC
augggccagaucaucaccuucuuccaggaggugccccaggugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaaccagagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuucgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaagaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2001 - RNA, 1473 nt, Artificial Sequence
  derived and/or modified CDS sequence (opt4) from Lassa virus__AIT17588__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2002 - RNA, 1473 nt, Artificial Sequence
  derived and/or modified CDS sequence (opt4) from Lassa virus__AIT17592__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacacccugaugagcaucaucagcaccuuccaccugagcauccccaacuucaaccaguacgaggccaugagcugcgacuucaacggcggcagaaucagcgugcaguacaaccugagccacgccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaucaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacguggugggcaagcccugccccaagccccacagacugaaccacaugggcaucugcagcugcggccuguacaagcaccccggcgugcccgugaaguggaagagauga

SEQ ID NO: 2003 - RNA, 1473 nt, Artificial Sequence
  derived and/or modified CDS sequence (opt4) from Lassa virus__AIT17596__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccagcugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2004 - RNA, 1473 nt, Artificial Sequence
  derived and/or modified CDS sequence (opt4) from Lassa virus__AIT17600__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccggcgacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2005 - RNA, 1473 nt, Artificial Sequence
  derived and/or modified CDS sequence (opt4) from Lassa virus__AIT17604__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacaugaccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaaggaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaagcacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccgugggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguaccuggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2006 - RNA, 1473 nt, Artificial Sequence
  derived and/or modified CDS sequence (opt4) from Lassa virus__AIT17608__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagagaaaccuguacaaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcaucugcagcugcggccuguacaagcaccccggcgugcccgugaaguggagaagauga

SEQ ID NO: 2007 - RNA, 1473 nt, Artificial Sequence
  derived and/or modified CDS sequence (opt4) from Lassa virus__AIT17612__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucagagugggcaacgagaccggccuggagcugacccugaccaacaccagcaucaucaaccacaaguucugcaaccugagcgacgcccacaagaagaaccuguacgaccacagccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacguggugggcaagcccugccccaagccccacagacugaaccacaugggcaucugcagcugcggccuguacaagcaccccggcgugcccgugaaguggaagagauga

SEQ ID NO: 2008 - RNA, 1473 nt, Artificial Sequence
  derived and/or modified CDS sequence (opt4) from Lassa virus__AIT17616__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2009 - RNA, 1473 nt, Artificial Sequence
  derived and/or modified CDS sequence (opt4) from Lassa virus__AIT17620__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucagccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccaucgacgccgccaaccacugcggcaccguggccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2010 - RNA, 1473 nt, Artificial Sequence
  derived and/or modified CDS sequence (opt4) from Lassa virus__AIT17626__GPC
augggccagaucaucaccuucuuccaggaggugccccacgugaucgaggaggugaugaacaucgugcugaucgcccugagccugcuggccauccugaagggcguguacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucauccagcacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucaccgugcaguacaaccugagccacagcuacgccaucgacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcagaaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcgugugcagcugcggccuguacaagcaccccggcgugcccgugaaguggaagagauga

SEQ ID NO: 2011 - RNA, 1473 nt, Artificial Sequence
  derived and/or modified CDS sequence (opt4) from Lassa virus__AIT17630__GPC
augggccagaucaucaccuucuuccaggaggugccccacgugaucgaggaggugaugaacaucgugcugaucgcccugagccugcuggccauccugaagggcaucuacaacguggccaccugcggccuguucggccugcugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccgagcacugcggcaccaucgccaacggcgugcugcagaccuucaugagaauggccuggggcggcagcuacaucgcccuggacagcggcaagggcagcugggacugcgugaugaccagcuaccaguaccugaucauccagaacaccagcugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2012 - RNA, 1473 nt, Artificial Sequence
  derived and/or modified CDS sequence (opt4) from Lassa virus__AIT17634__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaucuacaaggacguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccaucgacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcagauacugguaccugaaccacaccgugaccggcagaaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaaccaccccggcgugcccgugaaguggaagagauga

SEQ ID NO: 2013 - RNA, 1473 nt, Artificial Sequence
  derived and/or modified CDS sequence (opt4) from Lassa virus__AIT17638__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaaggaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccugaucaagauccccacccacagacacaucaccggcaagcccugccccaagccccacagacugaaccacaugggcaucugcagcugcggccuguacaagcaccccggcgugcccgugaaguggaagagauga

SEQ ID NO: 2014 - RNA, 1473 nt, Artificial Sequence
  derived and/or modified CDS sequence (opt4) from Lassa virus__AIT17642__GPC
augggccagaucaucaccuucuuccaggaggugccccacgugaucgaggaggugaugaacaucgugcugaucgcccugagccugcuggccauccugaagggcguguacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgacaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccagccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcaucugcagcugcggccuguacaagcaccccggcgugcccgugaaguggaagagauga

SEQ ID NO: 2015 - RNA, 1473 nt, Artificial Sequence
  derived and/or modified CDS sequence (opt4) from Lassa virus__AIT17646__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccagccacugcggcaccguggccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2016 - RNA, 1473 nt, Artificial Sequence
  derived and/or modified CDS sequence (opt4) from Lassa virus__AIT17650__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaucagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcagaaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcaucugcagcugcggccuguacaagcaccccggcgugcccgugaaguggaagagauga

SEQ ID NO: 2017 - RNA, 1473 nt, Artificial Sequence
  derived and/or modified CDS sequence (opt4) from Lassa virus__AIT17658__GPC
augggccagaucaucaccuucuuccaggaggugccccacgugaucgaggaggugaugaacaucgugcugaucgcccugagccugcuggccauccugaagggcguguacaacguggccaccugcggccuguucggccuggugagcuuccugcugcugugcggcagaagcugcagcaucaccuacaagggcguguacgagcugcagacccuggagcuggacauggccaaccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccggcgacgccgccgaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaugggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaucaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacaucaccggcaagcccugccccaagccccacagacugaaccacaugggcaucugcagcugcggccuguacaagcaccccggcgugcccgugagauggaagagauga

SEQ ID NO: 2018 - RNA, 1473 nt, Artificial Sequence
  derived and/or modified CDS sequence (opt4) from Lassa virus__AIT17666__GPC
augggccagaucgugaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacaucaccggcaagcccugccccaagccccacagacugaaccacaugggcaucugcagcugcggccuguacaagcaccccggcgugcccgugaaguggaagagauga

SEQ ID NO: 2019 - RNA, 1473 nt, Artificial Sequence
  derived and/or modified CDS sequence (opt4) from Lassa virus__AIT17670__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcagaaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcaucugcagcugcggccuguacaagcaccccggcgugcccgugaaguggaagagauga

SEQ ID NO: 2020 - RNA, 1473 nt, Artificial Sequence
  derived and/or modified CDS sequence (opt4) from Lassa virus__AIT17674__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacaugaccaaccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacaaccacgcccugaugagcaucaucagcaccuuccaccugagcauccccaacuucaaccaguacgaggccaugagcugcgacuucaacggcggcaagaucagcgugcaguacaaccugagccacagcuacgccguggacgccgccaaccacugcggcaccaucgccaacggcgugcugcagaccuucaugagaauggccuggggcggcagcuacaucgcccuggacagcggcaagggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccaggccaacauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2021 - RNA, 1473 nt, Artificial Sequence
  derived and/or modified CDS sequence (opt4) from Lassa virus__AIT17678__GPC
augggccagaucaucaccuucuuccaggaggugccccacgugaucgaggaggugaugaacaucgugcugaucacccugagccugcuggccauccugaagggcaucuacaacaucgccaccugcggccuguucggccuggugagcuuccugcugcugugcggcagaagcugcagcaccaccuacaagggcguguacgagcugcagacccuggagcuggacaugaccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcaucugcagcugcggccuguacaagcaccccggcauccccgugaaguggaagagauga

SEQ ID NO: 2022 - RNA, 1473 nt, Artificial Sequence
  derived and/or modified CDS sequence (opt4) from Lassa virus__AIT17686__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcagaaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccugaucaagauccccacccacagacacgugaucggcaagcccugccccaagccccacagacugaaccacaugggcaucugcagcugcggccuguacaagcaccccggcgugcccgugaaguggaagagauga

SEQ ID NO: 2023 - RNA, 1473 nt, Artificial Sequence
  derived and/or modified CDS sequence (opt4) from Lassa virus__AIT17690__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccagccacugcggcaccguggccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcagaaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2024 - RNA, 1473 nt, Artificial Sequence
  derived and/or modified CDS sequence (opt4) from Lassa virus__AIT17694__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaucuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacguggugggcaagcccugccccaagccccacagacugaaccacaugggcaucugcagcugcggccuguacaagcaccccggcgugcccgugaaguggaagagauga

SEQ ID NO: 2025 - RNA, 1473 nt, Artificial Sequence
  derived and/or modified CDS sequence (opt4) from Lassa virus__AIT17712__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcgccugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucaugagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagaugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugagauggaagagauga

SEQ ID NO: 2026 - RNA, 1473 nt, Artificial Sequence
  derived and/or modified CDS sequence (opt4) from Lassa virus__AIT17718__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucagagugggcaacgagaccggccuggagcugacccugaccaacgccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccaucgacgccgccaaccacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggcuucuacaagcaccccggcgugcccgugaaguggaagagauga

SEQ ID NO: 2027 - RNA, 1473 nt, Artificial Sequence
  derived and/or modified CDS sequence (opt4) from Lassa virus__AIT17724__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccaaccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccguggccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacaucaugggcaagcccugccccaagccccacagacugaaccacaugggcaucugcagcugcggccuguacaagcaccccggcgugcccgugaaguggaagagauga

SEQ ID NO: 2028 - RNA, 1473 nt, Artificial Sequence
  derived and/or modified CDS sequence (opt4) from Lassa virus__AIT17728__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacaugggcagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2029 - RNA, 1473 nt, Artificial Sequence
  derived and/or modified CDS sequence (opt4) from Lassa virus__AIT17732__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcaccccggcgugcccgugaaguggaagagauga

SEQ ID NO: 2030 - RNA, 1473 nt, Artificial Sequence
  derived and/or modified CDS sequence (opt4) from Lassa virus__AIT17736__GPC
augggccagaucgugaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaaggaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucaugagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagaccagauucagcgacgacaucgagcagcaggccgacaacaugaucaccgagaugcugcagaaggaguaccuggacagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcaucugcagcugcggccuguacaagcaccccggcgugcccgugaaguggaagagauga

SEQ ID NO: 2031 - RNA, 1473 nt, Artificial Sequence
  derived and/or modified CDS sequence (opt4) from Lassa virus__AIT17744__GPC
augggccagaucaucaccuucuuccaggaggugccccacgugaucgaggaggugaugaacaucgugcugaucgcccugagccugcuggccauccugaagggcaucuacaacguggccaccugcggccuguucggccugaugagcuuccugcugcugugcggcagaagcugcagcaccaccuacaagggcguguacgagcugcagacccuggagcuggacauggccaaccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccagcugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2032 - RNA, 1473 nt, Artificial Sequence
  derived and/or modified CDS sequence (opt4) from Lassa virus__AIT17752__GPC
augggccagaucaucaccuucuuccacgaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccaucgacgccgccaaccacugcggcaccaucgccaacggcgugcugcagaccuucaugagaauggccuggggcggcagcuacaucgcccuggacagcggcagaggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2033 - RNA, 1473 nt, Artificial Sequence
  derived and/or modified CDS sequence (opt4) from Lassa virus__AIT17756__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaucaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcagaggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcagaaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcaucugcagcugcggccuguacaagcaccccggcgugcccgugaaguggaagagauga

SEQ ID NO: 2034 - RNA, 1473 nt, Artificial Sequence
  derived and/or modified CDS sequence (opt4) from Lassa virus__AIT17758__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcugaacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagagaaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaagcacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugcgaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2035 - RNA, 1473 nt, Artificial Sequence
  derived and/or modified CDS sequence (opt4) from Lassa virus__AIT17762__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucagccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgaggcccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcagauacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2036 - RNA, 1473 nt, Artificial Sequence
  derived and/or modified CDS sequence (opt4) from Lassa virus__AIT17770__GPC
augggccagaucgugaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcaggcccuggagcuggacaugagcagccugaacaugaccaugccccugagcugcaccaagaacaacagccaccacuacaucauggugggcaacgagaccggccuggagcugacccugaccaacaccagcaucauccaccacaaguucugcaaccugagcgacgcccacaagaaggaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcggcugggacugcaucaugaccagcuaccaguuccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucaagagacugaagaccgaggcccagaugagcauccaccugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugagauggaagagauga

SEQ ID NO: 2037 - RNA, 1473 nt, Artificial Sequence
  derived and/or modified CDS sequence (opt4) from Lassa virus__AIT17778__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccaaccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccagagacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugaacauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacgugaucggcaagcccugccccaagccccacagacugaaccacaugggcaucugcagcugcggccuguacaagcaccccggcgugcccgugaaguggaagagauga

SEQ ID NO: 2038 - RNA, 1473 nt, Artificial Sequence
  derived and/or modified CDS sequence (opt4) from Lassa virus__AIT17782__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucaagagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacaucgacagacagggcaagaccccccugggccugguggaccuguucguguucagcaccagcuucuaccugaucagcaucuuccugcaccuggugaagauccccacccacagacacguggugggcaagcccugccccaagccccacagacugaaccacaugggcaucugcagcugcggccuguacaagcaccccggcgugcccgugaaguggaagagauga

SEQ ID NO: 2039 - RNA, 1473 nt, Artificial Sequence
  derived and/or modified CDS sequence (opt4) from Lassa virus__AIT17786__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacgccuacgccaucgacgccgccgaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacaucaccggcaagcccugccccaagccccacagacugaaccacaugggcaucugcagcugcggccuguacaagcaccccggcgugcccgugaaguggaagagauga

SEQ ID NO: 2040 - RNA, 1473 nt, Artificial Sequence
  derived and/or modified CDS sequence (opt4) from Lassa virus__AIT17790__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagcugcugcagaaggaguacauggacagacagggcaagaccccccugggccugguggaccuguucguguucagcaccagcuucuaccugaucagcaucuuccugcaccuggugaagauccccacccacagacacaucaccggcaagcccugccccaagccccacagacugaaccacaugggcaucugcagcugcggccuguacaagcaccccggcgugcccgugaaguggaagagauga

SEQ ID NO: 2041 - RNA, 1473 nt, Artificial Sequence
  derived and/or modified CDS sequence (opt4) from Lassa virus__AIT17798__GPC
augggccagaucaucaccuucuuccaggaggugccccacgugaucgaggaggugaugaacaucgugcugaucgcccugagccugcuggccauccugaagggcaucuacaacguggccaccugcggccuguucggccuggugagcuuccugcugcugugcggcagaagcugcagcaccaccuacaagggcguguacgagcugcagacccuggagcuggacauggccagccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccguggacgccgccaaccacugcggcaccaucgccaacggcgugcugcagaccuucaugagaauggccuggggcggcagcuacaucgcccuggacagcggcaagggcagcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucaugagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccagaugcuggcuggugagcaacggcagcuaccugaacgagacccacuucagcgacgacaucgagcagcaggccgacaacaugaucaccgagaugcugcagaaggaguaccuggacagacagggcaagaccccccugggccugguggaccuguucguguucagcaccagcuucuaccugaucagcaucuuccugcaccuggugaagauccccacccacagacacaucaucggcaagcccugccccaagccccacagacugaaccacaugggcaucugcagcugcggccuguacaagcaccccggcgugcccgugaaguggaagagauga

SEQ ID NO: 2042 - RNA, 1476 nt, Artificial Sequence
  derived and/or modified CDS sequence (opt4) from Lassa virus__AIT17802__GPC
augggccagaucgugaccuucuuccaggaggugccccacgugaucgaggaggugaugaacaucgugcugaucgcccugagcauccuggccgugcugaagggccuguacaaccuggccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacaaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagagacagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacugggcaagaccccccugggccugguggaccuguucguguucagcaccagcuucuaccugaucagcaucuuccugcaccuggugaagauccccacccacagacacaucgugggcagaagcugccccaagccccacagacugaaccacaugggcaucugcagcugcggccuguacaagcagcccggcgugcccgugaaguggaagagauga

SEQ ID NO: 2043 - RNA, 1476 nt, Artificial Sequence
  derived and/or modified CDS sequence (opt4) from Lassa virus__AIT17806__GPC
augggccagaucgugaccuucuuccaggaggugccccacgugaucgaggaggugaugaacaucgugcugaucgcccugagcauccuggccgugcugaagggccuguacaacuucgccaccugcggccugaucggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcaagugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 2044 - RNA, 1476 nt, Artificial Sequence
  derived and/or modified CDS sequence (opt4) from Lassa virus__AIT17810__GPC
augggccagaucgugaccuucuuccaggaggugccccacgugaucgaggaggugaugaacaucgugcugaucgcccugagcauccuggccgugcugaagggccuguacaaccuggccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaaggacaacagccaccacuacaucagagugggcaacgagaccggccuggagcugacccugaccaacaccagcauccugaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcagaaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccagaugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacguggugggcaagcccugccccaagccccacagacugaaccacaugggcaucugcagcugcggccuguacaagcagcccggcgugcccgugaaguggaagagauga

SEQ ID NO: 2045 - RNA, 1476 nt, Artificial Sequence
  derived and/or modified CDS sequence (opt4) from Lassa virus__AIT17814__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucgaccacaaguucugcaaccugagcgacgcccacagaaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccaaggacgccgccgaccacugcggcaccguggccaacggcgugcugcagaccuucaugagaauggccuggggcggcagcuacaucgcccuggacagcggcagaggcagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugaaguggaagagauga

SEQ ID NO: 2046 - RNA, 1476 nt, Artificial Sequence
  derived and/or modified CDS sequence (opt4) from Lassa virus__AIT17820__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccgaggacgccgccaaccacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 2047 - RNA, 1476 nt, Artificial Sequence
  derived and/or modified CDS sequence (opt4) from Lassa virus__AIT17824__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagcguguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggccacggcaagugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugagauggaagagauga

SEQ ID NO: 2048 - RNA, 1476 nt, Artificial Sequence
  derived and/or modified CDS sequence (opt4) from Lassa virus__AIT17828__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaccagccuguacaagggcgacuacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugaaguggaagagauga

SEQ ID NO: 2049 - RNA, 1473 nt, Artificial Sequence
  derived and/or modified CDS sequence (opt4) from Lassa virus__AIT17836__GPC
augggccagaucaucaccuucuuccaggaggugccccacgugaucgaggaggugaugaacaucgugcugaucgcccugagccugcuggccauccugaagggccuguacaacaucgccaccugcggcaucaucggccugguggccuuccuguuccugugcggcaagagcugcagccugacccugaagggcggcuacgagcugcagacccuggagcugaacauggagacccugaacaugaccaugccccugagcugcaccaagaacagcagccaccacuacaucagagugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccgagcacugcggcaccguggccaacggcgugcugcagaccuucaugagaauggccuggggcggcagauacaucgcccuggacagcggcaagggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccagcagcggcagaaccagccugcccaagugcuggcugaucagcaacggcagcuaccugaacgagacccaguucagcgacgacaucgagcagcaggccgacaacaugaucaccgagaugcugcagaaggaguacaucgagagacagggcaagaccccccugggccugguggacaucuucaucuucagcaccagcuucuaccugaucagcaucuuccugcaccugaucaagauccccacccacagacacaucgugggcaagcccugccccaagccccacagacugaaccacaugggcgugugcagcugcggccuguacaagcaccccggcgugcccaccaaguggaagagauga

SEQ ID NO: 2050 - RNA, 1476 nt, Artificial Sequence
  derived and/or modified CDS sequence (opt4) from Lassa virus__AIT17840__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaucagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagagacagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugaaguggaagagauga

SEQ ID NO: 2051 - RNA, 1476 nt, Artificial Sequence
  derived and/or modified CDS sequence (opt4) from Lassa virus__AIT17844__GPC
augggccagaucgugaccuucuuccaggaggugccccacgugaucgaggaggugaugaacaucgugcugaucgcccugagcauccuggccgugcugaagggccuguacaacuucgccaccugcggccuggugggccuggugaccuuccugcugcugugcggcagaagcugcaccaucagccuguacaagggcguguacgagcugcagacccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacagcuacgccggcgacgccgccaaccacugcggcaccguggccaacggcgugcugcagaccuucaugagaauggccuggggcggcagcuacaucgcccuggacagcggcagagacagaugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacagagccgugaacgcccugaucaacgaccagcugaucaugaagaaccaccugagagacaucaugggcauccccuacugcaacuacagcaaguacugguaccugaaccacaccaccaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugaaguggaagagauga

SEQ ID NO: 2052 - RNA, 1473 nt, Artificial Sequence
  derived and/or modified CDS sequence (opt4) from Lassa virus__AMR44577__GPC
augggccagaucaucaccuucuuccaggaggugccccacgugaucgaggaggugaugaacaucgugcugaucgcccugagccugcuggccauccugaagggcguguacaacguggccaccugcggcaucaucggccuggugaccuuccuguuccugugcggcagaagcugcagccugaucuacaagggcagcuacgagcugcagacccuggagcugaacauggagacccugaacaugaccaugccccugagcugcaccaagaacagcagccaccacuacaucagagugggcaacgagaccggccuggagcugacccugaccaacaccagcaucaucaaccacaaguucugcaaccugagcgacgcccacaagagaaaccuguacgaccacgcccugaugagcauccugagcaccuuccaccugagcauccccaacuucaaccaguacgaggccaugagcugcgacuucaacggcggcaagaucagcgugcaguacaaccugagccacgccuacgccguggacgccgccgagcacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaagagcgaggcccagaugagcauccagcugaucaacaaggccgugaacgcccugaucaacgaccagcugaucaugaagaaccaccugagagacaugaugggcauccccuacugcaacuacagcaaguacugguaccugaaccacaccagcagcggcagaaccagccugcccaagugcuggcuggugagcaacggcagcuaccugaacgagacccacuucagcgacgacaucgagcagcaggccgacaacaugaucaccgagaugcugcagaaggaguacaucgacagacagggcaagaccccccugggccugguggaccuguucguguucagcaccagcuucuaccugaucagcaucuuccugcaccugaucaagauccccacccacagacacaucgugggcaagcccugccccaagccccacagacugaaccacaugggcaucugcagcugcggccuguacaagcagcccggcgugcccaccagauggaagagauga

SEQ ID NO: 2053 - RNA, 1476 nt, Artificial Sequence
  derived and/or modified CDS sequence (opt4) from Lassa virus__ANH09722__GPC
augggccagaucgugaccuucuuccaggaggugccccacgugaucgaggaggugaugaacaucgugcugaucgcccugagcauccuggccgugcugaagggccuguacaacguggccaccugcggccugaucggccuggugaccuuccugcugcugugcggcagaagcugcaccaccacccuguacaagggcguguacgagcugcaggcccuggagcugaacauggagacccugaacaugaccaugccccugagcugcaccaagaacaacagccaccacuacaucagagugggcaacgagaccggccuggagcugacccugaccaacaccagccugaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacgacggcaagaucagcgugcaguacaaccugagccacaccuacgccggcgacaccgccaaccacugcggcaccguggccaacggcgugcugcagaccuucaugagaauggccuggggcggcagcuacaucgcccuggacagcggcagaggcggcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacguggugggcaagcccugccccaagccccacagacugaaccacaugggcaucugcagcugcggcuucuacaagcagcccggcgugcccgugagauggaagagauga

SEQ ID NO: 2054 - RNA, 1476 nt, Artificial Sequence
  derived and/or modified CDS sequence (opt4) from Lassa virus__ANH09724__GPC
augggccagaucgugaccuucuuccaggaggugccccacgugaucgaggaggugaugaacaucgugcugaucgcccugagcauccuggccgugcugaagggccuguacaacguggccaccugcggccugaucggccuggugaccuuccugcugcugugcggcagaagcugcaccaccacccuguacaagggcguguacgagcugcaggcccuggagcugaacauggagacccugaacaugaccaugccccugagcugcaccaagaacgacagccaccacuacaucauggugggcaacgagaccggccuggagcugacccugaccaacaccagcaucaucagccacaaguucugcaaccugagcgacgcccacaagcagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccggcgacgccgccaaccacugcggcaccguggccaacggcgugcugcagaccuucaugagaauggccuggggcggcagcuacaucgcccuggacagcggcagaggcggcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacguggugggcaagcccugccccaagccccacagacugaaccacaugggcaucugcagcugcggcuucuacggccagcccggcgugcccgugagauggaagagauga

SEQ ID NO: 2055 - RNA, 1476 nt, Artificial Sequence
  derived and/or modified CDS sequence (opt4) from Lassa virus__ANH09728__GPC
augggccagaucgugaccuucuuccaggaggugccccacgugaucgaggaggugaugaacaucgugcugaucgcccugagcgugcuggccgugcugaagggccuguacaacguggccaccugcggccugaucggccuggugaccuuccugcugcugugcggcagaagcugcaccaccacccuguacaagggcguguacgagcugcaggcccuggagcugaacaugggcacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaaggaccuguacgaccacgcccugaugagcaucaucagcaccuuccaccugagcgugcccaacuucaaccaguacgaggccaugagcugcgacuucaacggcggcaagaucagcgugcaguacaaccugagccacgccuacgccggcgacaccgccaaccacugcggcaccguggccaacggcgugcugcagaccuucaugagaauggccuggggcggcagcuacaucgcccuggacagcggcagaggcggcugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcgaguacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacguggugggcaagcccugccccaagccccacagacugaaccacaugggcaucugcagcugcggcuucuacaagcagcccggcgugcccgugagauggaagagauga

SEQ ID NO: 2056 - RNA, 1476 nt, Artificial Sequence
  derived and/or modified CDS sequence (opt4) from Lassa virus__ANH09730__GPC
augggccagaucgugaccuucuuccaggaggugccccacgugaucgaggaggugaugaacaucgugcugaucgcccugagcgugcuggccgugcugaagggccuguacaacguggccaccugcggccugaucggccuggugaccuuccugcugcugugcggcagaagcugcaccaccacccuguacaagggcguguacgagcugcaggcccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaaccagggcaagaucagcgugcaguacaaccugagccacgccuacgccggcgacgccgccaaccacugcggcaccguggccaacggcgugcugcagaccuucaugagaauggccuggggcggcagcuacaucgcccuggacagcggcagaggcggcugggacugcaucaugaccagcuaccaguaccugaucauccagaacaccaccugggagaaccacugccaguucagcagacccagccccaucggcuaccugggccugcugagccagagaaccagagacaucuacaucagcagaagacugcugggcaccuucaccuggacccugagcgacagcgagggcaagggcacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagauucaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcagaaccccccugggccugguggaccuguucguguucagcaccagcuucuaccugaucagcaucuuccugcaccuggugaagauccccacccacagacacguggugggcaagcccugccccaagccccacagacugaaccacaugggcaucugcagcugcggcuucuacaagcagcccggcgugcccgugagauggaagagauga

SEQ ID NO: 2057 - RNA, 1476 nt, Artificial Sequence
  derived and/or modified CDS sequence (opt4) from Lassa virus__ANH09732__GPC
augggccagaucgugaccuucuuccaggaggugccccacgugaucgaggaggugaugaacaucgugcugaucgcccugagcauccuggccgugcugaagggcguguacaacguggccaccugcggccugaucggccuggugaccuuccugcugcugagcggcagaagcugcaccaccaccaucuacaagggcguguacgagcugcaggcccuggagcugaacauggagacccugaacaugaccaugccccugagcugcaccaagaacaacagccaccacuacaucauggugggcaacgagaccggccuggagcugacccugaccaacaccagcaucaucaaccacaaguucugcaaccugagcgacgcccacaagaagaaccuguacgaccacgcccugaugagcaucaucagcaccuuccaccugagcauccccaacuucaaccaguacgaggccaugagcugcgacuucaacggcggcaagaucagcgugcaguacaaccugagccacaccuacgccggcgacgccgccaaccacugcggcaccguggccaacggcgugcugcagaccuucaugagaauggccuggggcggcagcuacaucgcccuggacagcggccacggcggcugggacugcaucaugaccagcuaccaguaccugaucauccagaacaccaccugggagaaccacugccaguucagcagacccagccccaucggcuaccugggccugcugagccagagaaccagagacaucuacaucagcagaagacugcugggcaccuucaccuggacccugagcgacagcgagggcaaggacacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaaggccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccgugaccggcaagaccagccugcccaagugcuggcuggugagcaacggcagcuaccugaacgagacccacuucagcgacgacaucgagcagcaggccgacaacaugaucaccgagaugcugcagaaggaguacauggagagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggcuucuacaagcagcccggcgugcccgugagauggaagagauga

SEQ ID NO: 2058 - RNA, 1473 nt, Artificial Sequence
  derived and/or modified CDS sequence (opt4) from Lassa virus__ANH09738__GPC
augggccagaucgugaccuucuuccaggaggugccccacgugaucgaggagaucaugaacaucgugcugaucacccugagccugcuggccauccugaagggccuguacaacuucgccaccugcggccugaucggccugaucaccuuccuguuccugugcggcagaagcugcagcaugaucuacaagggcagcuaccagcuggagacccuggagcugaacauggagacccugaacaugaccaugccccugagcugcaccaagaacaacagccaccacuacaucagagugggcaacgagaccggccuggagcugacccugaccaacaccagcaucaucaaccacaaguucugcaaccugagcgacgcccacaagagaaaccuguacgaccacagccugaugagcaucaucagcaccuuccaccugagcauccccaacuucaaccaguacgaggccaugagcugcgacuucaacggcggcaagaucagcauccaguacaaccugagccacaccuacgccggcgacgccgccaagcacugcggcaccguggccaacggcgugcugcagaccuucaugagaauggccuggggcggcagcuacaucgcccuggacagcggcagaggcaacugggacugcaucaugaccagcuaccaguaccugaucauccagaacaccaccugggaggaccacugccaguucagcagacccagccccaucggcuaccugggccugcugagccagagaaccagagacaucuacaucagcagaagacugcugggcaccuucaccuggacccugagcgacagcgagggcaaggagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccauccagagacugaagaccgaggcccagaugagcauccagcugaucaacaaggccgugaacgcccugaucaacgaccagcugaucaugaagaaccaccugagagacaucaugggcauccccuacugcaacuacagcaaguacugguaccugaaccacaccagcaccggcagaaccagccugcccaagugcuggcuggugagcaacggcagcuaccugaacgagacccacuucagcgacgacaucgagcagcaggccgacaacaugaucaccgagaugcugcagaaggaguacaucgacagacagggcaagaccccccugggccugguggacguguucauguucagcaccagcuucuaccugaucagcaucuuccugcaccuggugaagauccccacccacagacacaucgugggcaagagcugccccaagccccacagacugaaccacaugggcaucugcagcugcggccuguacaagcagcccggcgugcccgugagauggaagagauga

SEQ ID NO: 2059 - RNA, 1473 nt, Artificial Sequence
  derived and/or modified CDS sequence (opt4) from Lassa virus__ANH09740__GPC
augggccagaucgugaccuucuuccaggaggugccccacgugaucgaggaggugaugaacaucgugcugaucgcccugagccugcuggccauccugaagggccuguacaacuucgccaccugcggcgugaucggccugaucaccuuccugcugcugugcggcagaagcugcagcgccaccuacaagggccaguacgagcugcagacccuggagcugaacauggagagccugaacaugaccaugccccugagcugcaccaagaacaacagccaccacuacaucagagccggcaacaacaccggccuggagcugacccugaccaacaccagcaucaucagccacaaguucugcaaccugagcgacgcccacaagaagaaccuguacgaccacacccugaugagcaucaucaccaccuuccaccugagcauccccaacuucaaccaguacgaggccaugagcugcgacuucaacggcggcaagaucagcauccaguacaaccugagccacagcuacgccggcgacgccgcccagcacugcggcaccguggccaacggcgugcugcagaccuucaugagaauggccuggggcggcagcuaccuggcccuggacagcggcagaagaggcugggacugcaucaucagcagcuaccaguaccugaucauccagaacaccaccugggacgaccacugccaguucagcagacccagccccaucggcuaccugggcuucgugagccagaagaccagagacaucuacaucagcagaagacugcugggcaccuucaccuggacccugagcgacagcgagggccacgacaugcccggcggcuacugccugaccagauggaugcugaucgaggccgaccugaagugcuucggcaacaccgccguggccaagugcaacgagaagcacgacgaggaguucugcgacauguggagacuguucgacuucaacaagcaggccauccagagacugaaggccgaggcccagaugaacauccagcugaucaacaaggccgugaacgcccugaucaacgaccagcugaugaugaagaaccaccugagagacaucaugggcauccccuacugcaacuacagcaaguucugguaccugaacaacaccaccaccggcagaaccagccugcccagaugcuggcugaucagcaacggcagcuaccugaacgagacccacuucagcgacgacaucgagcagcaggccgacaacaugaucaccgagaugcugcagaaggaguacauggacagacagggcaagaccccccugggccugguggaccuguucguguucagcaccagcuucuaccugaucaccaucuuccugcaccuggugaagauccccacccacagacacaucgugggcaagcccugccccaagccccacagacugaaccacaugggcaucugcagcugcggccuguacaagcagcccggcgugcccgugagauggaagagauga

SEQ ID NO: 2060 - RNA, 1473 nt, Artificial Sequence
  derived and/or modified CDS sequence (opt4) from Lassa virus__CAA36645__GPC
augggccagaucgugaccuucuuccaggaggugccccacgugaucgaggaggugaugaacaucgugcugaucgcccugagcauccuggccauccugaagggccuguacaacguggccaccugcggccugaucggccuggugaccuuccugcugcugagcggcagaagcugcagccugaucuacaagggcaccuacgagcugcagacccuggagcugaacauggagacccugaacaugaccaugccccugagcugcaccaagaacaacagccaccacuacaucagagugggcaacgagaccggccuggagcugacccugaccaacaccagcauccugaaccacaaguucugcaaccugagcgacgcccacaagagaaaccuguacgaccacagccugaugagcaucaucagcaccuuccaccugagcauccccaacuucaaccaguacgaggccaugagcugcgacuucaacggcggcaagaucaccgugcaguacaaccugagccacagcuucgccguggacgccgccggccacugcggcacccuggccaacggcgugcugcagaccuucaugagaauggccuggggcggcagcuacaucgcccuggacagcggcagaggcaacugggacugcaucaugaccagcuaccaguaccugaucauccagaacaccaccugggacgaccacugccaguucagcagacccagccccaucggcuaccugggccugcugagccagagaaccagagacaucuacaucagcagaagacugcugggcaccuucaccuggacccugagcgacagcgagggcaacgagacccccggcggcuacugccugaccagauggaugcugaucgaggccgagcugaagugcuucggcaacaccgccguggccaagugcaacgagaagcacgacgaggaguucugcgacaugcugagacuguucgacuucaacaagcaggccaucagaagacugaagaccgaggcccagaugagcauccagcugaucaacaaggccgugaacgcccugaucaacgaccagcugaucaugaagaaccaccugagagacaucaugggcauccccuacugcaacuacagcagauacugguaccugaaccacaccagcaccggcaagaccagccugcccagaugcuggcugaucagcaacggcagcuaccugaacgagaccaaguucagcgacgacaucgagcagcaggccgacaacaugaucaccgagaugcugcagaaggaguacaucgacagacagggcaagaccccccugggccugguggaccuguucguguucagcaccagcuucuaccugaucagcaucuuccugcaccuggugaagauccccacccacagacacaucgugggcaagcccugccccaagccccacagacugaaccacaugggcaucugcagcugcggccuguacaagcagcccggcgugcccgugagauggaagagauga

SEQ ID NO: 2061 - RNA, 1476 nt, Artificial Sequence; identical to SEQ ID NO: 1881
  derived and/or modified CDS sequence (opt4) from Lassa virus__NP_694870__GPC

SEQ ID NO: 2062 - RNA, 1713 nt, Artificial Sequence
  derived and/or modified CDS sequence (opt4) from Lassa virus__AAA46284__NP
augagcgccagcaaggaggugagaagcugccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacggcgaccugaagagacugagagaccugaaccaggccgugaacaaccugguggagcugaagagcacccagcagaagagcgugcugagagugggcacccugagcagcgacgaccugcugauccuggccgccgaccuggagaagcugaagagcaaggugaccagaaccgagagaccccugagcagcggcguguacaugggcaaccugagcagccagcagcuggaccagagaagagcccugcugaacaugaucggcaugaccggcgugagcggcggcggcaagggcgccagcaacggcaucgugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacagcagcgaccuggacagacugagccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaagagccugggcauguucgugagcgacacccccggcgagagaaaccccuacgagaacauccuguacaagaucugccugagcggcgacggcuggagcuacaucgccagcagaaccagcaucgugggcagagccugggagaacaccgugguggaccuggagcaggacaacaagccccagaagaucggcaacggcggcagcaacaagagccugcagagcgccggcuucgccgccggccugaucuacagccagcugaugacccugaaggacuucaagugcuucaaccugauccccaacgccaagaccuggauggacaucgagggcagacccgaggaccccguggagaucgcccuguaccagcccagcagcggcugcuacgugcacuucuucagagagcccaccgaccugaagcaguucaagcaggacgccaaguacagccacggcagagacgugaccgaccuguucgccgcccagcccggccugaccagcgccgugaucgaggcccugcccagaaacauggugaucaccugccagggcagcgaggacaucagaaagcugcuggagagccagggcagaagagacaucaagcugaucgacaucacccugagcaaggccgacagcagaaaguucgagaacgccgugugggaccaguucaaggaccugugccacaugcacaccggcguggugguggagaagaagaagagaggcggcaaggaggagaucaccccccacugcgcccugauggacugcaucauguucgacgccgccgugagcggcggccuggacgccaaggugcugagaguggugcugcccagagacaugguguucagaaccagcacccccaagguggugcuguga

SEQ ID NO: 2063 - RNA, 1710 nt, Artificial Sequence
  derived and/or modified CDS sequence (opt4) from Lassa virus__AAF86704__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugaacaacgugcagagacugaugagaaagcagaagagagacgacggcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagaagcugcuggacagccagggcagaagagacaucaagcugaucgacaucagccugagcaagguggacagcagaaaguucgagaacgccgugugggaccagugcaaggaccugugccacaugcacaccggcguggugguggagaagaagaagagaggcggcaaggaggagaucaccccccacugcgcccugauggacugcaucauguucgacgccgccgugagcggcggccugaacauccccgugcugagagccgugcugcccagagacaugguguucagaaccagcagccccaagguggugcuguga

SEQ ID NO: 2064 - RNA, 1710 nt, Artificial Sequence
  derived and/or modified CDS sequence (opt4) from Lassa virus__AAO59513__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacagcgaccugaagagacugagagaccugaaccaggccgugaacaaccugguggagcugaagagcacccagcagaagagcgugcugagagugggcacccugaccagcgacgaccugcuggugcuggccgccgaccuggagaagcugagaagcaaggugaccagaaccgagagaccccugagcgccggcguguacaugggcaaccugagcagccagcagcuggaccagagaagagcccugcugagcaugaucggcaugaacggcagcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacgugagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacgagaagccccagaaggccggcagcaacaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacaucaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugaacaaggccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaagacccuggugcugagagccgugcugcccagagacaugguguucagaaccagcacccccagaguggugcuguga

SEQ ID NO: 2065 - RNA, 1710 nt, Artificial Sequence
  derived and/or modified CDS sequence (opt4) from Lassa virus__AAT48999__NP
augagcgugagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcggcaaccagggcgcccagaccggcagagacggcguggugagaaucugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcggcgagaagccccagaagaucggcagcaacaacagcaacaagugccugcagagcgccggcuucaccgccggccugagcuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaugaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagaagggcggcaaggaggagaucaccccccacugcgcccugauggacugcaucauguucgacgccgccgugagcggcggccugaacaccagcgugcugagagccgugcugcccagagacaugguguucagaaccagcacccccaagguggugcuguga

SEQ ID NO: 2066 - RNA, 1710 nt, Artificial Sequence
  derived and/or modified CDS sequence (opt4) from Lassa virus__AAT49007__NP
augagcgugagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaccagaaccgagagaccccugagcgccggcaucuacaugggcaaccugagcagccagcagcuggaccagagaagagcccugcugaacaugaucggcaugagcggcggcaaccagggcgcccagaccggcagagacggcguggugagaaucugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcggcgagaagccccagaagaucggcagcaacaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaugaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagaagggcggcaaggaggagaucaccccccacugcgcccugauggacugcaucauguucgacgccgccgccagcggcggccugaacacccuggugcugagagccgugcugcccagagacaugguguucagaaccagcacccccaagguggugcuguga

SEQ ID NO: 2067 - RNA, 1710 nt, Artificial Sequence
  derived and/or modified CDS sequence (opt4) from Lassa virus__AAT49009__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacggcgaccugaagagacugagagaccugaaccaggccgugaacaaccugguggagcugaagagcacccagcagaagagcgugcugagagugggcacccugaacagcgacgaccugcuggugcuggccgccgaccuggagaagcugaagagcaaggugaucagaaccgagagaccccugagcagcggcaucuacaugggcaaccugagcagccagcagcuggaccagagaagagcccugcugaacaugaucggcaugaccggcggcaacagaggcggcggcaccagcagcgacggcaucgugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacagcagcgaccuggacagacuggcccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccaucgacggcauccugaagaccauccugaaggugaagaagagccugggcauguucaucagcgacgugcccggcgagagaaaccccuacgagaacauccuguacaagaucugccugagcggcgacggcuggcccuacaucgccagcagaaccagcaucgugggcagagccugggagaacaccgugguggaccuggagagcgacaacaagccccagaagaccggcaacggcggcagcaacaagagccugcagagcgccggcuucgccgccggccugaccuacagccagcugaugacccugaaggacagcaugcugcagcuggaccccaacagcaagaccuggauggacaucgagggcagacccgaggaccccguggagaucgcccuguaccagcccaacagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgaggacaucagaaagcugcuggagagccagggcagaagagacaucaagcugaucgacaucagccugaacaaggccgacagcagaaaguucgagaacgccgugugggaccaguucaaggaccugugccacaugcacaccggcguggugguggagaagaagaagagaggcggcaaggaggagaucaccccccacugcgcccugauggacugcaucauguucgacgccgccgugagcggcggccuggacgccaaggugcugagagccgugcugcccagagacaugguguucagaaccagcacccccaagguggugcuguga

SEQ ID NO: 2068 - RNA, 1710 nt, Artificial Sequence
  derived and/or modified CDS sequence (opt4) from Lassa virus__ADI39452__NP
augagcgugagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagaccaaggugaccagaaccgagagaccccugagcgccggcguguacaugggcaaccugagcagccagcagcuggagcagagaagagcccugcugaacaugaucggcaugaacggcggcaaccagggcgugcaggccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacuggcccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagagaacccugggcauguucgugagcgacacccccggcgagagaaaccccuacgagaacauccuguacaagaucugccugagcggcgacggcuggcccuacaucgccagcagaaccagcaucaccggcagagccugggagaacaccaucguggaccuggagagcgacggcaagccccagaaggugggcaacaacggcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgaggacgugagaaagcugcuggagagccagggcagaaaggacaucaagcugaucgacaucgcccugagcaaggccgacagcagaaaguacgagaacgccgugugggaccaguacaaggaccugugccacaugcacaccggcguggugguggagaagaagaagagaggcggcaaggaggagaugaccccccacugcgcccugauggacugcaucauguucgacgccgccgugagcggcggccugagcacccaggugcugagagccgugcugcccagagacaugguguucagaaccagcacccccaagguggugcuguga

SEQ ID NO: 2069 - RNA, 1710 nt, Artificial Sequence
  derived and/or modified CDS sequence (opt4) from Lassa virus__ADU56611__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacggcgaccugaagagacugagagaccugaaccaggccgugaacaaccugguggagcugaagagcacccagcagaagagcgugcugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaaaggcccugcugagcaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacgugaccgaccuguucagcgcccagcccggccugaccagcgccgugaucgaggcccugcccagaaacauggugcugaccugccagggcagcgacgacaucaagaagcugcuggacagccagggcagaagagacaucaagcugaucgacaucagccugaacaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguucgacgccgccgugagcggcggccugaacauccccauccugagagccgugcugcccagagacaugguguucagaaccagcagccccaagguggugcuguga

SEQ ID NO: 2070 - RNA, 1710 nt, Artificial Sequence
  derived and/or modified CDS sequence (opt4) from Lassa virus__ADU56615__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcgugcugagaaucggcacccugagcagcgacgaccugcugauccuggccgccgaccuggagaagcugaagagcaagguggugagaaccgagagaccccugagcagcggcaucuacaugggcaaccugagcagccagcagcuggaccagagaaaggcccugcugaacaugaucggcaugaccggcggcaacggcggcagaaacgccaccagcgacggcaucgugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacagcagcgaccuggacagacuggcccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagagaagccugggcauguucaucagcgacacccccggcgagagaaaccccuacgagaacauccuguacaagaucugccugagcggcgacggcuggcccuacaucgccagcagaaccagcaucgugggcagagccugggagaacaccgugguggaccuggagaccgacaacaagccccagaagaccggcaacggcggcagcaacaagagccugcagagcgccggcuucgccgccggccugaccuacagccagcugaugacccugaaggacagcaugcugcagcuggaccccaacgccaagaccuggauggacaucgagggcagacccgaggaccccguggagaucgcccuguaccagcccgugagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgaggacaucagaaagcugcuggagagccagggcagaagagacaucaagcugaucgacaucagccugagcaagguggacagcagaaaguucgagaacgccgugugggaccaguucaaggaccugugccacaugcacaccggcaucgugguggagaagaagaagagaggcggcaaggaggagaucaccccccacugcgcccugauggacugcaucauguucgacgccgccgugagcggcggcguggacgccaaggugcugagagccgugcugcccagagacaugguguucagaaccagcacccccaagguggugcuguga

SEQ ID NO: 2071 - RNA, 1710 nt, Artificial Sequence
  derived and/or modified CDS sequence (opt4) from Lassa virus__ADU56619__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacggcgaccugaagagacugagagaccugaaccaggccgugaacaaccugguggagcugaagagcacccagcagaagagcgugcugagagugggcacccugagcagcgacgaccugcuggugcuggccgccgaccuggagaagcugaagagcaagguggugagaaccgagagaccccugagcagcggcaucuacaugggcaaccugagcagccagcagcuggaccagagaaaggcccugcugaacaugaucggcaugaccggcggcaacggcggcagaaacaccaccagcgacggcaucgugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacagcagcgaccuggacagacuggcccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagagaagccugggcauguucaucagcgacacccccggcgagagaaaccccuacgagaacauccuguacaagaucugccugagcggcgacggcuggcccuacaucgccagcagaaccagcaucgugggcagagccugggagaacaccgugguggaccuggagagcgacaacaagccccagaagaccggcaacggcggcagcaacaagagccugcagagcgccggcuucgccgccggccugaccuacagccagcugaugacccugaaggacagcaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgaggacaucagaaagcugcuggagagccagggcagaagagacaucaagcugaucgacaucagccugagcaagguggacagcagaaaguucgagaacgccgugugggaccaguucaaggaccugugccacaugcacaccggcaucgugguggagaagaagaagagaggcggcaaggaggagaucaccccccacugcgcccugauggacugcaucauguucgacgccgccgugagcggcggcguggacgccaaggugcugagagccgugcugcccagagacaugguguucagaaccagcacccccaagguggugcuguga

SEQ ID NO: 2072 - RNA, 1710 nt, Artificial Sequence
  derived and/or modified CDS sequence (opt4) from Lassa virus__ADU56623__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaaccugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuucaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccacaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2073 - RNA, 1710 nt, Artificial Sequence
  derived and/or modified CDS sequence (opt4) from Lassa virus__ADU56627__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugaacacccagcagcuggagcagagaagagcccugcugaacaugaucggcauggccggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2074 - RNA, 1710 nt, Artificial Sequence
  derived and/or modified CDS sequence (opt4) from Lassa virus__ADU56631__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacgugaccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2075 - RNA, 1710 nt, Artificial Sequence
  derived and/or modified CDS sequence (opt4) from Lassa virus__AFY05580__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugagaagcaaggugaucagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacgccgagcugcugagcaaccaguucggcaccauccccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcggcggcaagccccagaaggccgacagcaacaacagcagcaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccacccagcccggccugaccagcgccgugaucgacgcccugcccagaaacauggugaucaccugccagggcagcgacgacaucagaaagcugcuggagagccagggcagaaaggacaucaagcugaucgacaucgaccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2076 - RNA, 1710 nt, Artificial Sequence
  derived and/or modified CDS sequence (opt4) from Lassa virus__AFY05581__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaucagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacgccgagcugcugagcaaccaguucggcaccauccccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcggcggcaagccccagaaggccgacagcaacaacagcagcaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccacccagcccggccugaccagcgccgugaucgacgcccugcccagaaacauggugaucaccugccagggcagcgacgacaucagaaagcugcuggagagccagggcagaaaggacaucaagcugaucgacaucgaccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugaaggccgugcugcccagagacaugguguucagaaccagcacccccagaguggugcuguga

SEQ ID NO: 2077 - RNA, 1710 nt, Artificial Sequence
  derived and/or modified CDS sequence (opt4) from Lassa virus__AFY05587__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugagaagcaaggugaucagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacgccgagcugcugagcaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccgacagcaacaacagcagcaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccacccagcccggccugaccagcgccgugaucgacgcccugcccagaaacauggugaucaccugccagggcagcgacgacaucagaaagcugcuggagagccagggcagaaaggacaucaagcugaucgacaucgaccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2078 - RNA, 1710 nt, Artificial Sequence
  derived and/or modified CDS sequence (opt4) from Lassa virus__AFY05591__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaucagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacguggagcugcugagcaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacuggcccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccgacagcaacaacagcagcaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccacccagcccggccugaccagcgccgugaucgacgcccugcccagaaacauggugaucaccugccagggcagcgacgacaucagaaagcugcuggagagccagggcagaaaggacaucaagcugaucgacaucgaccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2079 - RNA, 1710 nt, Artificial Sequence
  derived and/or modified CDS sequence (opt4) from Lassa virus__AFY05597__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaucagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacgccgagcugcugagcaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccgacagcaacaacagcagcaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccacccagcccggccugaccagcgccgugaucgacgcccugcccagaaacauggugaucaccugccagggcagcgacgacaucagaaagcugcuggagagccagggcagaaaggacaucaagcugaucgacaucgaccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2080 - RNA, 1710 nt, Artificial Sequence
  derived and/or modified CDS sequence (opt4) from Lassa virus__AFY05610__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaucagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacgccgagcugcugagcaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccgacagcaacaacagcagcaagagccugcagagcgccggcuucaccgccggccugaccuacagccagcugaugacccugaaggacgccaugcugcagcuggaccccaacaccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccacccagcccggccugaccagcgccgugaucgacgcccugcccagaaacauggugaucaccugccagggcagcgacgacaucagaaagcugcuggagagccagggcagaaaggacaucaagcugaucgacaucgaccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2081 - RNA, 1710 nt, Artificial Sequence
  derived and/or modified CDS sequence (opt4) from Lassa virus__AFY05616__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaucagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacgccgagcugcugagcaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacuggcccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccgacagcaacaacagcagcaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccacccagcccggccugaccagcgccgugaucgacgcccugcccagaaacauggugaucaccugccagggcagcgacgacaucagaaagcugcuggagagccagggcagaaaggacaucaagcugaucgacaucgaccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2082 - RNA, 1716 nt, Artificial Sequence
  derived and/or modified CDS sequence (opt4) from Lassa virus__AFY05618__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugagaagcaaggugaucagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacgccgagcugcugagcaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccgacagcaacaacagcagcaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcagaagcaguucaagcaggacgccaaguacagccacggcaucgacgugaccgaccuguucgccacccagcccggccugaccagcgccgugaucgacgcccugcccagaaacauggugaucaccugccagggcagcgacgacaucagaaagcugcuggagagccagggcagaaaggacaucaagcugaucgacaucgaccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2083 - RNA, 1710 nt, Artificial Sequence
  derived and/or modified CDS sequence (opt4) from Lassa virus__AHC95552__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacggcgaccugaagagacugagagaccugaaccaggccgugaacaaccugguggagcugaagagcacccagcagaagaacgugcugagagugggcacccugaacagcgacgaccugcugacccuggccgccgaccuggagaagcugaagagcaaggugaccagaaccgagagaccccugagcagcggcguguacaugggcaaccugagcagccagcagcuggaccagagaagagcccugcugaacaugaucggcaugaccggcggcaaccagggcacccaggccggcagagacggcguggugagagugugggacgugaagaacgccgagcugcugaacaaccaguucggcaccaugcccagccugacccuggccugccugaccaagcagggccaggccgaccugaacgacguggugcaggcccugaccgaccugggccugaucuacaccgccaaguaccccaacgccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagagcauggacggcauccugaagagcauccugaaggugaagagagcccugggcauguucgugagcgacacccccggcgagagaaaccccuacgagaacauccuguacaagaucugccugagcggcgacggcuggcccuacaucgccagcagaaccagcaucgugggcagagccugggagaacaccgugguggaccuggaggccgacggcaaccccaagaagcugaacagcaacggcagcaacaagagccugcagagcgccggcuuccccgccggccugaccuacagccagcugaugacccugaaggacgccaugcugcagcuggaccccaacgccaagaccuggauggacaucgagggcagacccgaggaccccguggagguggcccuguaccagcccaacagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgaggacaucagaaagcugcuggagagccagggcagaaaggacaucaagcugaucgacaucgcccugagcaagaccgacagcagaaaguucgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacacccuggugcugagagccgugcugcccagagacaugguguucagaaccagcacccccagaguggugcuguga

SEQ ID NO: 2084 - RNA, 1710 nt, Artificial Sequence
  derived and/or modified CDS sequence (opt4) from Lassa virus__AHC95554__NP
augagcgccagcaaggaggugagaagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacggcgaccugaagagacugagagaccugaaccaggccgugaacaaccugguggagcugaagagcacccagcagaagagcgugcugagagugggcacccugaacagcgacgaccugcugacccuggccgccgaccuggagaagcugaagagcaaggugaccagaaccgagagaccccugagcagcggcguguacaugggcaaccugagcagccagcagcuggaccagagaagagcccugcugaacaugaucggcaugaccggcggcaaccagggcgcccaggccggcagagacggcguggugagagugugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaagaucagcccccagagcguggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccgugguggaccuggaggccgacggcaagccccagaagcccaacagcggcagcagcaacaagagccugcagagcgccggcuuccccgccggccugaccuacagccagcugaugacccugaaggacgccaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgaggacaucaagaagcugcuggagagccagggcagaaaggacaucaagcugaucgacaucgcccugagcaagaucgacagcagaaaguucgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacgccagcgugcugagagccgugcugcccagagacaugguguucagaaccagcacccccaagguggugcuguga

SEQ ID NO: 2085 - RNA, 1710 nt, Artificial Sequence
  derived and/or modified CDS sequence (opt4) from Lassa virus__AHC95556__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacggcgaccugaagagacugagagaccugaaccaggccgugaacaaccugguggagcugaagagcacccagcagaagaacgugcugagagugggcacccugaacagcgacgaccugcugacccuggccgccgaccuggagaagcugaagagcaaggugaccagaaccgagagaccccugagcagcggcguguacaugggcaaccugagcagccagcagcuggaccagagaagagcccugcugaacaugaucggcaugaccggcggcaaccagggcacccagaccggcagagacggcguggugagagugugggacgugaagaacgccgagcugcugaacaaccaguucggcaccaugcccagccugacccuggccugccugaccaagcagggccaggccgaccugaacgacguggugcaggcccugaccgaccugggccugaucuacaccgccaaguaccccaacgccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagagcauggacggcauccugaagagcauccugaaggugaagagagcccugggcauguucgugagcgacacccccggcgagagaaaccccuacgagaacauccuguacaagaucugccugagcggcgacggcuggcccuacaucgccagcagaaccagcaucgugggcagagccugggagaacaccgugguggaccuggaggccgacggcaaccccaagaagcugaacagcaacggcagcaacaagagccugcagagcgccggcuuccccgccggccugaccuacagccagcugaugacccugaaggacgccaugcugcagcuggaccccaacgccaagaccuggauggacaucgagggcagacccgaggaccccguggagguggcccuguaccagcccaacagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgaggacaucagaaagcugcuggagagccagggcagaaaggacaucaagcugaucgacaucgcccugagcaagaccgacagcagaaaguucgagaacgccgugugggaccagcacaaggaccugugccacaugcacaccggcguggugguggagaagaagaagagaggcggcaaggaggagaucaccccccacugcgcccugauggacugcaucauguucgacgccgccgugagcggcggccugaacacccuggugcugagagccgugcugcccagagacaugguguucagaaccagcacccccaagguggugcuguga

SEQ ID NO: 2086 - RNA, 1710 nt, Artificial Sequence
  derived and/or modified CDS sequence (opt4) from Lassa virus__AHC95558__NP
augagcgccagcaaggaggugagaagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacagcgaccugaagagacugagagaccugaaccaggccgugaacaaccugguggagcugaagagcacccagcagaagagcgugcugagagugggcacccugagcagcgacgaccugcugacccuggccgccgaccuggagaagcugaagagcaaggugaucagaaccgagagaccccugagcagcggcguguacaugggcaaccugagcagccagcagcuggaccagagaagagcccugcugaacaugaucggcaugaccggcggcaaccagggcgcccaggccggcagagacggcguggugagagugugggacgugagaaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagaaccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagagcaucgacggcauccugaagagcauccugaaggugaagagaacccugggcauguucgugagcgacacccccggcgagagaaaccccuacgagaacauccuguacaagaucugccugagcggcgacggcuggcccuacaucgccagcagaaccagcaucgugggcagagccugggagaacaccgugguggaccuggagaccgacagaaagagccagggccccaacagcggcaacagcaacaagagccugcagagcgccggcuucagcgccggccugaccuacagccagcugaugacccugaaggacgccaugcugcagcuggaccccaacgccaagaccuggauggacaucgagggcagacccgaggaccccguggagguggcccuguaccagcccaucagcggcugcuacauccacuucuucagagagcccaccgaccugaagcaguucaagcaggacgccaaguacagccacggcaucgacaucaccgaccuguucgccgcccagcccggccugaccagcgccgugaucgaggcccugcccagaaacauggugaucaccugccagggcagcgaggacaucaagaagcugcuggagagccagggcagaaaggacaucaagcugaucgacaucgcccugagcaagaucgacagcagaaaguucgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacgccagcgugcugagagccgugcugcccagagacaugguguucagaaccagcacccccaagguggugcuguga

SEQ ID NO: 2087 - RNA, 1710 nt, Artificial Sequence
  derived and/or modified CDS sequence (opt4) from Lassa virus__AHC95560__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacggcgaccugaagagacugagagaccugaaccaggccgugaacaaccugguggagcugaagagcacccagcagaagaacgugcugagagugggcacccugaacagcgacgaccugcugacccuggccgccgaccuggagaagcugaagagcaaggugaccagaaccgagagaccccugagcagcggcguguacaugggcaaccugagcagccagcagcuggaccagagaagagcccugcugaacaugaucggcaugagcggcggcaaccagggcacccaggugggcagagacggcguggugagagugugggacgugaagaacgccgagcugcugaacaaccaguucggcaccaugcccagccugacccuggccugccugaccaagcagggccaggccgaccugaacgacguggugcaggcccugaccgaccugggccugaucuacaccgccaaguaccccaacgccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagagcauggacggcauccugaagagcauccugaaggugaagagagcccugggcauguucgugagcgacacccccggcgagagaaaccccuacgagaacauccuguacaagaucugccugagcggcgacggcuggcccuacaucgccagcagaaccagcaucgugggcagagccugggagaacaccgugguggaccuggaggccgacggcaaccccaagaagcugaacagcaacggcagcaacaagagccugcagagcgccggcuuccccgccggccugaccuacagccagcugaugacccugaaggacgccaugcugcagcuggaccccaacgccaagaccuggauggacaucgagggcagacccgaggaccccguggagguggcccuguaccagcccaacagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgaggacaucagaaagcugcuggagagccagggcagaaaggacaucaagcugaucgacaucgcccugagcaagaccgacagcagaaaguucgagaacgccgugugggaccagcacaaggaccugugccacaugcacaccggcguggugguggagaagaagaagagaggcggcaaggaggagaucaccccccacugcgcccugauggacugcaucauguucgacgccgccgugagcggcggccugaacacccuggugcugagagccgugcugcccagagacaugguguucagaaccagcacccccaagguggugcuguga

SEQ ID NO: 2088 - RNA, 1710 nt, Artificial Sequence
  derived and/or modified CDS sequence (opt4) from Lassa virus__AIT17127__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaucagaaccgagagaccccugagcgccggcguguacaugggcaaccugagcagccagcagcuggaccagagaagagcccugcugagcaugaucggcaugagcggcggcaaccagggcgugagagccggcaaggacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucaccgccggccugaccuacagccagcugaugacccugaaggacgccaugcugcagcuggaccccaacaccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugaacaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2089 - RNA, 1710 nt, Artificial Sequence
  derived and/or modified CDS sequence (opt4) from Lassa virus__AIT17131__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugagcagcgacgaccugcuggugcuggccgccgaccuggagaagcugaagagcaaggugaccagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugguggacaccaagaagagcagccugaacaucagcggcuacaacuucagccugggcgccgccgugaaggccggcgccugcaugcuggacggcggcaacaugcuggagaccaucaaggugagcccccagaccaucgacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucaccgccggccugaccuacagccagcugaugacccugaaggacgccaugcugcagcuggaccccaacgccaagaucuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcgccgacgacaucagaaagcugcuggagagccagggcagaaaggacaucaagcugaucgacaucgcccugaacaaggccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2090 - RNA, 1710 nt, Artificial Sequence
  derived and/or modified CDS sequence (opt4) from Lassa virus__AIT17139__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacagcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucgccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccaccacccccagaguggugcuguga

SEQ ID NO: 2091 - RNA, 1710 nt, Artificial Sequence
  derived and/or modified CDS sequence (opt4) from Lassa virus__AIT17143__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcagcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcaacaacggcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaaccuggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2092 - RNA, 1710 nt, Artificial Sequence
  derived and/or modified CDS sequence (opt4) from Lassa virus__AIT17147__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaccagaaccgagagaccccugagcgccggcguguacaugggcaaccugagcagccagcagcuggagcagagaagagcccugcugaacaugaucggcaugagcggcagcaaccagggcgcccaggccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgugaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccgacagcaacagcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2093 - RNA, 1710 nt, Artificial Sequence
  derived and/or modified CDS sequence (opt4) from Lassa virus__AIT17151__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugagcaugaucggcaugagcggcggcaaccagggcgccagagccggcagagacggcguggugagagugugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagcugcagaaggccggcagcaacaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugaacaagaccgacagcagaaaguacgagaacgccgugugggaccaguacaaggaccugugccacaugcacaccggcguggugguggagaagaagaagaagggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2094 - RNA, 1710 nt, Artificial Sequence
  derived and/or modified CDS sequence (opt4) from Lassa virus__AIT17155__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcgugcugagagugggcacccugaccagcgacgagcugcuggugcuggccgccgaccuggagaagcugaagagcaaggugaucagaaccgagagaccccugagcgccggcguguacaugggcaaccugagcagccagcagcuggaccagagaagagcccugcugagcaugaucggcaugagcggcggcaaccagggcgccagaaccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaucgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacagccuggugcugagagccgugcugcccagagacaugguguucagaaccagcacccccagaguggugcuguga

SEQ ID NO: 2095 - RNA, 1710 nt, Artificial Sequence
  derived and/or modified CDS sequence (opt4) from Lassa virus__AIT17161__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcagcaaccagggcgccagaaccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacagcagcaacaagagccugcagagcgccggccugaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaaccuggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacgccagcgugcugagagccgugcugcccagagacaugguguucagaaccagcacccccagaguggugcuguga

SEQ ID NO: 2096 - RNA, 1710 nt, Artificial Sequence
  derived and/or modified CDS sequence (opt4) from Lassa virus__AIT17165__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugaacaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcaacggcaaccagggcaccagagccggcagagacggcguggugagagugugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccgacagcagcaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaaggccgacagcagaaaguacgagaacgccgugugggaccagcacaaggaccugugccacaugcacaccggcguggugguggagaagaagaagagaggcggcaaggaggagaucaccccccacugcgcccugauggacugcaucauguacgacgccgccgugagcggcggccugaacaccagcgugcugagagccgugcugcccagagacaugguguucagaaccagcacccccagaguggugcuguga

SEQ ID NO: 2097 - RNA, 1710 nt, Artificial Sequence
  derived and/or modified CDS sequence (opt4) from Lassa virus__AIT17169__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaucagaaccgagagaccccugagcgccggcguguacaugggcaaccugagcagccagcagcuggaccagagaagagcccugcugagcaugaucggcaugagcagcggcaaccagagagcccaggccggcagagacggcguggugagagugugggacgugaagaacguggagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgugggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2098 - RNA, 1710 nt, Artificial Sequence
  derived and/or modified CDS sequence (opt4) from Lassa virus__AIT17173__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcagcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacgcccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacggcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcuguucgagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2099 - RNA, 1710 nt, Artificial Sequence
  derived and/or modified CDS sequence (opt4) from Lassa virus__AIT17177__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacaacgaccugaagagacugagagaccugaaccaggccgugaacaaccugguggagcugaagagcacccagcagaagagcgugcugagagugggcacccugaccagcgacgaccugcuggugcuggccgccgaccuggagaagcugaagagcaaggugaucagaaccgagagaccccugagcgccggcaucuacaugggcaaccugagcagccagcagcuggaccagagaagagcccugcugaacaugaucggcaugagcggcggcaaccagggcgccagagccggcagagacggcguggugagagugugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaagaugaucgacgccaacaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaagagccugggcauguucaucagcgacacccccggcgagagaaaccccuacgagaacauccuguacaagaucugccugagcggcgacggcuggcccuacaucgccagcagaaccagcaucaucggcagagccugggagaacaccgugguggaccuggagagcgacggcaagccccagaagaccggcagcaacaacagcagcaagagccugcagagcgccggcuucgccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacacccuggugcugagagccgugcugcccagagacaugguguucagaaccagcacccccaagguggugcuguga

SEQ ID NO: 2100 - RNA, 1710 nt, Artificial Sequence
  derived and/or modified CDS sequence (opt4) from Lassa virus__AIT17181__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacaacgaccugaagagacugagagaccugaaccaggccgugaacaaccugguggagcugaagagcacccagcagaagagcgugcugagagugggcacccugaccagcgacgaccugcuggugcuggccgccgaccuggagaagcugaagagcaaggugaucagaaccgagagaccccugagcgccggcguguacaugggcaaccugagcagccagcagcuggaccagagaagagcccugcugaacaugaucggcaugagcggcggcauccagggcaccagaaccggcagagacggcguggugagagugugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacgccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaagacccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucgccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgacgacaucaagaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacacccuggugcugagagccgugcugcccagagacaugguguucagaaccagcacccccagaguggugcuguga

SEQ ID NO: 2101 - RNA, 1710 nt, Artificial Sequence
  derived and/or modified CDS sequence (opt4) from Lassa virus__AIT17185__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacggcgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcggcaacagaggcgccagaaccggcaaggacggcguggugagaaucugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaacaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaagagccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacgagaagccccagaaggccggcagcaacaacagcaacaagagccugcagagcaccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacacccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacgccagcgugcugagagccgugcugcccagagacaugguguucagaaccagcacccccagaguggugcuguga

SEQ ID NO: 2102 - RNA, 1710 nt, Artificial Sequence
  derived and/or modified CDS sequence (opt4) from Lassa virus__AIT17189__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugagcaugaucggcaugagcggcggcaaccagggcgccagaaccggcagagacggcguggugagagugugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccaucgacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacagccuggugcugagagccgugcugcccagagacaugguguucagaaccagcacccccagaguggugcuguga

SEQ ID NO: 2103 - RNA, 1710 nt, Artificial Sequence
  derived and/or modified CDS sequence (opt4) from Lassa virus__AIT17193__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugagcaugaucggcaugagcggcggcaaccagggcgccagaaccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcaacaacaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacagccuggugcugagagccgugcugcccagagacaugguguucagaaccagcacccccagaguggugcuguga

SEQ ID NO: 2104 - RNA, 1710 nt, Artificial Sequence
  derived and/or modified CDS sequence (opt4) from Lassa virus__AIT17197__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaucagaaccgagagaccccugagcgccggcguguacaugggcaaccugagccugcagcagcuggaccagagaagagcccugcugaacaugaucggcaugagcggcagcaaccagggcgugagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacggcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2105 - RNA, 1710 nt, Artificial Sequence
  derived and/or modified CDS sequence (opt4) from Lassa virus__AIT17201__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcagcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacgcccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacggcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucaagaagcuguucgagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2106 - RNA, 1710 nt, Artificial Sequence
  derived and/or modified CDS sequence (opt4) from Lassa virus__AIT17205__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaaaggcccugcugaacaugaucggcaugagcggcagcaaccagggcgccagaaucggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacagcagcaacaagagccugcagagcgccggccugaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaaccuggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacgccagcgugcugagagccgugcugcccagagacaugguguucagaaccagcacccccagaguggugcuguga

SEQ ID NO: 2107 - RNA, 1710 nt, Artificial Sequence
  derived and/or modified CDS sequence (opt4) from Lassa virus__AIT17209__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugagcaugaucggcaugagcggcggcaaccagggcgccagagccggcagagacggcguggugagagugugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagcugcagaagaccggcagcaacaacagcaacaagagccugcagagcgccggcuucaccgccggccugaccuacagccagcugaugacccugaaggacgccaugcugcagcuggaccccaacgccaagaucuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugaacaagaccgacagcagaaaguacgagaacgccgugugggaccaguacaaggaccugugccacaugcacaccggcguggugguggagaagaagaagaagggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2108 - RNA, 1710 nt, Artificial Sequence
  derived and/or modified CDS sequence (opt4) from Lassa virus__AIT17211__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcggcaaccagggcgcccaggccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccaacagcaacagcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2109 - RNA, 1710 nt, Artificial Sequence
  derived and/or modified CDS sequence (opt4) from Lassa virus__AIT17213__NP
augagcgccagcaaggagaucaagagcuuccuguggacccagagccugagaagagagcuggccggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaucagaaccgagagaccccugagcgccggcguguacaugggcaaccugagcagccagcagcuggaccagagaagagcccugcugaacaugaucggcaugagcggcagcaaccagggcgugagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacggcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2110 - RNA, 1710 nt, Artificial Sequence
  derived and/or modified CDS sequence (opt4) from Lassa virus__AIT17217__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugagcaugaucggcaugagcagcggcgugcagggcgccagagccggcagagacggcguggugagagugugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgagacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcaccggcuucgccgccggccugaccuacagccagcugaugacccugaaggacgccaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucaagaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2111 - RNA, 1710 nt, Artificial Sequence
  derived and/or modified CDS sequence (opt4) from Lassa virus__AIT17225__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacaacgaccugaagagacugagagaccugaaccaggccgugaacaaccugguggagcugaagagcacccagcagaagagcgugcugagagugggcacccugaccagcgacgaccugcuggugcuggccgccgaccuggagaagcugaagagcaaggugaccagaaccgagagaccccugagcgccggcguguacaugggcaaccugagcagccagcagcuggaccagagaagagcccugcugaacaugaucggcaugagcggcggcaaccagggcgccagagccggcaacgacggcguggugagagugugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaagaccggcaacaacagcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgacgacaucagaaagcugcuggagagccagggcagaaaggacaucaagcugaucgacaucgcccugagcaagaucgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacacccuggugcugagagccgugcugcccagagacaugguguucagaaccagcacccccaagguggugcuguga

SEQ ID NO: 2112 - RNA, 1710 nt, Artificial Sequence
  derived and/or modified CDS sequence (opt4) from Lassa virus__AIT17229__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaucagaaccgagagaccccugagcgccggcguguacaugggcaaccugagcagccagcagcuggaccagagaagagcccugcugagcaugaucggcaugagcggcggcaaccagggcaccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaaggccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2113 - RNA, 1710 nt, Artificial Sequence
  derived and/or modified CDS sequence (opt4) from Lassa virus__AIT17233__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcuggugcuggccgccgaccuggagaagcugaagagcaaggugaccagaaccgagagaccccugagcgccggcguguacaugggcaaccugagcagccagcagcuggaccagagaagagcccugcugagcaugaucggcaugagcggcggcaaccagggcgcccaggccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2114 - RNA, 1710 nt, Artificial Sequence
  derived and/or modified CDS sequence (opt4) from Lassa virus__AIT17237__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugagcaugaucggcaugagcggcggcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2115 - RNA, 1710 nt, Artificial Sequence
  derived and/or modified CDS sequence (opt4) from Lassa virus__AIT17241__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugagcaugaucggcaugagcggcggcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcuguucgagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2116 - RNA, 1710 nt, Artificial Sequence
  derived and/or modified CDS sequence (opt4) from Lassa virus__AIT17245__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcagcaaccagggcgccagaaccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggccugaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacguggccgaccuguucgccgcccagcccggccugaccagcgccgugaucgacgcccugcccagaaaccuggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacgccagcgugcugagagccgugcugcccagagacaugguguucagaaccagcacccccagaguggugcuguga

SEQ ID NO: 2117 - RNA, 1710 nt, Artificial Sequence
  derived and/or modified CDS sequence (opt4) from Lassa virus__AIT17247__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacagcgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaucagaaccgagagaccccugagcagcggcguguacaugggcaaccugagcagccagcagcuggaccagagaagagcccugcugaacaugaucggcaugagcggcggcaaccagggcgcccaggugggcagagacggcguggugagagugugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacuggcccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgagacccccggcgagagaaaccccuacgagaacauccuguacaagaucugccugagcggcgacggcuggcccuacaucgccagcagaaccagcaucaccggcagagccugggagaacaccaucguggaccuggagagcgacggcaagccccagaaggccggcagcaacaacagcaacaagagccugcagagcgccggcuucaccgccggccugaccuacagccagcugaugacccugaaggacagcaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgacgacaucagaaagcugcuggagagccagggcagaaaggacaucaagcugaucgacaucgcccugaacaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaagacccuggugcugagagccgugcugcccagagacaugguguucagaaccagcacccccaagguggugcuguga

SEQ ID NO: 2118 - RNA, 1710 nt, Artificial Sequence
  derived and/or modified CDS sequence (opt4) from Lassa virus__AIT17251__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacagcgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaucagaaccgagagaccccugagcagcggcguguacaugggcaaccugagcagccagcagcuggaccagagaagagcccugcugaacaugaucggcaugagcggcggcaaccagggcgcccaggugggcagagacggcguggugagagugugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacuggcccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgagacccccggcgagagaaaccccuacgagaacauccuguacaagaucugccugagcggcgacggcuggcccuacaucgccagcagaaccagcaucaccggcagagccugggagaacaccaucguggaccuggagagcgacggcaagccccagaagaccggcagcaacaacagcaacaagagccugcagagcgccggcuucaccgccggccugaccuacagccagcugaugacccugaaggacagcaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgacgacaucagaaagcugcuggagagccagggcagaaaggacaucaagcugaucgacaucgcccugaacaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaagacccuggugcugagagccgugcugcccagagacaugguguucagaaccagcacccccaagguggugcuguga

SEQ ID NO: 2119 - RNA, 1710 nt, Artificial Sequence
  derived and/or modified CDS sequence (opt4) from Lassa virus__AIT17255__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcgugcugagagugggcacccugaccagcgacgaccugcuggugcuggccgccgaccuggagaagcugaagagcaaggugaccagaaccgagagaccccugagcgccggcguguacaugggcaaccugagcagccagcagcuggaccagagaagagcccugcugagcaugaucggcaugagcggcggcaaccagagagcccaggccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgugaaguaccccaacgccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaagacccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcaacggcaagccccagaaggccgacagcaacagcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgccuucuaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacacccuggugcugagagccgugcugcccagagacaugguguucagaaccagcacccccagaguggugcuguga

SEQ ID NO: 2120 - RNA, 1710 nt, Artificial Sequence
  derived and/or modified CDS sequence (opt4) from Lassa virus__AIT17259__NP
augagcgccagcaaggagaucaagagcuuccuguggacccagagccugagaagagagcugagcagcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugcugggcaugagcggcagcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacagcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacgccagcgugcugagagccgugcugcccagagacaugguguucagaaccagcacccccagaguggugcuguga

SEQ ID NO: 2121 - RNA, 1710 nt, Artificial Sequence
  derived and/or modified CDS sequence (opt4) from Lassa virus__AIT17263__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaucagaaccgagagaccccugagcgccggcguguacaugggcaaccugagcagccagcagcuggaccagagaagagcccugcugaacaugaucggcaugggcggcagcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacggcagcaacaagagccugcagagcgccggcuucaccgccggccugaccuacagccagcugaugacccugaaggacgccaugcugcagcuggaccccaacaccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2122 - RNA, 1710 nt, Artificial Sequence
  derived and/or modified CDS sequence (opt4) from Lassa virus__AIT17267__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacagcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucgccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccaccacccccagaguggugcuguga

SEQ ID NO: 2123 - RNA, 1710 nt, Artificial Sequence
  derived and/or modified CDS sequence (opt4) from Lassa virus__AIT17271__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagaccauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaagaccggcagcaacaacagcaacaagagccugcagagcgccggcuucgccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaaggccgacagcagaaaguacgagaacgccgugugggaccaguacaaggaccugugccacaugcacaccggcguggugguggagaagaagaagagaggcggcaaggaggagaucaccccccacugcgcccugauggacugcaucauguacgacgccgccgugagcggcggccugagcaccagcgugcugagagccgugcugcccagagacaugguguucagaaccagcacccccagaguggugcuguga

SEQ ID NO: 2124 - RNA, 1710 nt, Artificial Sequence
  derived and/or modified CDS sequence (opt4) from Lassa virus__AIT17275__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacggcgaccugaagagacugagagaccugaaccaggccgugaacaaccugguggagcugaagagcacccagcagaagagcgugcugagagugggcacccugaccagcgacgaccugcugacccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcggcaaccagggcgccagaaccggcaaggacggcguggugagaaucugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaucagcgaccuggacagacuggcccagagccaccccauccugaagaugaucgacaccagcaagagcagccugaacaucagcggcuacaacuucagccugggcgccgccgugaaggccggcgccugcaugcuggacggcggcaacaugcuggagaccgugaaggugagcccccagaccauggacggcauccugaagagcauccugaaggugaagaagagccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggugggcagcaacaacagcaacaagagccugcagagcaccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacacccugcccagaaacauggugaucaccugccagggcagcgacgacaucggcaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacgccagcgugcugagagccgugcugcccagagacaugguguucagaaccagcacccccagaguggugcuguga

SEQ ID NO: 2125 - RNA, 1710 nt, Artificial Sequence
  derived and/or modified CDS sequence (opt4) from Lassa virus__AIT17277__NP
augagcgccagcaaggagaucaagagcuuccuguggacccagagccugagaagagagcugagcagcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugagcaugaucggcaugagcggcagcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2126 - RNA, 1710 nt, Artificial Sequence
  derived and/or modified CDS sequence (opt4) from Lassa virus__AIT17281__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacagcgaccugaagagacugagagaccugaaccaggccgugaacaaccugguggagcugaagagcacccagcagaagagcgugcugagagugggcacccugaccagcgacgaccugcuggugcuggccgccgaccuggagaagcugaagagcaaggugaccagaaccgagagaccccugagcgccggcguguacaugggcaaccugagcagccagcagcuggaccagagaagagcccugcugagcaugaucggcaugagcggcggcaaccagggcgccagagccggcagagacggcguggugagaaucugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccaucguggaccuggagagcgacggcaagccccagaagaccagcaccaccaacagcaacaagagccugcagagcgccggcuucgccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacacccugcccagaaacauggugaucaccugccagggcagcgaggacaucagaagacugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagaagggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2127 - RNA, 1710 nt, Artificial Sequence
  derived and/or modified CDS sequence (opt4) from Lassa virus__AIT17285__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagaagcaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcagcaaccagggcgccagagccggcagagacggcguggugagagugugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacgccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccaucguggaccuggagagcgacggcaagccccagaaggccggcaacaacggcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaaccuggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2128 - RNA, 1710 nt, Artificial Sequence
  derived and/or modified CDS sequence (opt4) from Lassa virus__AIT17289__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacagcgaccugaagagacugagagaccugaaccaggccgugaacaaccugguggagcugaagagcacccagcagaagagcgugcugagagugggcacccugaccagcgacgaccugcuggugcuggccgccgaccuggagaagcugaagagcaaggugaccagaaccgagagaccccugagcgccggcguguacaugggcaaccugagcagccagcagcuggaccagagaagagcccugcugagcaugaucggcaugagcggcggcaaccagggcgugagagccggcagagacggcguggugagaaucugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccaucguggaccuggagagcgacggcaagccccagaagaccggcagcaucaacagcaacaagagccugcagagcaccggcuucgccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2129 - RNA, 1710 nt, Artificial Sequence
  derived and/or modified CDS sequence (opt4) from Lassa virus__AIT17293__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacaacgaccugaagagacugagagaccugaaccaggccgugaacaaccugguggagcugaagagcacccagcagaagagcgugcugagagugggcacccugaccagcgacgaccugcuggugcuggccgccgaccuggagaagcugaagagcaaggugaccagaaccgagagaccccugagcgccggcguguacaugggcaaccugagcacccagcagcuggaccagagaagagcccugcugaacaugaucggcaugagcggcggcaaccagggcgccagagccggcagagacggcguggugagagugugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaacaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcggcaacaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugcaacaugcacaccggcaucgugguggagaagaagaagagaggcggcaaggaggagaucaccccccacugcgcccugauggacugcaucauguucgacgccgccgugagcggcggcaugaacaccagcgugcugagagccgugcugcccagagacaugguguucagaaccagcacccccagaguggugcuguga

SEQ ID NO: 2130 - RNA, 1710 nt, Artificial Sequence
  derived and/or modified CDS sequence (opt4) from Lassa virus__AIT17295__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaucagaaccgagagaccccugagcgccggcguguacaugggcaaccugagcagccagcagcuggaccagagaagagcccugcugaacaugaucggcaugggcggcagcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccaucguggaccuggagagcgacggcaagccccagaaggccggcagcaacggcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccaucaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2131 - RNA, 1710 nt, Artificial Sequence
  derived and/or modified CDS sequence (opt4) from Lassa virus__AIT17299__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcgugcugagagugggcacccugaccagcgacgaccugcuggugcuggccgccgaccuggagaagcugaagagcaaggugaccagaaccgagagaccccugagcgccggcguguacaugggcaaccugagcagccagcagcuggaccagagaagagcccugcugagcaugaucggcaugagcggcggcaaccagggcgccagaaccggcagagacggcguggugagagugugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccagcgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcuguucgagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacagccuggugcugagagccgugcugcccagagacaugguguucagaaccagcacccccagaguggugcuguga

SEQ ID NO: 2132 - RNA, 1710 nt, Artificial Sequence
  derived and/or modified CDS sequence (opt4) from Lassa virus__AIT17303__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacagcgaccugaagagacugagagaccugaaccaggccgugaacaaccugguggagcugaagagcacccagcagaagagcgugcugagagugggcacccugaccagcgacgaccugcuggugcuggccgccgaccuggagaagcugaagagcaaggugaucagaaccgagagaccccugagcagcggcguguacaugggcaaccugagcagccagcagcuggaccagagaagagcccugcugaacaugaucggcaugagcggcggcaaccagggcgcccaggugggcagagacggcguggugagagugugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacuggugcagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgagacccccggcgagagaaaccccuacgagaacauccuguacaagaucugccugagcggcgacggcuggcccuacaucgccagcagaaccagcaucaccggcagagccugggagaacaccaucguggaccuggagagcgacggcaagccccagaaggccggcagcaacaacagcaacaagagccugcagagcgccggcuucaccgccggccugaccuacagccagcugaugacccugaaggacagcaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgacgacaucagaaagcugcuggagagccagggcagaaaggacaucaagcugaucgacaucgcccugaacaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaagacccuggugcugagagccgugcugcccagagacaugguguucagaaccagcacccccaagguggugcuguga

SEQ ID NO: 2133 - RNA, 1710 nt, Artificial Sequence
  derived and/or modified CDS sequence (opt4) from Lassa virus__AIT17307__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugagcaugaucggcaugagcggcggcaaccagggcgccagaaccggcagagacggcguggugagagugugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagcugcagaagaccggcagcaacaacagcaacaagagccugcagagcgccggcuucaccgccggccugaccuacagccagcugaugacccugaaggacgccaugcugcagcuggaccccaacgccaagaucuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugaacaagaccgacagcagaaaguacgagaacgccgugugggaccaguacaaggaccugugccacaugcacaccggcguggugguggagaagaagaagaagggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2134 - RNA, 1710 nt, Artificial Sequence
  derived and/or modified CDS sequence (opt4) from Lassa virus__AIT17311__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaucagaaccgagagaccccugagcgccggcguguacaugggcaaccugagcagccagcagcuggaccagagaagagcccugcugaacaugaucggcaugggcggcagcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacggcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2135 - RNA, 1710 nt, Artificial Sequence
  derived and/or modified CDS sequence (opt4) from Lassa virus__AIT17315__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcagcaaccagggcgccagagccggcagagacggcguggugagagugugggacgugaagaacguggagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacagcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagaagggcagcaaggaggagaucaccccccacugcgcccugauggacugcaucauguucgacgccgccgugagcggcggccugaacgccagcgugcugagagccgugcugcccagagacaugguguucagaaccagcacccccagaguggugcuguga

SEQ ID NO: 2136 - RNA, 1710 nt, Artificial Sequence
  derived and/or modified CDS sequence (opt4) from Lassa virus__AIT17319__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacagcgaccugaagagacugagagaccugaaccaggccgugaacaaccugguggagcugaagagcacccagcagaagagcgugcugagagugggcacccugaccagcgacgaccugcuggugcuggccgccgaccuggagaagcugaagagcaaggugaucagaaccgagagaccccugagcagcggcguguacaugggcaaccugagcagccagcagcuggaccagagaagagcccugcugaacaugaucggcaugagcggcggcaaccagggcgcccaggugggcagagacggcguggugagagugugggacgugaagaacgccgacaugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacuggcccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgagacccccggcgagagaaaccccuacgagaacauccuguacaagaucugccugagcggcgacggcuggcccuacaucgccagcagaaccagcaucaccggcagagccugggagaacaccaucguggaccuggagagcgacggcaagccccagaaggccggcagcaacaacagcaacaagagccugcagagcgccggcuucaccgccggccugaccuacagccagcugaugacccugaaggacagcaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgacgacaucagaaagcugcuggagagccagggcagaaaggacaucaagcugaucgacaucgugcugaacaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaagaccauggugcugagagccgugcugcccagagacaugguguucagaaccagcacccccaagguggugcuguga

SEQ ID NO: 2137 - RNA, 1710 nt, Artificial Sequence
  derived and/or modified CDS sequence (opt4) from Lassa virus__AIT17323__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacagcgaccugaagagacugagagaccugaaccaggccgugaacaaccugguggagcugaagagcacccagcagaagagcgugcugagagugggcacccugaccagcgacgaccugcuggugcuggccgccgaccuggagaagcugaagagcaaggugaucagaaccgagagaccccugagcagcggcguguacaugggcaaccugagcagccagcagcuggaccagagaagagcccugcugaacaugaucggcaugagcggcggcaaccagggcgcccaggugggcagagacggcguggugagagugugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacuggcccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgagacccccggcgagagaaaccccuacgagaacauccuguacaagaucugccugagcggcgacggcuggcccuacaucgccagcagaaccagcaucaccggcagagccugggagaacaccaucguggaccuggagagcgacggcaagccccagaaggccggcagcaacaacagcaacaagagccugcagagcgccggcuucaccgccggccugaccuacagccagcugaugacccugaaggacagcaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgacgacaucagaaagcugcuggagagccagggcagaaaggacaucaagcugaucgacaucgcccugaacaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaagacccuggugcugagagccgugcugcccagagacaugguguucagaaccagcacccccaagguggugcuguga

SEQ ID NO: 2138 - RNA, 1710 nt, Artificial Sequence
  derived and/or modified CDS sequence (opt4) from Lassa virus__AIT17325__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacaacgaccugaagagacugagagaccugaaccaggccgugaacaaccugguggagcugaagagcacccagcagaagagcgugcugagagugggcacccugaccagcgacgaccugcuggugcuggccgccgaccuggagaagcugaagagcaaggugaccagaaccgagagaccccugagcgccggcguguacaugggcaaccugagcagccagcagcuggaccagagaagagcccugcugaacaugaucggcaugaccggcggcagcagaggcgcccaggccggcggcgacggcguggugagagugugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaagagccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcggcaacaacagcaacaagagccugcagagcgccggcuucaccgccggccugaccuacagccagcugaugacccugaaggacaccaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgacgacaucagaaagcugcuggagagccagggcagaaaggacaucaagcugaucgacaucgcccugagcaagguggacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacacccuggugcugagagccgugcugcccagagacaugguguucagaaccagcacccccaagguggugcuguga

SEQ ID NO: 2139 - RNA, 1710 nt, Artificial Sequence
  derived and/or modified CDS sequence (opt4) from Lassa virus__AIT17329__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacagcgaccugaagagacugagagaccugaaccagaccgugaacaaccugguggagcugaagagcacccagcagaagagcauccugagagugggcacccugaccagcgacgaccugcugauccuggccgccgaccuggagaagcugaagagcaaggugaucagaaccgagagaccccugagcgccggcguguacaugggcaaccugagcagccagcagcuggaccagagaagagcccugcugaacaugaucggcaugagcagcggcaaccagggcgcccaggccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaugccccagaaggccggcagcagcagcagcaacaagagccugcagagcgccggcuucguggccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaaggccgacagcagaaaguacgagaacgccgugugggaccaguacaaggaccugugccacaugcacaccggcguggugguggagaagaagaagagaggcggcaaggaggagaucaccccccacugcgcccugauggacugcaucauguacgacgccgccgugagcggcggccugaacaccagcgugcugagagccgugcugcccagagacaugguguucagaaccagcacccccagaguggugcuguga

SEQ ID NO: 2140 - RNA, 1710 nt, Artificial Sequence
  derived and/or modified CDS sequence (opt4) from Lassa virus__AIT17333__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacagcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucgccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2141 - RNA, 1710 nt, Artificial Sequence
  derived and/or modified CDS sequence (opt4) from Lassa virus__AIT17335__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacagcgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugagcaugaucggcaugagcagcggcgugcagggcgccagagccggcagagacggcguggugagagugugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgagacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcaccggcuucgccgccggccugaccuacagccagcugaugacccugaaggacgccaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucaagaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2142 - RNA, 1710 nt, Artificial Sequence
  derived and/or modified CDS sequence (opt4) from Lassa virus__AIT17341__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacgcccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacggcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcuguucgagagccagggcagaaaggacaucaagcugaucgacaucgcccugagcaaggccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2143 - RNA, 1710 nt, Artificial Sequence
  derived and/or modified CDS sequence (opt4) from Lassa virus__AIT17345__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugagcaugaucggcaugagcagcggcgugcagggcgccagagccggcagagacggcguggugagagugugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgagacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucaagaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2144 - RNA, 1710 nt, Artificial Sequence
  derived and/or modified CDS sequence (opt4) from Lassa virus__AIT17351__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacggcgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaucagaaccgagagaccccugagcgccggcguguacaugggcaaccugagcagccagcagcuggagcagagaagagcccugcugaacaugaucggcaugagcagcggcaaccagggcgccagaaccggcaaggacggcguggugagaaucugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugguggacaccagcaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucaccggcagagccugggagaacaccgugguggaccuggagagcaacggcaagccccagaaggccggcagcaacaacagcaacaagagccugcagagcaccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacacccugcccagaaacauggugaucaccugccagggcagcgacgacaucagaaagcugcuggagagccagggcagaaaggacaucaagcugaucgacaucgcccugagcaagaucgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacgccagcgugcugagagccgugcugcccagagacaugguguucagaaccagcacccccagaguggugcuguga

SEQ ID NO: 2145 - RNA, 1710 nt, Artificial Sequence
  derived and/or modified CDS sequence (opt4) from Lassa virus__AIT17359__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacagcgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugcugggcaugagcggcagcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacgagaagccccagaaggccggcagcaacagcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacgccagcgugcugagagccgugcugcccagagacaugguguucagaaccagcacccccagaguggugcuguga

SEQ ID NO: 2146 - RNA, 1710 nt, Artificial Sequence
  derived and/or modified CDS sequence (opt4) from Lassa virus__AIT17361__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacagcgaccugaagagacugagagaccugaaccaggccgugaacaaccugguggagcugaagagcacccagcagaagagcgugcugagagugggcacccugaccagcgacgaccugcuggugcuggccgccgaccuggagaagcugaagagcaaggugaccagaaccgagagaccccugagcgccggcguguacaugggcaaccugagcagccagcagcuggaccagagaagagcccugcugaacaugaucggcaugagcggcggcaaccagggcgccagagccggcagagacggcguggugagaaucugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccaucguggaccuggagagcgacggcaagccccagaagaccaacaacaccaacagcaacaagagccugcagagcgccggcuucgccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacacccugcccagaaacauggugaucaccugccagggcagcgaggacaucagaagacugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagaagggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2147 - RNA, 1710 nt, Artificial Sequence
  derived and/or modified CDS sequence (opt4) from Lassa virus__AIT17365__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcagcaaccagggcgcccaggccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacgcccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacggcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcuguucgagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2148 - RNA, 1710 nt, Artificial Sequence
  derived and/or modified CDS sequence (opt4) from Lassa virus__AIT17371__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcagcaaccagggcgcccaggccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacgcccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacagcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcuguucgagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2149 - RNA, 1710 nt, Artificial Sequence
  derived and/or modified CDS sequence (opt4) from Lassa virus__AIT17379__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacagcgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcagcggcaacagaggcgcccaggccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugguggacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucgccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2150 - RNA, 1710 nt, Artificial Sequence
  derived and/or modified CDS sequence (opt4) from Lassa virus__AIT17381__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacagcgaccugaagagacugagagaccugaaccaggccgugaacaaccugguggagcugaagagcacccagcagaagagcgugcugagagugggcacccugaccagcgacgaccugcuggugcuggccgccgaccuggagaagcugaagagcaaggugaccagaaccgagagaccccugagcgccggcguguacaugggcaaccugagcagccagcagcuggaccagagaagagcccugcugagcaugaucggcaugagcggcggcaaccagggcgccagagccggcagagacggcguggugagaaucugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccaucguggaccuggagagcgacggcaagccccagaagaccagcaacaccaacagcaacaagagccugcagagcgccggcuucgccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgaggacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagaagggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2151 - RNA, 1710 nt, Artificial Sequence
  derived and/or modified CDS sequence (opt4) from Lassa virus__AIT17389__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacggcgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcggcaaccagggcgccagaaccggcaaggacggcguggugagaaucugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccagcaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaagagccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcaccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacacccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacgugagcgugcugagagccgugcugcccagagacaugguguucagaaccagcacccccagaguggugcuguga

SEQ ID NO: 2152 - RNA, 1710 nt, Artificial Sequence
  derived and/or modified CDS sequence (opt4) from Lassa virus__AIT17399__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacagcgaccugaagagacugagagaccugaaccaggccgugaacaaccugguggagcugaagagcacccagcagaagagcgugcugagagugggcacccugaccagcgacgaccugcuggugcuggccgccgaccuggagaagcugaagagcaaggugaucagaaccgagagaccccugagcagcggcguguacaugggcaaccugagcagccagcagcuggaccagagaagagcccugcugaacaugaucggcaugagcggcggcaaccagggcgcccaggugggcagagacggcguggugagagugugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacuggcccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaaggcccugggcauguucaucagcgagacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcaacaacaacagcaacaagagccugcagagcgccggcuucaccgccggccugaccuacagccagcugaugacccugaaggacagcaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccacccagcccggccugaccagcgccgugaucgaggcccugcccagaaacauggugaucaccugccagggcagcgacgacaucagaaagcugcuggagagccagggcagaaaggacaucaagcugaucgacaucgcccugaacaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaagacccuggcccugagagccgugcugcccagagacaugguguucagaaccagcacccccaagguggugcuguga

SEQ ID NO: 2153 - RNA, 1710 nt, Artificial Sequence
  derived and/or modified CDS sequence (opt4) from Lassa virus__AIT17405__NP
augagcgugagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaucaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcagcgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2154 - RNA, 1710 nt, Artificial Sequence
  derived and/or modified CDS sequence (opt4) from Lassa virus__AIT17409__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacggcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacgugaccgaccuguucagcgcccagcccggccugaccagcgccgugaucgaggcccugcccagaaacauggugcugaccugccagggcagcgacgacaucaagagacugcuggacagccagggcagaagagacaucaagcugaucgacaucgcccugaacaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2155 - RNA, 1710 nt, Artificial Sequence
  derived and/or modified CDS sequence (opt4) from Lassa virus__AIT17413__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacgcccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaagaugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagaagcugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2156 - RNA, 1710 nt, Artificial Sequence
  derived and/or modified CDS sequence (opt4) from Lassa virus__AIT17421__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugagcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaucaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaagaugggcagcgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2157 - RNA, 1710 nt, Artificial Sequence
  derived and/or modified CDS sequence (opt4) from Lassa virus__AIT17425__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaucguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2158 - RNA, 1710 nt, Artificial Sequence
  derived and/or modified CDS sequence (opt4) from Lassa virus__AIT17429__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcgcccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacgcccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2159 - RNA, 1710 nt, Artificial Sequence
  derived and/or modified CDS sequence (opt4) from Lassa virus__AIT17431__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuucaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccgccagccccaagguggugcuguga

SEQ ID NO: 2160 - RNA, 1710 nt, Artificial Sequence
  derived and/or modified CDS sequence (opt4) from Lassa virus__AIT17439__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuucaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaagaugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccgugagcggcugcuacauccacuucuucagagagcccaccgaccugaagcaguucaagcaggacgccaaguacagccacggcaucgacguggccgaccuguucagcgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccguguucagagccgugcugcccagagacaugguguucagaaccagcagccccaagguggugcuguga

SEQ ID NO: 2161 - RNA, 1710 nt, Artificial Sequence
  derived and/or modified CDS sequence (opt4) from Lassa virus__AIT17443__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacgcccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagaagcugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2162 - RNA, 1710 nt, Artificial Sequence
  derived and/or modified CDS sequence (opt4) from Lassa virus__AIT17447__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccaccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacgugaccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2163 - RNA, 1710 nt, Artificial Sequence
  derived and/or modified CDS sequence (opt4) from Lassa virus__AIT17451__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguuccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccaccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2164 - RNA, 1710 nt, Artificial Sequence
  derived and/or modified CDS sequence (opt4) from Lassa virus__AIT17455__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcgugcugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugagcaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2165 - RNA, 1710 nt, Artificial Sequence
  derived and/or modified CDS sequence (opt4) from Lassa virus__AIT17459__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaagaugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccgugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2166 - RNA, 1710 nt, Artificial Sequence
  derived and/or modified CDS sequence (opt4) from Lassa virus__AIT17463__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcacaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagagcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaccaugguggacaccaagaagagcagccugaacaucagcggcuucaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaucguggaccuggagaccgacggcaagccccagaaggugggcaccgccggcagcagcagaagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagaagcugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2167 - RNA, 1710 nt, Artificial Sequence
  derived and/or modified CDS sequence (opt4) from Lassa virus__AIT17467__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcacccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucagccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2168 - RNA, 1710 nt, Artificial Sequence
  derived and/or modified CDS sequence (opt4) from Lassa virus__AIT17471__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaagaugggcaccaccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagaagcugcuggacagccagggcagaagagacaucaagcugaucgacaucgcccugagcaaggccgacagcagaaaguucgagaacguggugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2169 - RNA, 1710 nt, Artificial Sequence
  derived and/or modified CDS sequence (opt4) from Lassa virus__AIT17475__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcgugcugagagugggcacccugaccagcgacgaccugcugacccuggccgccgaccuggagaagcugaagagcaaggugaucagaaccgagagaccccugagcagcggcguguacaugggcaaccugagcgcccagcagcuggagcagagaagagcccugcugagcaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacaccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaucagcggcugcuacauccacuucuucagagagcccaccgaccugaagcaguucaagcaggacgccaaguacagccacggcaucgacgugaccgaccuguuccccgcccagcccggccugaccagcgccgugaucgaggcccugcccagaaacauggugcugaccugccagggcagcgacgacaucaagagacugcuggacagccagggcagaagagacaucaagaucaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2170 - RNA, 1710 nt, Artificial Sequence
  derived and/or modified CDS sequence (opt4) from Lassa virus__AIT17479__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcgugcugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagaagcugcuggacagccagggcagaaaggacaucaagcugaucgacaucgcccugagcaagguggacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2171 - RNA, 1710 nt, Artificial Sequence
  derived and/or modified CDS sequence (opt4) from Lassa virus__AIT17491__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacggcgaccugaagagacugagagaccugaaccaggccgugaacaaccugguggagcugaagagcacccagcagaagagcgugcugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugagcaugaucggcauggugggcggcgccagaggcacccagcccggcagagacggcguggugagagugugggacgugaagaaccccgaccugcugaacaaccaguucggcaccaugcccagccugacccuggccugccugaccaagcagggccagguggaccugaacgacguggugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcgccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacgugaccgaccuguucagcgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2172 - RNA, 1710 nt, Artificial Sequence
  derived and/or modified CDS sequence (opt4) from Lassa virus__AIT17495__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagagcgcccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuucaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacgcccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagaagcugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2173 - RNA, 1710 nt, Artificial Sequence
  derived and/or modified CDS sequence (opt4) from Lassa virus__AIT17499__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaucaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcgccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacgugaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2174 - RNA, 1710 nt, Artificial Sequence
  derived and/or modified CDS sequence (opt4) from Lassa virus__AIT17503__NP
augagcagcagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcgcccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2175 - RNA, 1710 nt, Artificial Sequence
  derived and/or modified CDS sequence (opt4) from Lassa virus__AIT17507__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaaccugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuucaacuucagccugggcgccgccgugaaggccggcgccugcaugcuggacggcggcaacaugcuggagaccaucaaggugaccccccagaccaucgacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccacaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaagguggacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2176 - RNA, 1710 nt, Artificial Sequence
  derived and/or modified CDS sequence (opt4) from Lassa virus__AIT17511__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacggcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccaucgacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacgugaccgaccuguucagcgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2177 - RNA, 1710 nt, Artificial Sequence
  derived and/or modified CDS sequence (opt4) from Lassa virus__AIT17515__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcgccgccggcagcagcaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccgugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2178 - RNA, 1710 nt, Artificial Sequence
  derived and/or modified CDS sequence (opt4) from Lassa virus__AIT17519__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcgcccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuucaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2179 - RNA, 1710 nt, Artificial Sequence
  derived and/or modified CDS sequence (opt4) from Lassa virus__AIT17525__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagagaagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccguggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccacccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaaaguucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2180 - RNA, 1710 nt, Artificial Sequence
  derived and/or modified CDS sequence (opt4) from Lassa virus__AIT17533__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugaacaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggccggcggcacccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagaagcugcuggacagccagggcagaagagacaucaagcugaucgacaucagccugagcaagaucgacagcagaaaguucgagaacgccgugugggaccagugcaaggaccugugccacaugcacaccggcguggugguggagaagaagaagagaggcggcaaggaggagaucaccccccacugcgcccugauggacugcaucauguucgacgccgccgugagcggcggccugaacauccccgugcugagagccgugcugcccagagacaugguguucagaaccagcagccccaagguggugcuguga

SEQ ID NO: 2181 - RNA, 1710 nt, Artificial Sequence
  derived and/or modified CDS sequence (opt4) from Lassa virus__AIT17539__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacggcgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaucagaaccgagagaccccugagcagcggcguguacaugggcaaccugagcacccagcagcuggagcagagaaaggcccugcugagcaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcagcgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacgugaccgaccuguucagcgcccagcccggccugaccagcgccgugaucgaggcccugcccagaaacauggugcugaccugccagggcagcgacgacaucaagaagcugcuggacagccagggcagaagagacaucaagcugaucgacaucagccugggcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguucgacgccgccgugagcggcggccugaacauccccauccugagagccgugcugcccagagacaugguguucagaaccagcagccccaagguggugcuguga

SEQ ID NO: 2182 - RNA, 1710 nt, Artificial Sequence
  derived and/or modified CDS sequence (opt4) from Lassa virus__AIT17541__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacggcgaccugaagagacugagagaccugaaccaggccgugaacaaccugguggagcugaagagcacccagcagaagagcgugcugagagugggcacccugagcagcgacgaccugcugacccuggccgccgaccuggagaagcugaagagcaaggugaucagaaccgagagaccccugagcagcggcguguacaugggcaaccugagcagccagcagcuggaccagagaagagcccugcugaacaugaucggcaugaccagcgacagacagggcgccagcaccggcagagacggcaucgugagagugugggacgugaagaacgccgagcugcugaacaaccaguucggcaccgugcccagccugacccuggccugccugaccaagcagggccagguggaccugaacgacgccgugcaggcccugaccgaccugggccugaucuacaccgccaaguaccccaacagcagcgaccuggacagacugagccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagagaagccugggcauguucgugagcgacauccccggcgagagaaaccccuacgagaacauccuguacaagaucugccugagcggcgacggcuggcccuacaucgccagcagaaccagcaucaccggcagagccugggagaacaccaucguggaccuggagagcgacagcaagccccagaagcccggcaacagcggcagcaacagaagccugcagagcgccggcuuccccgccggccugaccuacagccagcugaugacccugaaggacagcaugcugcagcuggaccccaacgccaagaccuggauggacaucgagggcagacccgacgaccccguggagaucgcccuguaccagcccagcagcggcugcuacauccacuucuucagagagcccaccgaccugaagcaguucaagcaggacgccaaguacagccacggcaucgacgugggcgaccuguucgccgcccagcccggccugaccagcgccgugaucgaggcccugcccagaaacauggugaucaccugccagggcagcgaggacaucaagaagcugcuggagagccagggcagaaaggacaucaagcugguggacaucagcaugagcaagcccgacagcagaaaguucgagaacgccgugugggaccaguacaaggaccugugccacaugcacaccggcaucgugguggagaagaagaagagaggcggcaaggaggagaucaccccccacugcgcccugauggacugcaucauguucgacgccgccguggugggcggccuggacgccagaauccugagagccgugcugcccagagacaugguguucagaaccagcacccccaagguggugcuguga

SEQ ID NO: 2183 - RNA, 1710 nt, Artificial Sequence
  derived and/or modified CDS sequence (opt4) from Lassa virus__AIT17545__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcgugcugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaucgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguucagcgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaaaguucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccuggacauccccgugcugagagccgugcugcccagagacaugguguucagaaccagcagccccaagguggugcuguga

SEQ ID NO: 2184 - RNA, 1710 nt, Artificial Sequence
  derived and/or modified CDS sequence (opt4) from Lassa virus__AIT17549__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacguggugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgugggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagaagcugcuggacagccagggcagaagagacaucaagcugaucgacaucgcccugagcaaggccgacagcagaaaguucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2185 - RNA, 1710 nt, Artificial Sequence
  derived and/or modified CDS sequence (opt4) from Lassa virus__AIT17553__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaagaugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagaagcugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2186 - RNA, 1710 nt, Artificial Sequence
  derived and/or modified CDS sequence (opt4) from Lassa virus__AIT17561__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccaucgacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgugggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagagaagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2187 - RNA, 1710 nt, Artificial Sequence
  derived and/or modified CDS sequence (opt4) from Lassa virus__AIT17565__NP
augagcgccagcaaggagaucaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacgcccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaaaguucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2188 - RNA, 1710 nt, Artificial Sequence
  derived and/or modified CDS sequence (opt4) from Lassa virus__AIT17569__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguuccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccaccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaaccugcccgugcugagagccgugcugcccagagacaugguguucagaaccagcagccccaagguggugcuguga

SEQ ID NO: 2189 - RNA, 1710 nt, Artificial Sequence
  derived and/or modified CDS sequence (opt4) from Lassa virus__AIT17573__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacaucgccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2190 - RNA, 1710 nt, Artificial Sequence
  derived and/or modified CDS sequence (opt4) from Lassa virus__AIT17577__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgccggcagagccugggagaacaccaccguggaccuggagagcgacggcaagccccagaaggugggcgccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcagagaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2191 - RNA, 1710 nt, Artificial Sequence
  derived and/or modified CDS sequence (opt4) from Lassa virus__AIT17581__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcgugcugagagugggcacccugaccagcgacgaccugcugacccuggccgccgaccuggagaagcugaagagcaaggugaucagaaccgagagaccccugagcagcggcguguacaugggcaaccugagcgcccagcagcuggagcagagaagaacccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacguggugcuggcccugaccgaccugggccugaucuacaccgccaaguaccccaacagcagcgaccuggacagacugagccagagccaccccauccugagcaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacgugaccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2192 - RNA, 1710 nt, Artificial Sequence
  derived and/or modified CDS sequence (opt4) from Lassa virus__AIT17589__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcgcccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccaccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagaagcugcuggacagccagggcagaagagacaucaagcugaucgacaucgcccugagcaaggccgacagcagaaaguucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2193 - RNA, 1710 nt, Artificial Sequence
  derived and/or modified CDS sequence (opt4) from Lassa virus__AIT17593__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacggcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcagccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcgccgccggcagcaccaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaagguggacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2194 - RNA, 1710 nt, Artificial Sequence
  derived and/or modified CDS sequence (opt4) from Lassa virus__AIT17605__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggccggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguucagcgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2195 - RNA, 1710 nt, Artificial Sequence
  derived and/or modified CDS sequence (opt4) from Lassa virus__AIT17609__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggccggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcgccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2196 - RNA, 1710 nt, Artificial Sequence
  derived and/or modified CDS sequence (opt4) from Lassa virus__AIT17613__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaagaccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2197 - RNA, 1710 nt, Artificial Sequence
  derived and/or modified CDS sequence (opt4) from Lassa virus__AIT17617__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcgcccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuucaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2198 - RNA, 1710 nt, Artificial Sequence
  derived and/or modified CDS sequence (opt4) from Lassa virus__AIT17621__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugaccaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaucgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaaaguucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2199 - RNA, 1710 nt, Artificial Sequence
  derived and/or modified CDS sequence (opt4) from Lassa virus__AIT17625__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagagaagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccguggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaaaguucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2200 - RNA, 1710 nt, Artificial Sequence
  derived and/or modified CDS sequence (opt4) from Lassa virus__AIT17627__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcagccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcagcgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2201 - RNA, 1710 nt, Artificial Sequence
  derived and/or modified CDS sequence (opt4) from Lassa virus__AIT17631__NP
augagcgccagcaaggagaucaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacgcccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2202 - RNA, 1710 nt, Artificial Sequence
  derived and/or modified CDS sequence (opt4) from Lassa virus__AIT17635__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacaacgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugaacacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2203 - RNA, 1710 nt, Artificial Sequence
  derived and/or modified CDS sequence (opt4) from Lassa virus__AIT17639__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaucaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcagcgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2204 - RNA, 1710 nt, Artificial Sequence
  derived and/or modified CDS sequence (opt4) from Lassa virus__AIT17643__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcgcccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2205 - RNA, 1710 nt, Artificial Sequence
  derived and/or modified CDS sequence (opt4) from Lassa virus__AIT17651__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcgugcugagagugggcacccugaccagcgacgaccugcugacccuggccgccgaccuggagaagcugaagagcaaggugaucagaaccgagagaccccugagcagcggcguguacaugggcaaccugagcgcccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacguggugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacgugaccgaccuguucagcgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2206 - RNA, 1710 nt, Artificial Sequence
  derived and/or modified CDS sequence (opt4) from Lassa virus__AIT17655__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagaagccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguuccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccaccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2207 - RNA, 1710 nt, Artificial Sequence
  derived and/or modified CDS sequence (opt4) from Lassa virus__AIT17659__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcgugcugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugagcaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugaacaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2208 - RNA, 1710 nt, Artificial Sequence
  derived and/or modified CDS sequence (opt4) from Lassa virus__AIT17663__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagaagcugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2209 - RNA, 1710 nt, Artificial Sequence
  derived and/or modified CDS sequence (opt4) from Lassa virus__AIT17667__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccaucgacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccaccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacgugaccgaccuguuccccgcccagcccggccugaccagcgccgugaucgaggcccugcccagaaacauggugcugaccugccagggcagcgaggacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2210 - RNA, 1710 nt, Artificial Sequence
  derived and/or modified CDS sequence (opt4) from Lassa virus__AIT17671__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcgugcugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacguggugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacgugaccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2211 - RNA, 1710 nt, Artificial Sequence
  derived and/or modified CDS sequence (opt4) from Lassa virus__AIT17675__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcgugcugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaucguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2212 - RNA, 1710 nt, Artificial Sequence
  derived and/or modified CDS sequence (opt4) from Lassa virus__AIT17679__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagagcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2213 - RNA, 1710 nt, Artificial Sequence
  derived and/or modified CDS sequence (opt4) from Lassa virus__AIT17683__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuucaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2214 - RNA, 1710 nt, Artificial Sequence
  derived and/or modified CDS sequence (opt4) from Lassa virus__AIT17687__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcgcccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2215 - RNA, 1710 nt, Artificial Sequence
  derived and/or modified CDS sequence (opt4) from Lassa virus__AIT17695__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaaccugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacguggugcuggcccugaccgaccugggccugaucuacaccgccaaguaccccaacagcagcgaccuggacagacugagccagagccaccccauccugaacaugguggacaccaagaagagcagccugaacaucagcggcuucaacuucagccugggcgccgccgugaaggccggcgccugcaugcuggacggcggcaacaugcuggagaccaucaaggugaccccccacaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccacaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2216 - RNA, 1710 nt, Artificial Sequence
  derived and/or modified CDS sequence (opt4) from Lassa virus__AIT17705__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaaccugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuucaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccacaaggugggcaccgccggcagcaacagaagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2217 - RNA, 1710 nt, Artificial Sequence
  derived and/or modified CDS sequence (opt4) from Lassa virus__AIT17711__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaaccugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuucaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccacaaggugggcaccgccggcagcagcaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2218 - RNA, 1710 nt, Artificial Sequence
  derived and/or modified CDS sequence (opt4) from Lassa virus__AIT17713__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaucaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugaacaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2219 - RNA, 1710 nt, Artificial Sequence
  derived and/or modified CDS sequence (opt4) from Lassa virus__AIT17719__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugagcggcgcccagggcacccagcccggcagagacggcguggugagagugugggacgugaagaaccccgagcugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucagccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2220 - RNA, 1710 nt, Artificial Sequence
  derived and/or modified CDS sequence (opt4) from Lassa virus__AIT17725__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcgcccagcagcuggagcagagaagagcccugcugaacaugaucggcauggugggcggcgcccagggcacccagcugggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgaggacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2221 - RNA, 1710 nt, Artificial Sequence
  derived and/or modified CDS sequence (opt4) from Lassa virus__AIT17729__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagagaagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcacccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaaaguucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2222 - RNA, 1710 nt, Artificial Sequence
  derived and/or modified CDS sequence (opt4) from Lassa virus__AIT17733__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2223 - RNA, 1710 nt, Artificial Sequence
  derived and/or modified CDS sequence (opt4) from Lassa virus__AIT17745__NP
augagcgccagcaaggagaucaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacgcccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaagguggacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2224 - RNA, 1710 nt, Artificial Sequence
  derived and/or modified CDS sequence (opt4) from Lassa virus__AIT17753__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccaccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2225 - RNA, 1710 nt, Artificial Sequence
  derived and/or modified CDS sequence (opt4) from Lassa virus__AIT17763__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccguggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacgagaagccccagaaggugggcgccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacgugaccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2226 - RNA, 1710 nt, Artificial Sequence
  derived and/or modified CDS sequence (opt4) from Lassa virus__AIT17771__NP
augagcgccagcaaggaggugaagagcuuccuguggacccagagccugagaagagagcugagcggcuacugcagcagcaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagagaagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagacccagaaggugagcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacgugaccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2227 - RNA, 1710 nt, Artificial Sequence
  derived and/or modified CDS sequence (opt4) from Lassa virus__AIT17779__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacggcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacgugaccgaccuguucagcgcccagcccggccugaccagcgccgugaucgaggcccugcccagaaacauggugcugaccugccagggcagcgacgacaucaagagacugcuggacagccagggcagaagagacaucaagcugaucgacaucgcccugagcaagaccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2228 - RNA, 1710 nt, Artificial Sequence
  derived and/or modified CDS sequence (opt4) from Lassa virus__AIT17783__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacagcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacguggugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccgugagcggcugcuacauccacuucuucagagagcccaccgaccugaagcaguucaagcaggacgccaaguacagccacggcaucgacguggccgaccuguuccccgcccagcccggccugaccagcgccgugaucgaggcccugcccagaaacauggugcugaccugccagggcagcgacgacaucaagagacugcuggacagccagggcagaagagacaucaagcugaucgacaucgcccugagcaaggccgacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2229 - RNA, 1710 nt, Artificial Sequence
  derived and/or modified CDS sequence (opt4) from Lassa virus__AIT17787__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacggcgaccugaagagacugagagaccugaaccaggccgugaacaaccugguggagcugaagagcacccagcagaagagcauccugagagugggcacccugaccagcgacgaccugcugacccuggccgccgaccuggagaagcugaagagcaaggugaucagaaccgagagaccccugagcagcggcguguacaugggcaaccugagcacccagcagcuggagcagagaagagcccugcugaacaugaucggcauggugggcggcgcccagggcacccagcccggcagagacggcguggugagagugugggacgugaagaaccccgaccugcugaacaaccaguucggcaccaugcccagccugacccuggccugccugaccaagcagggccagguggaccugaacgacgccgugcuggcccugaccgaccugggccugaucuacaccgccaaguaccccaacagcagcgaccuggacagacugagccagagccaccccauccugaacaugguggacaccaagaagagcagccugaacaucagcggcuacaacuucagccugggcgccgccgugaaggccggcgccugcaugcuggacggcggcaacaugcuggagaccaucaaggugaccccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccaccguggaccuggagagcgacggcaagccccagaaggugggcaccgccggcagcaacaagagccugcagagcgccggcuuccccaccggccugaccuacagccagcugaugacccugaaggacagcaugaugcagcuggaccccagcgccaagaccuggaucgacaucgagggcagacccgaggaccccguggagaucgcccuguaccagcccaugagcggcugcuacauccacuucuucagagagcccaccgaccugaagcaguucaagcaggacgccaaguacagccacggcaucgacgugaccgaccuguucagcgcccagcccggccugaccagcgccgugaucgaggcccugcccagaaacauggugcugaccugccagggcagcgacgacaucaagagacugcuggacagccagggcagaagagacaucaagcugaucgacaucgcccugagcaagguggacagcagaagauucgagaacgccgugugggaccagugcaaggaccugugccacaugcacaccggcguggugguggagaagaagaagagaggcggcaaggaggagaucaccccccacugcgcccugauggacugcaucauguacgacgccgccgugagcggcggccugaacauccccgugcugagagccgugcugcccagagacaugguguucagaaccagcagccccaagguggugcuguga

SEQ ID NO: 2230 - RNA, 1710 nt, Artificial Sequence
  derived and/or modified CDS sequence (opt4) from Lassa virus__AIT17803__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaucagaaccgagagaccccugagcgccggcguguacaugggcaaccugagcagccagcagcuggaccagagaagagcccugcugagcaugaucggcaugagcggcggcagccaggaggccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccguggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagaagggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2231 - RNA, 1710 nt, Artificial Sequence
  derived and/or modified CDS sequence (opt4) from Lassa virus__AIT17811__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcagcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacggcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgccuucuaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaaccuggugaucaccugccagggcagcgacgacaucagaaagcuguucgagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacgccagcgugcugagagccgugcugcccagagacaugguguucagaaccagcacccccagaguggugcuguga

SEQ ID NO: 2232 - RNA, 1710 nt, Artificial Sequence
  derived and/or modified CDS sequence (opt4) from Lassa virus__AIT17815__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcuggacaugaucggcaugagcggcagcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacgcccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacggcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcuguucgagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2233 - RNA, 1710 nt, Artificial Sequence
  derived and/or modified CDS sequence (opt4) from Lassa virus__AIT17821__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaucagaaccgagagaccccugagcgccggcguguacaugggcaaccugagcagccagcagcuggaccagagaagagcccugcugagcaugaucggcaugagcggcggcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccguggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaagaccggcagcaacaacagcaacaagagccugcagagcgccggcuucaccgccggccugaccuacagccagcugaugacccugaaggacgccaugcugcagcuggaccccaacgccaagaccuggauggacaucgagggcagacccgaggaccccguggagguggcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2234 - RNA, 1710 nt, Artificial Sequence
  derived and/or modified CDS sequence (opt4) from Lassa virus__AIT17837__NP
augagcaacagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacgccgaccugaagagacugagagaccugaaccaggccgugaacaaccugguggagcugaagagcacccagcagaagaacgugcugagagugggcacccugagcagcgacgaccugaucacccuggccgccgaccuggagaagcugaagagcaaggugaucagaaccgagagaccccugagcagcggcguguacaugggcaaccugagcagccagcagcuggaccagagaagagcccugcugagcaugaucggcaugagcggcggcccccagggcaacagaaccggcggcgacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacagcagcgaccuggacaugcugacccagagccaccccauccugggcaugguggacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagagaagccugggcauguucaucagcgacacccccggcgagagaaaccccuacgagaacauccuguacaagaucugccugagcggcgagggcuggcccuacaucgccagcagaaccagcaucaccggcagagccugggagaacacccugguggaccuggagagcgacaacaagccccccaagcugaacagcgccggcagcaacaagagccugcaggccgccggccugaacgccggccugaccuacagccagcugaugacccugaaggacugcaugcugcagcuggaccccagcagcaagaccuggaucgacaucgagggcagacccgaggaccccguggagaucgcccuguuccagcccagcagcggcugcuacauccacuucuucagagagcccaccgaccugaagcaguucaagcaggacgccaaguacagccacggcaucgacgugaccgaccuguucagcacccagcccggccugaccagcgccgugaucgaggcccugcccagaaacauggugcugaccugccagggcagcgacgacaucaagaagcugcuggagagccagggcagaagagacaucaagcugaucgacaucagccugagcaaggccgacagcagaaaguucgagaacgccgugugggaccaguacaaggaccugugccacaugcacaccggcguggugguggagaagaagaagagaggcggcaaggaggagaucaccccccacugcgcccugcuggacugcaucauguucgacgccgccaccaccggcagccugaacaucaccacccugagagccgugcugcccagagacaugguguucagaaccagcacccccaagguggugcuguga

SEQ ID NO: 2235 - RNA, 1710 nt, Artificial Sequence
  derived and/or modified CDS sequence (opt4) from Lassa virus__AIT17841__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcagcaaccagggcgccagaaccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacgcccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacggcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcuguucgagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2236 - RNA, 1710 nt, Artificial Sequence
  derived and/or modified CDS sequence (opt4) from Lassa virus__AIT17845__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcagcaaccagggcgcccagaccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacgcccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccggcagcaacggcagcaacaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccgcccagcccggccugaccagcgccgugaucgacgcccugcccagaaacauggugaucaccugccagggcagcgacgacaucagaaagcuguucgagagccagggcagaaaggacaucaagcugaucgacaucgcccugagcaagaccgacagcagaaaguacgagaacgccgugugggaccaguacaaggaccugugccacaugcacaccggcaucgugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2237 - RNA, 1710 nt, Artificial Sequence
  derived and/or modified CDS sequence (opt4) from Lassa virus__ANH09723__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacaacgaccugaagagacugagagaccugaaccaggccgugaacaaccugguggagcugaagagcacccagcagaagagcgugcugagagugggcacccugaccagcgacgaccugcugacccuggccgccgaccuggagaagcugaagagcaaggugaccagaaccgagagaccccugaccgccggcguguacaugggcaaccugagcagccagcagcuggaccagagaagagcccugcugaacaugaucggcaugagcggcggcaaccagggcgccagaaccggcagagacggcguggugagagugugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaacaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaagagccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcggcggcaagccccagaaggccggcagcaacaacagcaacaagagccugcagagcgccggcuucgccgccggccugaccuacagccagcugaugacccugaaggacgccaugcugcagcuggaccccaacgccaagaccuggauggacaucgagggcagacccgaggaccccguggagaucgcccuguaccagcccaucagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgacgacaucagaaagcuguucgagagccagggcagaaaggacaucaagcugaucgacaucgcccugagcaagaccgacagcagaaaguacgagaacgccgugugggaccaguacaaggaccugugccacaugcacaccggcguggugguggagaagaagaagaagggcggcaaggaggagaucaccccccacugcgcccugauggacugcaucauguucgacgccgccgugagcggcggccugaacacccuggugcugagagccgugcugcccagagacaugguguucagaaccagcacccccaagguggugcuguga

SEQ ID NO: 2238 - RNA, 1710 nt, Artificial Sequence
  derived and/or modified CDS sequence (opt4) from Lassa virus__ANH09725__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacaacgaccugaagagacugagagaccugaaccaggccgugaacaaccugguggagcugaagagcacccagcagaagagcgugcugagagugggcacccugaccagcgacgaccugcugauccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaacaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaagagccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcggcggcaagccccagaaggccggcagcaacaacagcaacaagagccugcagagcgccggcuucgccgccggccugaccuacagccagcugaugacccugaaggacgccaugcugcagcuggaccccaacgccaagaccuggauggacaucgagggcagacccgaggaccccguggagaucgcccuguaccagcccaucagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacacccuggugcugagagccgugcugcccagagacaugguguucagaaccagcacccccaagguggugcuguga

SEQ ID NO: 2239 - RNA, 1710 nt, Artificial Sequence
  derived and/or modified CDS sequence (opt4) from Lassa virus__ANH09729__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacagcgaccugaagagacugagagaccugaaccaggccgugaacaaccugguggagcugaagagcacccagcagaagagcgugcugagagugggcacccugaccagcgacgaccugcugacccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcggcaaccagggcgccagaaccggcagagacggcguggugagagugugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaacaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaagagccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcggcggcaagccccagagagccggcagcaacaacagcaacaagagccugcagagcgccggcuucgccgccggccugaccuacagccagcugaugacccugaaggacgccaugcugcagcuggaccccaacgccaagaccuggauggacaucgagggcagacccgaggaccccguggagaucgcccuguaccagcccaccagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagaagggcggcaaggaggagaucaccccccacugcgcccugauggacugcaucauguucgacgccgccgugagcggcggccugaacacccuggugcugagagccgugcugcccagagacaugguguucagaaccagcacccccaagguggugcuguga

SEQ ID NO: 2240 - RNA, 1710 nt, Artificial Sequence
  derived and/or modified CDS sequence (opt4) from Lassa virus__ANH09731__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacaacgaccugaagagacugagagaccugaaccaggccgugaacaaccugguggagcugaagagcacccagcagaagagcgugcugagagugggcacccugaccagcgacgaccugcugacccuggccgccgaccuggagaagcugaagagcaaggugaccagaaccgagagaccccugagcgccggcguguacaugggcaaccugagcagccagcagcuggaccagagaagagcccugcugaacaugaucggcaugaccggcggcaaccagggcgccagaaccggcagagacggcguggugagagugugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaacaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaagagccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcggcggcaagccccagagagccggcagcaacaacagcaacaagagccugcagagcgccggccuggccgccggccugaccuacagccagcugaugacccugaaggacgccaugcugcagcuggaccccaacgccaagaccuggauggacaucgagggcagacccgaggaccccguggagaucgcccuguaccagcccaccagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagaagggcggcaaggaggagaucaccccccacugcgcccugauggacugcaucauguucgacgccgccgugagcggcggccugaacacccuggugcugagagccgugcugcccagagacaugguguucagaaccagcacccccaagguggugcuguga

SEQ ID NO: 2241 - RNA, 1710 nt, Artificial Sequence
  derived and/or modified CDS sequence (opt4) from Lassa virus__ANH09733__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacaacgaccugaagagacugagagaccugaaccaggccgugaacaaccugguggagcugaagagcacccagcagaagagcgugcugagagugggcacccugaccagcgacgaccugcugacccuggccgccgaccuggagaagcugaagagcaaggugaccagaaccgagagaccccugagcgccggcguguacaugggcaaccugagcagccagcagcuggaccagagaagagcccugcugaacaugaucggcaugagcggcggcaaccagggcgccagaaccggcagagacggcguggugagagugugggacgugaagaacgccgaccugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaacaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaagagccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcggcggcaagccccagagagccggcagcaacaacagcaacaagagccugcagagcgccggcuucgccgccggccugaccuacagccagcugaugacccugaaggacgccaugcugcagcuggaccccaacgccaagaccuggauggacaucgagggcagacccgaggaccccguggagaucgccuucuaccagcccaucagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagaagggcggcaaggaggagaucaccccccacugcgcccugauggacugcaucauguucgacgccgccgugagcggcggccugaacacccuggugcugagagccgugcugcccagagacaugguguucagaaccagcacccccaagguggugcuguga

SEQ ID NO: 2242 - RNA, 1710 nt, Artificial Sequence
  derived and/or modified CDS sequence (opt4) from Lassa virus__ANH09735__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacauccagagacugaugagaaaggagagaagagacgacagcgaccugaagagacugagagaccugaaccaggccgugaacaaccugguggagcugaagagcacccagcagaagagcgugcugagagugggcacccugagcagcgacgaccugcugacccuggccgccgaccuggagaagcugaagagcaaggugaucagaaccgagagaccccugagcagcggcguguacaugggcaaccugagcacccagcagcuggaccagagaagagcccugcugaacaugaucggcaugaccaacggcggccagggcgccaacgccggcagagacggcaucgugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacagcagcgaccuggacagacugagccagaaccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagagaagccugggcauguucgugagcgacacccccggcgagagaaaccccuacgagaacauccuguacaagaucugccugagcggcgacggcuggcccuacguggccagcagaaccagcaucaucggcagagccugggagaacaccgugguggaccuggagagcgacagcaagccccagagacccggcagcaaggagagcaacagaagccugcagaccgccggcuuccccgccggccugaccuacagccagcugaugacccugaaggacagcaugcugcagcuggaccccaacgccaagaccuggauggacaucgagggcagacccgacgaccccguggagaucgcccuguaccagcccagcagcggcugcuacauccacuucuucagagagcccaccgaccugaagcaguucaagcaggacgccaaguacagccacggcaucgacaucggcgaccuguucgccgcccagcccggccugaccagcgccgugaucgaggcccugcccagaaacauggugaucaccugccagggcagcgaggacaucaagagacugcuggagagccagggcagaaaggacaucagacugguggacaucagccugagcaaggccgacagcagaaaguucgagaacgccgugugggaccaguucaaggaccugugcaacaugcacaccggcguggugguggagaagaagaagaagggcggcaaggaggagaucaccccccacugcgcccugauggacugcaucauguucgacgccgccgugaugggcggccuggacgccaaggugcugagagccgugcugcccaaggacaugguguucagaaccagcacccccagaguggugcuguga

SEQ ID NO: 2243 - RNA, 1710 nt, Artificial Sequence
  derived and/or modified CDS sequence (opt4) from Lassa virus__ANH09737__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacauccagagacugaugagaaaggagagaagagacgacagcgaccugaagagacugagagaccugaaccaggccgugaacaaccugguggagcugaagagcacccagcagaagagcgugcugagagugggcacccugagcagcgacgaccugcugacccuggccgccgaccuggagaagcugaagagcaaggugaucagaaccgagagaccccugagcagcggcguguacaugggcaaccugagcacccagcagcuggaccagagaagagcccugcugaacaugaucggcaugaccaacggcggccagggcgccaacgccggcagagacggcaucgugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacagcagcgaccuggacagacugagccagaaccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagagaagccugggcauguucgugagcgacacccccggcgagagaaaccccuacgagaacauccuguacaagaucugccugagcggcgacggcuggcccuacguggccagcagaaccagcaucaucggcagagccugggagaacaccgugguggaccuggagagcgacagcaagccccagagacccggcagcaaggagagcaacagaagccugcagaccgccggcuuccccgccggccugaccuacagccagcugaugacccugaaggacagcaugcugcagcuggaccccaacgccaagaccuggauggacaucgagggcagacccgacgaccccguggagaucgcccuguaccagcccagcagcggcugcuacauccacuucuucagagagcccaccgaccugaagcaguucaagcaggacgccaaguacagccacggcaucgacaugggcgaccuguucgccgcccagcccggccugaccagcgccgugaucgaggcccugcccagaaacauggugaucaccugccagggcagcgaggacaucaagagacugcuggagagccagggcagaagagacaucagacugguggacaucagccugagcaaggccgacagcagaaaguucgagaacgccgugugggaccaguucaaggaccugugcaacaugcacaccggcguggugguggagaagaagaagaagggcggcaaggaggagaucaccccccacugcgcccugauggacugcaucauguucgacgccgccgugaugggcggccuggacgccaaggugcugagagccgugcugcccaaggacaugguguucagaaccagcacccccagaguggugcuguga

SEQ ID NO: 2244 - RNA, 1710 nt, Artificial Sequence
  derived and/or modified CDS sequence (opt4) from Lassa virus__ANH09739__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacauccagagacugaugagaaaggagagaagagacgacagcgaccugaagagacugagagaccugaaccaggccgugaacaaccugguggagcugaagagcacccagcagaagagcgugcugagagugggcacccugagcagcgacgaccugcugacccuggccgccgaccuggagaagcugaagagcaaggugaucagaaccgagagaccccugagcagcggcguguacaugggcaaccugagcacccagcagcuggaccagagaagagcccugcugaacaugaucggcaugaccagcggcggccagggcgccaacgccggcagagacggcaucgugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacagcagcgaccuggacagacugagccagaaccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagagaagccugggcauguucgugagcgacacccccggcgagagaaaccccuacgagaacauccuguacaagaucugccugagcggcgacggcuggcccuacguggccagcagaaccagcaucaucggcagagccugggagaacaccgugguggaccuggagagcgacagcaagccccagagacccggcagcaaggagagcaacagaagccugcagaccgccggcuuccccgccggccugaccuacagccagcugaugacccugaaggacagcaugcugcagcuggaccccaacgccaagaccuggauggacaucgagggcagacccgacgaccccguggagaucgcccuguaccagcccagcagcggcugcuacauccacuucuucagagagcccaccgaccugaagcaguucaagcaggacgccaaguacagccacggcaucgacaucggcgaccuguucgccgcccagcccggccugaccagcgccgugaucgaggcccugcccagaaacauggugaucaccugccagggcagcgaggacaucaagagacugcuggagagccagggcagaagagacaucagacugguggacaucagccugagcaaggccgacagcagaaaguucgagaacgccgugugggaccaguucaaggaccugugcaacaugcacaccggcguggugguggagaagaagaagaagggcggcaaggaggagaucaccccccacugcgcccugauggacugcaucauguucgacgccgccgugaugggcggccuggacgccaaggugcugagagccgugcugcccaaggacaugguguucagaaccagcacccccagaguggugcuguga

SEQ ID NO: 2245 - RNA, 1710 nt, Artificial Sequence
  derived and/or modified CDS sequence (opt4) from Lassa virus__ANH09741__NP
augagcaacagcaaggaggugaagagcuuccuguggacccagagccugagaagagagcugagcggcuacugcaccaacaucaagcugcagguggugaaggacgcccaggcccugcugcacggccuggacuucagcgaggugagcaacgugcagagacugaugagaaagcagaagagagacgacaacgaccugaagagacugagagaccugaaccaggccgugaacaaccugguggagcugaagagcgugcagcagaagagcgugcugaaggugggcacccugaacagcgacgaccugcugacccuggccgccgaccuggagaagcugaagagcaagguggugagaaccgagagaccccugagcagcggcguguacaugggcaaccugagcagccagcagcuggaccagagaagagcccugcugaacaugaucggcauggccggcggcagccagggcaaccagcccagcagagacggcguggugagagugugggacgugaagaacgccgaccugcugaacaaccaguucggcaccaugcccagccugacccuggccugccugaccaagcagggccagguggaccugaacgacguggugcuggcccugaccgaccugggccugaucuacaccgccaaguaccccaacagcagcgaccuggacagacugagccagaaccaccccgugcugaacaugaucgacgugaacaagagcagccugaacaucagcggcuacaacuucagccugggcgccgccgugaaggccggcgccugcaugcuggacggcggcaacaugcuggagaccaucaagaucagcccccagaccguggacggcauccugaagagcauccugaaggugaagagagcccugggcauguucgugagcgacacccccggcgagagaaaccccuacgagaacauccuguacaaggugugccugagcggcaacggcuggcccuacaucgccagcagaaccagcaucgugggcagagccugggagaacaccgugguggaccuggagagcaacaagaaccagcccaaggugggcaacaacggcagcaacaagaugcugcagagcagcggcuucgccaccggccugaccuacagccagcugaugacccugagagacagcaugcugcagcuggaccccaccgccaagaccuggaucgacaucgagggcagacccgaggaccccguggagcuggcccuguuccagcccagcagcggcugcuacauccacuucuucagagagcccaccgaccugaagcaguucaagcaggacgccaaguacagccacggcaucgacgugaacgaccuguucagcgcccagcccggccugaccagcgccgugcuggaggcccugcccagaaacauggugcugaccugccagggcagcgacgacaucagaaagcugcuggacagccaggacagaaaggacaucaagcugaucgacaucagccugagcaaggccgacgccagaaaguucgagaacgacgugugggaccaguucaaggaccugugccacaugcacaccggcaucgugguggagaagaagaagaagggcggcaagcaggagaugaccccccacugcgcccugcuggacugcaucauguucgacgccgccgugagcggcggccugaacgugcccacccugagagccgugcugcccaccgacaugguguucagaaccaucaccaccaagguggugcuguga

SEQ ID NO: 2246 - RNA, 1713 nt, Artificial Sequence
  derived and/or modified CDS sequence (opt4) from Lassa virus__CAA36646__NP
augagcgccagcaaggaggugagaagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacggcgaccugaagagacugagagaccugaaccaggccgugaacaaccugguggagcugaagagcacccagcagaagagcgugcugagagugggcacccugagcagcgacgaccugcugauccuggccgccgaccuggagaagcugaagagcaaggugaccagaaccgagagaccccugagcagcggcguguacaugggcaaccugagcagccagcagcuggaccagagaagagcccugcugaacaugaucggcaugaccggcgugagcggcggcggcaagggcgccagcgacggcaucgugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacagcagcgaccuggacagacugagccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaagagccugggcauguucgugagcgacacccccggcgagagaaaccccuacgagaacauccuguacaagaucugccugagcggcgacggcuggcccuacaucgccagcagaaccagcaucgugggcagagccugggagaacaccgugguggaccuggagcaggacaacaagccccagaagaucggcaacggcggcagcaacaagagccugcagagcgccggcuucgccgccggccugaccuacagccagcugaugacccugaaggacuucaagugcuucaaccugauccccaacgccaagaccuggauggacaucgagggcagacccgaggaccccguggagaucgcccuguaccagcccagcagcggcugcuacgugcacuucuucagagagcccaccgaccugaagcaguucaagcaggacgccaaguacagccacggcaucgacgugaccgaccuguucgccgcccagcccggccugaccagcgccgugaucgaggcccugcccagaaacauggugaucaccugccagggcagcgaggacaucagaaagcugcuggagagccagggcagaagagacaucaagcugaucgacaucacccugagcaaggccgacagcagaaaguucgagaacgccgugugggaccaguucaaggaccugugccacaugcacaccggcguggugguggagaagaagaagagaggcggcaaggaggagaucaccccccacugcgcccugauggacugcaucauguucgacgccgccgugagcggcggccuggacgccaaggugcugagaguggugcugcccagagacaugguguucagaaccagcacccccaagguggugcuguga

SEQ ID NO: 2247 - RNA, 1710 nt, Artificial Sequence
  derived and/or modified CDS sequence (opt4) from Lassa virus__CCA30315__NP
augagcgccagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagagaagagacgacagcgaccugaagagacugagagaccugaaccaggccgugaacaaccugguggagcugaagagcacccagcagaagagcgugcugagagugggcacccugagcagcgacgaccugcugacccuggccgccgaccuggagaagcugaagagcaaggugaccagaaccgagagaccccugagcagcggcguguacaugggcaaccugagcagccagcagcuggaccagagaagagcccugcugaaccugaucggcaugaccaacggcagccagggcagccaggccggcagagacggcguggugagagugugggacgugaagaacgccgagcugcugaacaaccaguucggcaccaugcccagccugacccuggccugccugaccaagcagggccagguggaccugaacgacguggugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagagcauggacggcauccugaagagcauccugaaggugaagagagcccugggcauguucgugagcgacacccccggcgagagaaaccccuacgagaacauccuguacaagaucugccugagcggcgacggcuggcccuacaucgccagcagaaccagcaucgugggcagagccugggagaacaccgugguggaccuggagaccgacggcaagccccagaagaucggcagcggcaacagcaacaagagccugcagagcgccggcuucagcgccggccugaccuacagccagcugaugacccugaaggacgccaugcugcagcuggaccccaacgccaagaccuggauggacaucgagggcagacccgaggaccccguggagguggcccuguaccagcccaucagcggcugcuacauccacuucuucagagagcccaccgaccugaagcaguucaagcaggacgccaaguacagccacggcaucgacaucgccgaccuguucgccgcccagcccggccugaccagcgccgugaucgaggcccugcccagaaacauggugaucaccugccagggcagcgaggacaucaagaagcugcuggagagccagggcagaaaggacaucaagcugaucgacaucgcccugagcaagaucgacagcagaaaguucgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacacccuggugcugagagccgugcugcccagagacaugguguucagaaccagcacccccagaguggugcuguga

SEQ ID NO: 2248 - RNA, 1710 nt, Artificial Sequence
  derived and/or modified CDS sequence (opt4) from Lassa virus__JX985061__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugagaagcaaggugaucagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacgccgagcugcugagcaaccaguucggcaccauccccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccgacagcaacaacagcagcaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccacccagcccggccugaccagcgccgugaucgacgcccugcccagaaacauggugaucaccugccagggcagcgacgacaucagaaagcugcuggagagccagggcagaaaggacaucaagcugaucgacaucgaccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2249 - RNA, 1710 nt, Artificial Sequence
  derived and/or modified CDS sequence (opt4) from Lassa virus__NP_694869__NP
augagcgccagcaaggagaucaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaaggagagaagagacgacaacgaccugaagagacugagagaccugaaccaggccgugaacaaccugguggagcugaagagcacccagcagaagagcauccugagagugggcacccugaccagcgacgaccugcugauccuggccgccgaccuggagaagcugaagagcaaggugaucagaaccgagagaccccugagcgccggcguguacaugggcaaccugagcagccagcagcuggaccagagaagagcccugcugaacaugaucggcaugagcggcggcaaccagggcgccagagccggcagagacggcguggugagagugugggacgugaagaacgccgagcugcugaacaaccaguucggcaccaugcccagccugacccuggccugccugaccaagcagggccagguggaccugaacgacgccgugcaggcccugaccgaccugggccugaucuacaccgccaaguaccccaacaccagcgaccuggacagacugacccagagccaccccauccugaacaugaucgacaccaagaagagcagccugaacaucagcggcuacaacuucagccugggcgccgccgugaaggccggcgccugcaugcuggacggcggcaacaugcuggagaccaucaaggugagcccccagaccauggacggcauccugaagagcauccugaaggugaagaaggcccugggcauguucaucagcgacacccccggcgagagaaaccccuacgagaacauccuguacaagaucugccugagcggcgacggcuggcccuacaucgccagcagaaccagcaucaccggcagagccugggagaacaccgugguggaccuggagagcgacggcaagccccagaaggccgacagcaacaacagcagcaagagccugcagagcgccggcuucaccgccggccugaccuacagccagcugaugacccugaaggacgccaugcugcagcuggaccccaacgccaagaccuggauggacaucgagggcagacccgaggaccccguggagaucgcccuguaccagcccagcagcggcugcuacauccacuucuucagagagcccaccgaccugaagcaguucaagcaggacgccaaguacagccacggcaucgacgugaccgaccuguucgccacccagcccggccugaccagcgccgugaucgacgcccugcccagaaacauggugaucaccugccagggcagcgacgacaucagaaagcugcuggagagccagggcagaaaggacaucaagcugaucgacaucgcccugagcaagaccgacagcagaaaguacgagaacgccgugugggaccaguacaaggaccugugccacaugcacaccggcguggugguggagaagaagaagagaggcggcaaggaggagaucaccccccacugcgcccugauggacugcaucauguucgacgccgccgugagcggcggccugaacaccagcgugcugagagccgugcugcccagagacaugguguucagaaccagcacccccagaguggugcuguga

SEQ ID NO: 2250 - RNA, 1710 nt, Artificial Sequence
  derived and/or modified CDS sequence (opt4) from Lassa virus__SCA79106__NP
augagcaacagcaaggaggugaagagcuuccuguggacccagagccugagaagagagcugagcggcuacugcagcaacaucaagcugcagguggugaaggacgcccaggcccugcugcacggccuggacuucagcgaggugagcaacgugcagagacugaugagaaagcagaagagagacgacggcgaccugaagagacugagagaccugaaccaggccgugaacaaccugguggagcugaagagcgugcagcagaagagcauccugagagugggcacccugaccagcgacgaccugcugacccuggccgccgaccuggagaagcugaagagcaaggugaccagaaccgagagaccccugagcagcggcguguacaugggcaaccugagcagccagcagcuggaccagagaagagcccugcugagcaugaucggcaugagcggcggcaaccagaacagccagcccaagggcgacggcguggugagagugugggacgugaagaacgccgaccugcugaacaaccaguucggcaccaugcccagccugacccuggccugccugaccaagcagggccagguggaccugaacgacgccgugcaggcccugaccgaccugggccugaucuacaccgccaaguaccccaacagcagcgaccuggacagacugagccagagccaccccauccugaacaugaucgacaccaagaagagcagccugaacaucagcggcuacaacuucagccugggcgccgccaucaagaccggcgccugcaugcuggacggcggcaacaugcuggagaccaucaaggugaccccccagaccauggacggcauccugaagagcauccugaaggugaagagaagccugggcauguucaucagcgacacccccggcgagagaaaccccuacgagaacauccuguacaagaucugccugagcggcgacggcuggcccuacaucgccagcagaaccgccaucaucggcagagccugggagaacaccgugguggaccuggagagcgacagcaagccccagaagaucggcagcaacggcagcaacaagagccugcagagcgccggcuucgcccccggccugaccuacagccagcugaugacccugaaggacagcaugcugcagcuggaccccaacgccaagaccuggaucgacaucgagggcagacccgaggaccccguggagguggcccuguuccagcccaucagcggcugcuacauccacuucuucagagagcccaccgaccugaagcaguucaagcaggacgccaaguacagccacggcaucgacgugaccgaccuguucgccgcccagcccggccugaccagcgccgugaucgaggcccugcccagaaacauggugcugaccugccagggcagcgacgacaucaagaagcugcuggacagccagggcagaagagacaucaagcugaucgacgugagccugaacaagaucgacagcagaaaguucgagaacgccgugugggaccaguacaaggaccugugccacaugcacaccggcguggugguggagaagaagaagaagggcggcaaggaggagaucaccccccacugcgcccugcuggacugcaucauguucgacgccgccgugagcggcggccugaacgccaccgugcugagagccgugcugcccagagacaugguguucagaaccagcagccccaagguggugcuguga

SEQ ID NO: 2251 - RNA, 1473 nt, Artificial Sequence
  derived and/or modified CDS sequence (opt5) from Lassa virus__AAF86703__GPC
augggccagaucauuaccuucuuucaagaggugccccacgucaucgaagagguuaugaacauugugcugaucgcccucagccugcuugcuauucugaaggggaucuacaauguggccacaugcggacucuucggccugaucuccuuucuucugcucugugggagaucuugcagcgucacguauaaaggaguguacgaacugcagacccuggagcucaacauggcgaaucugaacaugacaaugccucuuuccuguaccaagaauaacucucaucacuauauuaugguuggcaaugaaacagggcuggagcucacccugacaaacaccagcaucauuaaucauaaauucugcaaccuuuccgacgcucacaagaaaaaucuguacgaucaugcccucaugucuaucauuagcacguuucaccuguccaucccgaacuucaaucaguaugaggccaugagcugugacuuuaacggaggcaagauuucugugcaguacaaucugucccacagcuucgcugucgaugccgcuaaccauugcggcaccaucgccaacggggugcuccaaacauuuaugcggauggcguggggaggcucuuauaucgcccuggacuccgggaagggaaauugggauuguauuaugaccagcuaccaguaccuuaucauucagaacacaaccugggaagaccacugccaguucucucgccccuccccuaucggcuaucuggggcuccugagccaaagaacgcgggauauuuacaucucccgcagacuucugggaacauuuaccuggacacucucugacagcgagggcaaugaagcucccggcggguauugucugacccgguggaugcugaucgaggccgagcucaaaugcuucggaaacaccgcuguugccaaguguaaugaaaaacaugaugaggaauuuugcgacaugcugcgccuuuucgauuucaacaagcaggcgauuaaaagacugaagacagaggcccagauguccauccagcucauuaauaaggcugugaacgcccugaucaaugaccaacuuauuaugaaaaaccaucugcgggauaucaugggcaucccuuacugcaauuauagccgcuacugguaucucaaccacacggucaccgggaagacaucucugcccagauguuggcugguguccaauggaagcuaccucaacgaaacccacuuuucugacgacauugagcagcaggcugauaauaugaucacagagaugcugcaaaaagaauacauggaccggcagggcaagaccccucuugggcugguggaucucuucgucuuuagcacguccuucuaucugauuucuaucuuucugcaccuuguuaaaauuccgacacaucgccacaucgugggaaagcccugcccuaaaccccauagacucaaccacaugggcauuuguagcugcggccuguacaagcacccuggggugcccgucaaguggaaacgguga

SEQ ID NO: 2252 - RNA, 1476 nt, Artificial Sequence
  derived and/or modified CDS sequence (opt5) from Lassa virus__AAG41802__GPC
augggccagaucgugaccuucuuucaagaggucccccacguuauugaagaggugaugaacaucgugcugauugcccucagcauccuggcuguccuuaaggggcuguacaauauugccacaugcggacucaucggccugaucacguuccuucugcucugugggagauccugcucuagcaaccuguauaaaggaguguacgaacugcagucccucgaccugaauauggagacccuuaacaugacaaugccucugucuuguaccaagaauaacagccaucacuauauucggguuggcaaugauacagggcucgaacugacccuuacaaacaccuccauccugaaucauaaauuuugcaaccucucugacgcgcacaagaaagaucuguacgaccaugcucugaugagcauuaucuccacguuccaccucagcauuccgaauuuuaaccaguaugaggccaugucuugugauuucaauggaggcaagaucuccgugcaguacaaccugagccacucuuaugccauugacgcugccaaucauugcggcaccgucgcuaacgggauccuucaaacauuuaugcgcauggccuggggaggcuccuacaucgcgcuggauagcgggagaggaaacugggacuguauuaugaccucuuaccaguaucucaucauucagaauacaaccugggagaaccacugccaguucucccggcccagcccuaucggcuaccuggggcuucugucccaacgcacgagagauauuuauaucucucggcgccuccugggaacauuuaccuggacacugagcgacuccgaaggcaaugccacccccggcggguacugucucaccagauggaugcugaucgaggcugaacuuaagugcuucggaaacacagccguggcuaaauguaaugagaagcaugaugaggaauuuugcgacaugcugcgccucuucgauuuuaacaaacaggccauuagccggcugaagucugaggcgcagauguccauccagcuuauuaauaaagccguuaacgcucugaucaaugaccaacucauuaugaagaaccaccugagagacaucaugggcaucccuuauugcaauuacagcaaguauugguaccugaaccacacgauuaccgggaaaacaucucuccccaaguguuggcuggugagcaauggauccuaccuuaacgaaacccauuucucugaugacaucgagcagcaggccgauaauaugauuacagaaaugcugcaaaaagaguauauggagcggcagggcaagaccccucucgggcuggucgaccuguucguguuuagcacguccuucuaccuuaucagcauuuuucuccgccuggugaaaaucccgacacacagacauauugucggaaagcccugcccuaaaccccaccggcugaaccauaugggcaucuguucuugcggccucuauaagcagccugggguucccgugcgcuggaagagauga

SEQ ID NO: 2253 - RNA, 1473 nt, Artificial Sequence
  derived and/or modified CDS sequence (opt5) from Lassa virus__AAL13212__GPC
augggccagaucgugaccuucuuucaagaggucccccacguuauugaagagaucaugaacauugugcugaucacacucagccugcuugccauucugaaggggguguacaaucucgcuacgugcggacugaucggccuuaucaccuuccuguuucucugugggagauccugcucuaugacauauaaaggaagcuaccagcuggaaacccuggagcucaacauggaaacacugaauaugaccaugccucuuuccuguacaaagaacaccucucaucacuauauucgggucggcaaugagacggggcuggagcucacccugacaaacaccagcaucauuaaucauaaauucugcaaccuuuccgacgcccacaagaaaaaucuguacgaucauucucucaugagcaucauuuccacauuucaccugagcaucccgaacuucaaucaguaugaagcgaugucuugugacuuuaacggaggcaagauuuccauccaguacaaucugagccacaccuaugcuggcgaugccgccaagcauugcgggacgcucgcuaacggaauccugcaaacauucaugcgcauggccuggggcgggucuuacauugcucuugacuccggaagaggcaauugggauuguaucaugaccagcuaccaguaucugauuauccagaacacaaccugggaggaccacugccaguuuucucggcccuccccuauuggguaccucggacugcuuagccaacgcaccagagaaaucuauaucucccggcgccugcucggcacauucacguggacccugucugauagcgagggcaacgagaaucccgggggauacugucugacaagauggaugcucauugaagccgagcugaaaugcuuuggcaacaccgcgguggccaaguguaaugaaaaacaugacgaggaguucugcgauaugcuucggcuguuugacuucaacaagcaggcuauccagcgccucaaagccgaagcucagauguccauucaacugaucaauaaggccguuaacgcgcuuauuaaugaucagcugaucaugaagaaccaccucagagacaucauggggauuccuuauugcaauuacagcaaauauugguaccugaaccacacaaccacgggacggacaucucugccccgcuguuggcucguguccaauggcagcuaccugaacgagaccagauucucugaugacaucgaacagcaagccgacaauaugauuaccgagaugcuucagaaggaauauaucgaucggcaggggaaaacaccucugggacucgucgaccuguuuguguucagcaccuccuuuuaccugauuucuaucuuccuucaucucauuaagaucccgacacaccgccauaucguuggcggccccugcccuaaaccccacagacugaaccauaaggggauuuguagcugcggacuguauaaacggccuggcguguccgucagauggaagcgcuga

SEQ ID NO: 2254 - RNA, 1476 nt, Artificial Sequence
  derived and/or modified CDS sequence (opt5) from Lassa virus__AAO59512__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguugcguuucuucugcucugugggagauccugcacgucuagccuguauaaaggaguguacgaacugcagacccucgagcugaacauggaaacacuuaauaugaccaugccucuguccuguacaaagaacaauucucaucacuauauucgggucggcaacgagaccgggcucgagcugacacuuaccaauacgagcaucaucaaccauaaauucugcaaucuguccgacgcucacaagaaaaaccucuacgaucaugcccugaugucuauuaucagcaccuuucaccuguccauuccgaauuucaaccaguaugaagccaugagcugugacuuuaauggaggcaagaucucugugcaguacaaccucucccacagcuaugcuguugaugccgcuaagcauugcggcacaguggccaaugggguccugcaaaccuucaugcgcauggcguggggaggcucuuacauugcccuugacuccgggcacggaagaugggauuguaucaugacaagcuaccaguaucugauuauccagaacaccacgugggaggaccauugccaguuuucucggcccuccccuaucggcuaccucgggcugcuuagccaacgcacaagagauauuuauaucucccggcgccugcucggaaccuucacauggacccugucugacagcgaaggcaaagauacccccggcggguacugucugacaagauggaugcucauugaggcugagcugaagugcuuuggaaacacggccguggcuaaauguaaugaaaagcacgacgaggaguucugcgauaugcuucggcuguuugacuucaacaaacaggccauccagcgccucaagaccgaagcgcagauguccauucaacugaucaauaaggccgugaacgcucuuaucaaugaucagcugauuaugaaaaaccaccucagagacaucaugggcauuccuuauugcaauuacagccgguauugguaccugaaccauacaaccacagggaagaccucucugcccaaauguuggcucgucuccaauggaagcuaccugaacgaaacgcgcuucucugacgauaucgagcagcaagccgacaauaugauuacagagaugcuucagaaggaauauauggagagacagggcaaaaccccucuggggcucguugaucuguuuguguucagcaccuccuuuuaccugaucucuaucuuccuucaccucgugaagauuccgacacaucggcacaucgucggaaaaagcugccccaagccucaucgccugaaccacaugggcauuuguuccugcggccuguauaagcagcccggggugccuguuaaauggaagagauga

SEQ ID NO: 2255 - RNA, 1476 nt, Artificial Sequence
  derived and/or modified CDS sequence (opt5) from Lassa virus__AAT49000__GPC
augggccagaucgugaccuucuuucaagaggucccccacguuauugaagaggugaugaacaucgugcugauugcccucagcauccuggcuguccuuaaggggcuguacaauguggccacaugcggacucauuggccugguuacguuccuuuuucugugugggagauccugcucuaccagccucuauaaaggaguguacgaacugcagacacuggagcucaacauggaaacccugaauaugacaaugccucuuuccuguaccaagaacaauucucaucacuauaucauggucggcaacgagacagggcuggagcucacccugacgaauaccagcaucauuaaccauaaauucugcaaucuuuccgacgcgcacaagaaaaaccuguacgaucauacacucaugucuaucauuagcaccuuucaccuguccaucccgaauuucaaccaguaugaagcuaugagcugugacuuuaauggaggcaagauuucugugcaguacaaccugucccacagcuaugccguugaugccgcuaaucauugcggcacaguggccaacgggguccuccaaaccuucaugcggauggcuuggggaggcucuuacaucgcccuggacuccgggcgcggaaacugggauuguauuaugacgagcuaccaguaucuugugauccagaauacaaccugggaggaccacugccaguuuucuagacccuccccuaucggcuaccuggggcuccugagccaacggacacgcgauauuuauaucuccagacggcuucugggaaccuucaccuggacacucucugacagcgaaggcaaggauacgcccggcggguacugucugacccgcuggaugcugauugaggcggagcucaaaugcuuuggaaacacagccguggcuaaguguaaugaaaaacaugacgaggaguucugcgauaugcugagacuuuuugacuucaacaagcaggccauccagcggcugaaagcugaagcccagauguccauucaacucaucaauaaggcggucaacgcccugaucaaugaucagcuuauuaugaagaaccaucugcgcgacaucaugggcauuccuuauugcaauuacagcaaauauugguaccucaaccacaccguuacagggaagaccucucugcccaaauguuggcugguguccaauggaagcuaccucaacgaaacgcacuucucugacgauaucgagcagcaagcugacaaucugauuacagagaugcuucagaaggaauauauggagagacagggcaaaaccccucuggggcucguggaucuguuugucuucagcaccuccuuuuaccugaucucuaucuuccuucaccucgugaagauuccgacacaucggcacaucguuggaaaacccugcccuaagccccaucgccugaaccacaugggcauuuguagcugcggcguguauaagcagccugggguccccgugagauggaaacgguga

SEQ ID NO: 2256 - RNA, 1476 nt, Artificial Sequence
  derived and/or modified CDS sequence (opt5) from Lassa virus__AAT49004__GPC
augggccagaucgugaccuucuuucaagaggucccccacguuauugaagaggugaugaacaucgugcugauugcccucagcguccuggcugugcuuaaggggcuguacaauuucgccacaugcggacucguuggccuggugacguuucuucugcucugugggagauccugcaccacaucucuguauaaaggagucuacgaacugcagacccucgagcugaacauggaaacacuuaauaugaccaugccucugagcuguacaaagaacaauucccaucacuauaucauggugggcaacgagaccgggcucgagcugacgcuuaccaauacaucuauuaucaaccauaaauucugcaaucugagcgacgcgcacaagaaaaaccucuacgaucaugcucugauguccaucauuucuaccuuucaccugagcaucccgaauuucaaccaguaugaagccauguccugugacuuuaauggaggcaagauuagcguucaguacaaccucucucacuccuaugccggcgaugcugccaaucauugcgggacaguggcuaacggaguccugcaaaccuucaugcggauggccuggggcgggagcuacaucgcgcuugacucuggacgcggcaacugggauuguauuaugacguccuaccaguaucugaucauucagaauacaaccugggaggaccacugccaguuuagcagacccucuccuaucggguaccucggacugcuuucccaacggacacgcgauaucuauauuagcagacggcugcucggcaccuucaccuggacacuguccgacucugaaggcaaggauacgcccgggggauacugucugacccgcuggaugcucaucgaggccgagcugaaaugcuuuggcaacacagcuguggccaaguguaaugaaaaacaugacgaggaguucugcgauaugcuuagacuguuugacuucaacaagcaggcuauucagcggcucaaagccgaagcgcagaugagcauccaacugauuaauaaggccgugaacgcucuuaucaaugaucagcugaucaugaagaaccaccuccgcgacauuauggggaucccuuauugcaauuacuccaaauauugguaccugaaccacaccacaaccggaagaacgagccugcccaaguguuggcucgucucuaauggcuccuaccugaacgaaacacauuucagcgacgauauugagcagcaagccgacaauaugaucaccgagaugcuucagaaagaauauauggagcggcaggggaagaccccucugggacucguugaucuguuuguguucucuaccagcuuuuaccugauuuccaucuuccuucaccucgugaaaaucccgacacaucgccacauugucggcaagucuugccccaaaccucauagacugaaccacaugggcaucuguagcugcgggcuguauaagcagcccggagugccuguuaaguggaaacgguga

SEQ ID NO: 2257 - RNA, 1476 nt, Artificial Sequence
  derived and/or modified CDS sequence (opt5) from Lassa virus__AAT49008__GPC
augggccagaucgugaccuucuuucaagaggucccccacguuauugaagaggugaugaacaucgugcugauugcccucagcauccuggcuguccuuaaggggcuguacaauguggccacaugcggacucauuggccugguuacguuccuuuuucugugugggagauccugcucuaccacacucuauaaaggaguguacgaacugcagacccuggagcucaacauggaaacacugaauaugaccaugccucuuagcuguacaaagaacaauucccaucacuauaucauggucggcaacgagaccgggcuggagcucacgcugaccaauacaucuaucauuaaccauaaauucugcaaucuuagcgacgcgcacaagaaaaaccuguacgaucauacccucauguccaucauuucuacauuucaccugagcaucccgaauuucaaccaguaugaagcuauguccugugacuuuaauggaggcaagauuagcgugcaguacaaccugucucacuccuaugccguugaugccgcuaaucauugcggcaccguggccaacgggguccuccaaacguucaugcggauggcuuggggaggcagcuacaucgcccuggacucugggcgcggaaacugggauuguauuaugacauccuaccaguaucuuaucauccagaauaccacaugggaggaccacugccaguuuagcagacccucuccuauuggcuaccuggggcuccugucccaacggacccgcgauaucuauauuagcagacggcuucugggaaccuucacauggacgcucuccgacucugaaggcaaggauacccccggcggguacugucugacacgcuggaugcugaucgaggcggagcucaaaugcuuuggaaacaccgccguggcuaaguguaaugaaaaacaugacgaggaguucugcgauaugcugagacuuuuugacuucaacaagcaggccauucagcggcugaaagcugaagcccagaugagcauccaacucaucaauaaggcggugaacgcccugauuaaugaucagcuuaucaugaagaaccaucugcgcgacauuaugggcaucccuuauugcaauuacuccagauauugguaccucaaccacacagucaccgggaaaacgagccugcccaaguguuggcugguuucuaauggauccuaccucaacgaaacacacuucagcgacgauauugagcagcaagcugacaaucugaucaccgagaugcuucagaaagaauauauggagcggcagggcaagaccccucuggggcucguggaucuguuuguguucucuaccagcuuuuaccugaucuccauuuuccuucaccucgucaaaaucccgacacaucgccacauugugggaaagcccugcccuaaaccccauagacugaaccacaugggcaucuguucuugcggcguuuauaagcagccuggggugcccguccgguggaagcgcuga

SEQ ID NO: 2258 - RNA, 1473 nt, Artificial Sequence
  derived and/or modified CDS sequence (opt5) from Lassa virus__AAT49010__GPC
augggccagaucgugaccuucuuucaagaggucccccacguuauugaagaggugaugaacaucgugcugauugcccucagcguccuggcuauccuuaaggggcuguacaauuucgccacaugcggacucauuggccuggugacguuucuucugcucuccgggagaucuuguagcaugaucuauaaaggaguuuacgaacugcagacccuggagcucaacauggaaacacugaauaugaccaugccucuuuccugcacaaagaacaccucucaucacuauauccgggugggcaaugacacagggcuggagcucacccugacgaacgagacccuucugcaucacaaauucuguaaucucagcgaugcgcauaagcgcaaccuguacgaccacgcucugauguccauuaucucuacauuucaccucagcauuccgaauuucaaccaguaugaagccauguccugcgauuuuaauggaggcaaaaucaccguccaguacaaccugagccauucuuaugccguggacgcugccaagcacuguggcacaguugcuaauggggugcuucaaaccuucaugagaauggccuggggaggcuccuacauugcgcuggauagccggcaugggaacugggacugcaucaugacgucuuaccaguaucucauuauccagaauacaaccugggaggaucacugucaguuuucccgccccagcccuaucggauaccugggccuucugucucaaagaacacgggacauuuauaucucccgcagacuccuggggaccuucaccuggacacugagcgauuccgaaggaaacgagacgcccggcggcuacugccucacccgguggaugcugauugaggccgaacuuaaguguuuugggaacacagcugucgccaaaugcaaugagaagcacgacgaagaguucugugauaugcugcgccucuuugacuucaacaaacaggcuaucagacggcugaagaccgaagcccagaugucuauucagcuuaucaauaaagcggugaacgcccugaucaaugaucaacucauuaugaagaaccaucugcgcgacaucaugggcauuccuuauugcaauuacagcaaguauugguaccugaaccacacauccaccggaaaaacgagccuccccagaugcuggcuggugucuaauggguccuaccuuaacgagacacauuucagcgacgauaucgagcagcaggcugacaauaugauuaccgaaaugcugcaaaaggaguaucucgaucggcagggaaaaaccccucugggccuggucgaccuuuuuguuuucucuaccagcuuuuaccucaucuccaucuuccugcaccugauuaagaucccgacacaucgccacauuguggggaaacccuguccuaagccccacagacucaaccauaugggaaucugcucuuguggccuguauaaacagccuggcgugcccguccgguggaagagauga

SEQ ID NO: 2259 - RNA, 1473 nt, Artificial Sequence
  derived and/or modified CDS sequence (opt5) from Lassa virus__AAT49014__GPC
augggccagaucauuaccuucuuucaagaggugccccacgucaucgaagagguuaugaacauugugcugaucgcccucagccugcuugcuauucugaaggggcucuacaauaucgccacaugcggaaucauuggccugguggcguuccuuuuucugugugggaaauccugcucucucacgcugaagggaggcuaugaacugcagacccucgagcugaacauggaaacacuuaauaugaccaugccucugagcuguaccaaaaacuccucucaucacuacaucagagucgggaaugagacaggacucgagcugacacuuaccaacacgagcauuaucaaucauaaguucugcaaccuguccgacgcucacaaaaagaaucucuaugaucaugcccugaugucuauuaucagcaccuuucaccuguccauuccgaacuucaaucaguacgaagccaugagcugugacuuuaacggcggcaagaucucugugcaguauaaucucucccacagcuacgcuggggaugccgcugagcauugcggaacaguugccaacggcgugcugcaaaccuucaugcggauggcguggggagggcgcuauaucgcccuugacucuggcaaagggaauugggauuguauuaugacauccuaccaguaccugaucauucagaacaccacgugggaagaccacugccaguuuagcagacccucuccuaucggauaucucggccugcuuucccaacggacacgcgauauuuacaucagcagacggcugcucggcaccuucacauggacccuguccgacucugaggggaacgagacccccggaggcuauugucugacacgcuggaugcucaucgaagcugagcugaagugcuuugggaauacggccgucgcuaaauguaacgaaaagcaugaugaggaguucugcgacaugcuuagacuguuugauuucaauaaacaggccauucggcgccucaaggcggaagcccagaugagcauccagcugauuaacaaggcugugaaugcccuuaucaacgaccaacugauuaugaaaaaucaccucagagauaucaugggaaucccuuacugcaacuauuccaaguacugguaucugaaucacaccagcucuggccggacaucccugcccaaauguuggcucauuagcaacgggucuuaccugaaugagacccaguucagcgacgacaucgaacagcaagcugaucauaugauuacagagaugcuucagaaggaauacaucgagcgccagggaaaaaccccucugggccucguugacauuuuuaucuucuccacgucuuuuuaucugauuagcaucuuccugcaccuuaucaagauuccgacacauagacacaucgugggcaaacccugcccuaagccccaucggcucaaccacaugggggucuguuccugcggacuguacaagcacccuggcgugcccaccaaauggaagcgcuga

SEQ ID NO: 2260 - RNA, 1476 nt, Artificial Sequence
  derived and/or modified CDS sequence (opt5) from Lassa virus__AAV54104__GPC
augggccagaucgugaccuucuuucaagaggucccccacguuauugaagaggugaugaacaucgugcugauugcccucagcguccuggcugugcuuaaggggcuguacaauuucgccacaugcggacucguuggccuggugacguuucuucugcucugugggagauccugcaccacaucucuguauaaaggagucuacgaacugcagacccucgagcugaacauggaaacacuuaauaugaccaugccucugagcuguacaaagaacaauucccaucacuauaucauggugggcaacgagaccgggcucgagcugacgcuuaccaauacaucuauuaucaaccauaaauucugcaaucugagcgacgcgcacaagaaaaaccucuacgaucaugcucugauguccaucauuucuaccuuucaccugagcaucccgaauuucaaccaguaugaagccauguccugugacuuuaauggaggcaagauuagcguucaguacaaccucucucacuccuaugccggcgaugcugccaaucauugcgggacaguggcuaacggaguccugcaaaccuucaugcggauggccuggggcgggagcuacaucgcgcuugacucuggacgcggcaacugggauuguauuaugacguccuaccaguaucugaucauucagaauacaaccugggaggaccacugccaguuuagcagacccucuccuaucggguaccucggacugcuuucccaacggacacgcgauaucuauauuagcagacggcugcucggcaccuucaccuggacacuguccgacucugaaggcgaggauacgcccgggggauacugucugacccgcuggaugcucaucgaggccgaacugaagugcuuuggcaacacagcuguggccaaauguaaugagaagcaugacgaagaguucugcgauaugcuuagacuguuugacuucaacaaacaggcuauucagcggcucaaggccgaagcgcagaugagcauccaacugauuaauaaagccgugaacgcucuuaucaaugaucagcugaucaugaagaaccaccuccgcgacauuauggggaucccuuauugcaauuacuccaaguauugguaccugaaccacaccacaaccggaagaacgagccugcccaaauguuggcucgucucuaauggcuccuaccugaacgagacacauuucagcgacgauauugagcagcaagccgacaauaugaucaccgaaaugcuucagaaggaguauauggaacggcaggggaaaaccccucugggacucguugaucuguuuguguucucuaccagcuuuuaccugauuuccaucuuccuucaccucgugaagaucccgacacaucgccacauugucggcaaaucuugccccaagccucauagacugaaccacaugggcaucuguagcugcgggcuguauaaacagcccggagugccuguuaaguggaagcgguga

SEQ ID NO: 2261 - RNA, 1476 nt, Artificial Sequence
  derived and/or modified CDS sequence (opt5) from Lassa virus__ADI39451__GPC
augggccagaucgugaccuucuuucaagaggucccccacguuauugaagaggugaugaacaucgugcugauugcccucagcguccuggcugugcuuaaggggcuguacaauguugccacaugcggacucaucggccugauugcguuccuucugcucugugggagauccugcacgaccacacuguauaaaggaguguacgaacugcaggcucucgagcugaacauggaaacccuuaauaugacaaugccucugucuuguaccaagaacaauagccaucacuauaucauggucggcaacgagacagggcucgagcugacccuuacgaauaccuccaucauuaaccauaaauuuugcaaucugucugacgcccacaagaaaaaccucuacgaucaugcccugaugagcaucauuuccacauuccaccugucuaucccgaauuuuaaccaguaugaagcuaugagcugugacuucaauggaggcaagauuuccgugcaguacaaccucagccacaccuaugccguugaugcugccaaucauugcggcacaguggcgaacgggguccugcaaaccuuuaugcggauggccuggggaggcucuuacaucgcucuugacuccgggcgcggaagcugggauuguauuaugacgucuuaccaguaucugaucauccagaacacaaccugggaggaccacugccaguucuccagacccagcccuauuggcuaccucgggcugcuuucucaacggacacgcgauaucuauauuuccagacggcugcucggaaccuuuaccuggacacugagcgacuccgaaggcaaggauacgcccggcggguacugucugacccgcuggaugcucaucgaggccgagcugaaaugcuucggaaauacagcuguggccaaguguaacgaaaaacaugacgaggaauuuugcgauaugcuuagacuguucgacuuuaauaagcaggcgauucagcggcucaaagccgaggcucagaugucuauccaacugaucaacaaggccgugaaugcucuuauuaacgaucagcugaucaugaagaaucaccuccgcgacauuaugggcaucccuuauugcaacuacagcaaauauugguaccugaaucacaccauuacagggagaaccucccugcccaaguguuggcucgucagcaacggaucuuaccugaaugaaacgcauuucuccgacgauaucgagcagcaagccgacaacaugaucacagagaugcuucagaaagaauauauugagcggcagggcaagaccccucuggggcucguugaucuguucguguuuagcaccucuuucuaccugaucagcauuuuucuucaccucaucaaaauuccgacacaucgccacaucgugaauaagcccugcccuaaaccccauagacugaaccacaugggagucuguuccugcggccuguauaagcagccuggcgugcccguucgguggaagcgcuga

SEQ ID NO: 2262 - RNA, 1473 nt, Artificial Sequence
  derived and/or modified CDS sequence (opt5) from Lassa virus__ADU56610__GPC
augggccagaucgugaccuucuuucaagaggucccccacguuauugaagaggugaugaacaucgugcugauugcccucagccugcuugcuauccugaaggggauuuacaaugucgccacaugcggacucuucggccugaucuccuuucuucugcucugugggagaucuugcagcacgaccuauaaaggaguguacgaacugcagacacuggagcucgacauggcgaaccugaauaugaccaugccucuuuccuguacaaagaacucuagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacgcuuaugccgucgacgcugccaaccauugcggcacaauugcgaauggggugcuccaaaccuucaugcggauggccuggggaggcucuuacaucgcucuggauuccgggaagggaaacugggacuguaucaugacaagcuaccaguaucuuauuauccagaacaccacgugggaagaucacugccaguuuucucgccccuccccuauuggcuaccuggggcuccugagccaaagaacacgggacaucuauauuucccgcagacuucugggaaccuucacauggacccucucugauagcgagggcaaugaagcccccggcggguacugucugacccgguggaugcugaucgaggcugagcucaaaugcuuuggaaacacagccaucgcgaaguguaaugaaaaacaugacgaggaguucugcgauaugcugcgccuuuuugacuucaacaagcaggccauuaaaagacugaaggcugaagcccagauguccauccagcucauuaauaaggcuguuaacgcccugaucaaugaucaacuuauuaugaaaaaccaucugcgggacaucaugggcaucccuuauugcaauuacagcaaguauugguaccucaaccacacggugaccgggaaaacaucucugccccgcuguuggcugauuuccaauggaagcuaccucaacgaaacccacuucucugacgauaucgagcagcaggccgacaauaugauuacagagcugcuucaaaaggaauauauggauagacagggcaaaaccccucuggggcucgucgaccuguuuguguucagcacguccuuuuaccugaucucuauuuuccuucaccucgugaagaucccgacacaucggcacauugucggacgccccugcccuaaaccccauagacugaaccacaugggcaucuguagcugcggccuguauaagcacccugggguucccgugaaguggaaacgguga

SEQ ID NO: 2263 - RNA, 1473 nt, Artificial Sequence
  derived and/or modified CDS sequence (opt5) from Lassa virus__ADU56618__GPC
augggccagaucgugaccuucuuucaagaggucccccacguuauugaagaggugaugaacaucgugcugauugcccucagcauccuggcuauucuuaaggggcuguacaauaucgccacaugcggacucaucggccuggucacguuccuucugcucuccgggagaucuuguagcaugaccuauaaaggaguguacgaacugcagacacuggagcucaacaugaauacccugaacaugacaaugccucuuuccugcaccaagaauaacucucaucacuauauuaugguuggcaaugaaacagggcuggagcucacccugacgaacaccagccuucugcaucacaaauuuuguaaucucuccgacgcgcauaagaaaaaccuguacgaucacacacugaugucuaucauuagcaccuuccaccucuccaucccgaauuuuaaccaguaugaggcuaugagcugcgacuucaauggaggcaagauuacagugcaguacaaccugucucauuccuaugccaucgaugccgcuaaucacuguggcaccgucgccaacggggugcuucaaacguuuaugcggauggcuuggggaggcagcuacauugcccuggacucugggcgcggaaagugggauugcaucaugacauccuaccaguaucucaucauucagaacaccacaugggaagaccauugucaguucagcagacccucuccuaucggcuaccuggggcuucugucccaacggacccgcgauauuuauaucagcagacggcuccugggaaccuuuacauggacgcuguccgacucugagggcaaugaaacccccggcggguacugccucacacgcuggaugcugauugaggcggagcuuaaauguuucggaaacaccgccguugcuaagugcaaugaaaaacacgaugaggaauuuugugacaugcugagacucuucgauuuuaacaagcaggccauccggcgccugaaagcugaggcccagaugagcauccagcuuauuaauaaggcggugaacgcccugaucaaugaccaacucauuaugaagaaccaccugagagauaucaugggcauuccuuauugcaauuacuccaaauauugguaccugaaccauacaagcaccgggcggacgucucucccccgcugcuggcuggucuccaauggaagcuaccuuaacgaaacacacuucucugacgacaucgagcagcaggcugauaauaugaucaccgagaugcugcaaaaggaauaucucgacagacagggcaaaaccccucuggggcugguggaucuuuucguguuuagcacauccuucuaccucauuucuaucuuucugcaucuggucaagauuccgacccaccggcauaucguuggaaaacccuguccuaagccccaccgccucaaccacaugggcauuugcagcuguggccuguauaaacagccuggggugcccgugagauggaagcgguga

SEQ ID NO: 2264 - RNA, 1473 nt, Artificial Sequence
  derived and/or modified CDS sequence (opt5) from Lassa virus__ADU56622__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggaagggaagcugggacuguaucaugaccucuuaccaguaucuuauuauccagaacacgacaugggaagaucacugccaguuuucccgccccagcccuauuggcuaccuggggcuccugucccaaagaacccgggacaucuauauuucucgcagacuucugggaacauucaccuggacccucagcgauuccgagggcaacgaaacacccggcggguacugucugacgcgguggaugcugaucgaggcugagcucaaaugcuuuggaaauaccgccguugcuaaguguaacgaaaaacaugacgaggaguucugcgauaugcugcgccuuuuugacuucaauaagcaggccaucagacggcugaaaacagaagcgcagaugagcauucagcucaucaacaaggccgugaaugcucugauuaacgaucaacuuaucaugaagaaucaucugcgcgacauuaugggcaucccuuauugcaacuacucuaaauauugguaccucaaucacaccgucacagggaagaccucccugcccagauguuggcuggugagcaacggaucuuaccucaaugaaacgcacuucagcgacgauaucgagcagcaggccgacaacaugauuacagagcugcuucaaaaagaauauaucgaucggcagggcaagaccccucuggggcucguggaccuguuugucuucuccaccucuuuuuaccugauuagcaucuuccuucaccucguuaaaauuccgacacaucgccacgugaucggaaagcccugcccuaaaccccauagacugaaucacaugggcauuuguuccugcggccuguauaagcacccuggggugcccgucaaguggaaacgguga

SEQ ID NO: 2265 - RNA, 1473 nt, Artificial Sequence
  derived and/or modified CDS sequence (opt5) from Lassa virus__ADU56626__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucaacauggcgucccugaauaugaccaugccucuuucuuguacaaagaacaauagccaucacuauaucaugguuggcaacgaaaccgggcuggagcucacacugaccaauacguccauuaucaaccauaaauucugcaaucuuucugacgcucacaagcggaaccuguacgaucaugcccucaugagcauuaucuccaccuuucaccugagcauuccgaauuucaaccaguaugaggccaugucuugugacuuuaauggaggcaaaaucuccgugcaguacaaccugagccacacauaugcugucgaugccgcuaagcauugcggcaccauugccaauggggugcuccaaacauucaugcgcauggcguggggaggcucuuacaucgcccuggacuccgggaagggaagcugggauuguaucaugaccucuuaccaguaucuuauuauccagaacacgacaugggaagaccacugccaguuuuccagacccagcccuauuggcuaccuggggcuccugucccaacggacccgcgauaucuauauuucuagacggcuucugggaacauucaccuggacccucagcgacuccgagggcaacgaaacacccggcggguacugucugacgcgcuggaugcugaucgaggcugagcucaaaugcuuuggaaauaccgccguugcuaaguguaacgaaaaacaugaugaggaguucugcgacaugcugagacuuuuugauuucaauaagcaggccauccggcgccugaaagcggaagcccagaugagcauucagcucaucaacaaggcugugaaugcccugauuaacgaccaacuuaucaugaagaaucaccugagagauauuaugggcaucccuuauugcaacuacucuaaauauugguaccucaaucacacagucaccgggaagacaucccugccccgguguuggcuggugagcaacggaucuuaccucaaugaaacccauuucagcgacgacaucgagcagcaggcugauaacaugauuacggagcugcuucaaaaagaauauaucgaccgccagggcaagacaccucuggggcucguggaucuguuugucuucuccaccucuuuuuaccugauuagcaucuuccuucaccucguuaaaauuccgacccauagacacgugaucggaaagcccugcccuaaaccccaucggcugaaucacaugggcauuuguuccugcggccuguauaagcacccuggggugcccgucaaguggaaacgcuga

SEQ ID NO: 2266 - RNA, 1473 nt, Artificial Sequence
  derived and/or modified CDS sequence (opt5) from Lassa virus__ADU56630__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacgcuuaugccgucgacgcugccaaccauugcggcacaauugcgaauggggugcuccaaaccuucaugcggauggccuggggaggcucuuacaucgcucuggauuccgggaagggaagcugggacuguaucaugacaucuuaccaguaucuuauuauccagaacaccacgugggaagaucacugccaguuuucccgccccagcccuauuggcuaccuggggcuccugucccaaagaacacgggacaucuauauuucucgcagacuucugggaaccuucacauggacccucagcgauuccgagggcaacgaaacccccggcggguacugucugacacgguggaugcugaucgaggccgagcucaaaugcuuuggaaauacggcuguugccaaguguaacgaaaaacaugacgaggaguucugcgauaugcugcgccuuuuugacuucaauaagcaggcgaucagacggcugaaaaccgaagcccagaugagcauucagcucaucaacaaggcugugaaugcccugauuaacgaucaacuuaucaugaagaaucaucugcgcgacauuaugggcaucccuuauugcaacuacucuaaauauugguaccucaaucacacagucaccgggaagacaucccugcccagauguuggcuggugagcaacggaucuuaccucaaugaaacccacuucagcgacgauaucgagcagcaggcugacaacaugauuacggagcugcuucaaaaagaauauauggaucggcagggcaagacaccucuggggcucguggaccuguuugucuucuccaccucuuuuuaccugaucagcauuuuccuucaccucguucgcaucccgacccauagacacgugauuggaaaacccugcccuaagccccaucggcugaaucacaugggcaucuguuccugcggccuguauaaacacccuggggugcccgucaaguggaagcgcuga

SEQ ID NO: 2267 - RNA, 1476 nt, Artificial Sequence
  derived and/or modified CDS sequence (opt5) from Lassa virus__AFY05588__GPC
augggccagaucgugaccuucuuucaagaggucccccacguuauugaagaggugaugaacaucgugcugauugcccucagcguccuggcugugcuuaaggggcuguacaauuucgccacaugcggacucguuggccuggugacguuucuucugcucugugggagauccugcaccacaucucuguauaaaggagucuacgaacugcagacccucgagcugaacauggaaacacuuaauaugaccaugccucugagcuguacaaagaacaauucccaucacuauaucauggugggcaacgagaccgggcucgagcugacgcuuaccaauacaucuauuaucaaccauaaauucugcaaucugagcgacgcgcacaagaaaaaccucuacgaucaugcucugauguccaucauuucuaccuuucaccugagcaucccgaauuucaaccaguaugaagccauguccugugacuuuaauggaggcaagauuagcguucaguacaaccucucucacuccuaugccggcgaugcugccaaucauugcgggacaguggcuaacggaguccugcaaaccuucaugcggauggccuggggcgggagcuacaucgcgcuugacucuggacgcggcaacugggauuguauuaugacguccuaccaguaucugaucauucagaauacaaccugggaggaccacugccaguuuagcagacccucuccuaucggguaccucggacugcuuucccaacggacacgcgaucuguauaucagcagacggcuccugggcaccuucaccuggacacuguccgacucugaaggcgaggauacgcccgggggauacugucucacccgcuggaugcugauugaggccgaacuuaagugcuuuggcaacacagcuguggccaaauguaaugagaagcaugacgaagaguucugcgauaugcugagacucuuugacuucaacaaacaggcuauccagcggcugaaggccgaagcgcagaugagcauucaacuuaucaauaaagccgugaacgcucugauuaaugaucagcucaucaugaagaaccaucugcgcgacaucauggggauuccuuauugcaauuacuccaaguauugguaccugaaccacaccacaaccggaagaacgagccuccccaaauguuggcuggucucuaauggcuccuaccuuaacgagacacacuucagcgacgauaucgagcagcaagccgacaauaugauuaccgaaaugcugcagaaggaguauauggaacggcaggggaaaaccccucucggacugguugaucuguuuguguucucuaccagcuuuuaccuuaucuccauuuuccuccaccuggugaagaucccgacacaucgccacaucgucggcaaaucuugccccaagccucauagacugaaccacaugggcauuuguagcugcgggcucuauaaacagcccggagugccuguuaaguggaagcgguga

SEQ ID NO: 2268 - RNA, 1476 nt, Artificial Sequence
  derived and/or modified CDS sequence (opt5) from Lassa virus__AFY05590__GPC
augggccagaucgugaccuucuuucaagaggucccccacguuauugaagaggugaugaacaucgugcugauugcccucagcguccuggcugugcuuaaggggcuguacaauuucgccacaugcggacucguuggccuggugacguuucuucugcucugugggagauccugcaccacaucucuguauaaaggagucuacgaacugcagacccucgagcugaacauggaaacacuuaauaugaccaugccucugagcuguacaaagaacaauucccaucacuauaucauggugggcaacgagaccgggcucgagcugacgcuuaccaauacaucuauuaucaaccauaaauucugcaaucugagcgacgcgcacaagaaaaaccucuacgaucaugcucugauguccaucauuucuaccuuucaccugagcaucccgaauuucaaccaguaugaagccauguccugugacuuuaauggaggcaagauuagcguucaguacaaccucucucacuccuaugccggcgaugcugccaaucauugcgggacaguggcuaacggaguccugcaaaccuucaugcggauggccuggggcgggagcuacaucgcgcuugacucuggacgcggcaacugggauuguauuaugacguccuaccaguaucugaucauucagaauacaaccugggaggaccacugccaguuuagcagacccucuccuaucggguaccucggacugcuuucccaacggacacgcgauauguauaucagcagacggcugcucggcaccuucaccuggacacuguccgacucugaaggcgaggauacgcccgggggauacugucugacccgcuggaugcucauugaggccgaacugaagugcuuuggcaacacagcuguggccaaauguaaugagaagcaugacgaagaguucugcgauaugcuuagacuguuugacuucaacaaacaggcuauccagcggcucaaggccgaagcgcagaugagcauucaacugaucaauaaagccgugaacgcucuuauuaaugaucagcugaucaugaagaaccaccuccgcgacaucauggggauuccuuauugcaauuacuccaaguauugguaccugaaccacaccacaaccggaagaacgagccugcccaaauguuggcucgucucuaauggcuccuaccugaacgagacacauuucagcgacgauaucgagcagcaagccgacaauaugauuaccgaaaugcuucagaaggaguauauggaacggcaggggaaaaccccucugggacucguugaucuguuuguguucucuaccagcuuuuaccugaucuccauuuuccuucaccucgugaagaucccgacacaucgccacaucgucggcaaaucuugccccaagccucauagacugaaccacaugggcauuuguagcugcgggcuguauaaacagcccggagugccuguuaaguggaagcgguga

SEQ ID NO: 2269 - RNA, 1476 nt, Artificial Sequence
  derived and/or modified CDS sequence (opt5) from Lassa virus__AHC95553__GPC
augggccagaucgugaccuucuuucaagaggucccccacguuauugaagaggugaugaacaucgugcugauugcccucagcauccuggcuguccuuaaggggcuguacaauauugccacaugcggacucaucggccuggugacguucuuucuucugugugggagauccugcucuagcaaccucuauaaaggaguuuacgaacugcagucccuggaccucaauauggagacccugaacaugacaaugccucuuucuuguaccaagaauaacagccaucacuauauccgggugggcaaugaaacagggcuggagcucacccugacaaacaccucccuucuggaucauaaauucugcaaucucucugacgcgcacaagaaaaaccuguacgaucaugcucugaugagcauuaucuccacguuucaccucagcauuccgaauuucaaccaguaugaggccaugucuugugacuuuaauggaggcaagaucaccguccaguacaaccugucccacagcuaugccggcgaugcugcccgccauugcgggacaauugcuaauggagugcuucaaaccuucaugagaauggccuggggcgggucuuacaucgcgcuggacuccggacacggcaacugggauuguauuaugacaagcuaccaguaucucaucauccagaacaccacgugggaagaccauugccaguuuucucggcccuccccuauuggguaccugagccuucugucccaacgcacaagagauaucuauauuucucggcgccuccugggaaccuucacauggacccugagcgacuccgagggcaaugccacccccggcggguacugucucacaagauggaugcugaucgaagcugagcuuaagugcuuuggaaacacggccguugcuaaauguaaugagaagcacgaugaagaguucugcgacaugcugcggcucuuugauuucaacaaacaggccauuagccgccugagaucugaagcgcagauguccauccagcuuaucaauaaggccgugaacgcucugauuaaugaccaacucaucaugaaaaaccaucugcgggacauuaugggcaucccuuauugcaauuacagcaaguauugguaccugaaccacaccgucacagggcgcaccucucuccccaaguguuggcuggugagcaauggauccuaccuuaacgagacacacuucucugaugacauugaacagcaggccgauaauaugaucaccgagaugcugcaaaaagaguauauggacagacagggcaagacgccucucgggcugguggaucuguuugucuucagcacauccuuuuaccuuaucagcauuuuccuccaucugguuaaaaucccgacccaccggcauauugugggaaagcccugcccuaaaccccaccgccugaacagaaugggcaucuguucuugcggccucuauaagcagccuggggugcccgucaaauggaagcgguga

SEQ ID NO: 2270 - RNA, 1476 nt, Artificial Sequence
  derived and/or modified CDS sequence (opt5) from Lassa virus__AHC95555__GPC
augggccagaucgugaccuucuuucaagaggucccccacguuauugaagaggugaugaacaucgugcugauugcccucagcauccuggcuguccuuaaggggcuguacaauauugccacaugcggacucaucggccuggugacguuccuucugcucugugggagauccugcucuagcaaccuguauaaaggaguuuacgaacugcagucccucgaccugaauauggagacccuuaacaugacaaugccucugucuuguaccaagaauaacagccaucacuauauccgggcgggcaaugaaacagggcucgagcugacccuuacaaacaccucccugauuaaucauaaauuuugcaaccucucugaugcucacaagaaaaaucuguacgaccauacgcugaugagcaucauuuccaccuuccaccucagcaucccgaacuuuaaucaguaugaggccaugucuugugauuucaacggaggcaagauuuccgugcaguacaaucugagccacgccuaugcuaucgacgccgcugaacauugcggcacagucgccaacggggugcuucaaaccuuuaugcgcauggcguggggaggcucuuacauugcccuggauuccgggagaggaaacugggacuguaucaugacaagcuaccaguaucucaucauucagaauaccacgugggaggaucacugccaguucucucggcccuccccuaucggcuaccuggggcuucugagccaacgcacaagagacauuuauaucucccggcgccuccugggaaccuuuacauggacccugucugauagcgaaggcaacgcuacccccggcggguacugucucacaagauggaugcugauugaggccgagcuuaagugcuucggaaauacggcuguugccaaauguaacgaaaagcaugacgaggaauuuugcgauaugcugcggcuguucgacuuuaauaaacaggcgaucucccgccucaagagcgaggcccagaugucuauccagcuuauuaacaaagcugugaaugcccugaucaacgaucaacucauuaugaagaaucaccugagagacaucaugggcauuccuuauugcaacuacuccaaguauugguaccugaaucacaccaucacagggcggaccagccuccccaaauguuggcuggucucuaacggaagcuaccuuaaugaaacacauuucuccgacgauaucgagcagcaggcugacaacaugauuaccgagaugcugcaaaaggaauauauggagcgccagggcaaaacgccucucgggcugguggaucuguucguguuuucuaccagcuucuaccuuaucuccauuuuucuccaccuggucaagaucccgacacauagacacauuguuggaaaacccugcccuaagccccaucggcugaaucacaugggcaucuguagcugcggccucuauaaacagccuggggugccccugaaguggaagcgcuga

SEQ ID NO: 2271 - RNA, 1476 nt, Artificial Sequence
  derived and/or modified CDS sequence (opt5) from Lassa virus__AHC95557__GPC
augggccagaucgugaccuucuuucaagaggucccccacguuauugaagaggugaugaacaucgugcugauugcccucagcauccuggcuguccuuaaggggcuguacaauauugccacaugcggacucaucggccuggugacguucuuucuucugugugggagauccugcucuagcaaccucuauaaaggaguuuacgaacugcagucccuggaccucaauauggagacccugaacaugacaaugccucuuucuuguaccaagaauaacagccaucacuauauccgggugggcaaugaaacagggcuggagcucacccugacaaacaccucccuucugaaucauaaauucugcaaccucucugaugcgcacaagcgcaaucuguacgaccaugcucugaugagcauuaucuccacguuucaccucagcauuccgaacuucaaucaguaugaggccaugucuugugauuuuaacggaggcaaaaucaccguccaguacaaucugucccacagcuaugccggcgacacagcuaagcauugcgggaccauugccaacggagugcuucaaacauucaugagaauggcuuggggcgggucuuacaucgcccuggauuccggacacggcaacugggacuguauuaugaccagcuaccaguaucucaucauccagaauacgacaugggaagaucauugccaguuuucucggcccuccccuauuggguaccugggacuucugagccaacgcaccagagacaucuauauuucccggcgccuccugggcacauucaccuggacccugucugauagcgagggcaacgcgacacccgggggauacugucucacgagauggaugcugaucgaagccgagcuuaagugcuuuggcaauaccgcuguugccaaauguaacgagaagcacgacgaagaguucugcgauaugcugcggcucuuugacuucaauaaacaggcuauuucccgccugagaagcgaagcccagaugucuauccagcuuaucaacaaggcggugaaugcccugauuaacgaucaacucaucaugaaaaaucaucugcgggacauuauggggaucccuuauugcaacuacuccaaguauugguaccugaaucacacagucaccggacgcacaagccuccccaaguguuggcuggugucuaacggcagcuaccuuaaugagacccacuucuccgacgauauugaacagcaggcugacaacaugaucacggagaugcugcaaaaagaguauauggauagacaggggaagacaccucucggacugguggaccuguuugucuucucuaccagcuuuuaccuuaucuccauuuuccuccaucugguuaaaaucccgacccaccggcauauugugggcaagcccugcccuaaaccccaccgccugaauagaaugggcaucuguagcugcgggcucuauaagcagccuggagugcccgucaaauggaagcgguga

SEQ ID NO: 2272 - RNA, 1476 nt, Artificial Sequence
  derived and/or modified CDS sequence (opt5) from Lassa virus__AHC95559__GPC
augggccagaucauuaccuucuuucaagaggugccccacgucaucgaagagguuaugaacauugugcugaucgcccucagcauucuggcugugcuuaaggggcuguacaauaucgccacaugcggacucaucggccuggucacguuccuucugcucugugggagauccugcucuagcucccuguauaaaggaguguacgaacugcagucucucgaccugaacauggagacccuuaauaugacaaugccucugagcuguaccaagaacaauucccaucacuauauucggguuggcaacgaaacagggcucgagcugacccuuacaaauaccucucugaucaaccauaaauuuugcaaucucagcgaugcgcacaagaaaaaccuguacgaccaugcucugauguccauuaucagcacguuccaccucucuauuccgaauuuuaaccaguaugaggccauguccugugauuucaauggaggcaagaucagcgugcaguacaaccugucucacgccuaugcuauugacgccgcuucccauugcggcaccgucgccaauggggugcuucaaacauuuaugcgcauggcguggggaggcagcuacaucgcccuggauucugggcacggaaacugggacuguaucaugaccuccuaccaguaucucauuauccagaacacaaccugggaagaucauugccaguucagcagacccuccccuauuggcuaccuggggcuucugucucaacggacgcgcgacaucuauauuagcagacggcuccugggaacauuuaccuggacacuguccgauagcgagggcaaugcuacccccggcggguacugucucacccgcuggaugcugaucgaagccgagcuuaagugcuucggaaacacagcuguugccaaauguaaugagaagcacgacgaagaguuuugcgauaugcugagacucuucgacuuuaacaaacaggcgaucucucggcugaaguccgaagcccagaugagcauucagcuuaucaauaaagcugugaacgcccugauuaaugaucaacucaucaugaagaaccaucugcgcgacauuaugggcaucccuuauugcaauuacucuaaguauugguaccugaaccacacggucaccgggaaaacaagccuccccaaguguuggcugguguccaauggaucuuaccuuaacgagacccacuucagcgacgauaucgaacagcaggcugacaauaugauuacagagaugcugcaaaaagaguauauggaaagacagggcaagaccccucucgggcugguggaucuguucgucuuuuccacgagcuucuaccuuaucucuauuuuucuccaucugguuaaaaucccgacacaccggcauauugugggaaagcccugcccuaaaccccaccgccugaaccacaugggcaucuguuccugcggccucuauaagcagccuggggugcccgucaaguggaaaagauga

SEQ ID NO: 2273 - RNA, 1476 nt, Artificial Sequence
  derived and/or modified CDS sequence (opt5) from Lassa virus__AIT17126__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugcuuacguuucugcuccugugugggagauccugcaccacaggacuguauaaaggcguuuacgaacuccagacccuggagcuuaacauggaaacacugaauaugaccaugccucucucuuguacaaagaacaauagccaucacuauauuaugguggggaacgagaccggacuggagcuuacgcugaccaauacauccaucaucaaccauaaauucugcaaucucucugacgcgcacaagaaaaaccuguacgaucaugcucugaugagcauuaucuccaccuuucaccucucuauuccgaauuucaaccaguaugaagccaugagcugugacuuuaauggcggcaagaucuccguccaguacaaccugagccacucuuaugccggggaugcugccgaccauugcggaacaguggcuaauggcguucuucaaaccuucaugcggauggccuggggaggguccuacauugcgcuggauagcggccgcgggagaugggacuguaucaugacgucuuaccaguaucucauuauccagaacacaaccugggaggaucacugccaguuuucccggcccagcccuaucggauaccugggccuucugucucaacgcacaagagacauuuauaucucccggcgccuccugggcaccuucaccuggacacugagcgauuccgaagggaaggacacgcccggaggcuacugucucaccagauggaugcugauugaggccgagcuuaaaugcuuugggaacacagcuguggccaaguguaaugaaaaacaugaugaggaguucugcgacaugcugcggcucuuugauuucaacaagcaggcuauccagcgccugaaagccgaagcgcagaugucuauucaacuuaucaauaaggccgucaacgcucugaucaaugaccagcucgugaugaagaaccaccugagagacauuaugggaaucccuuauugcaauuacagccgguauugguaccugaaccacaccacaaccggccgcacgucccuccccaaauguuggcuggugagcaaugggucuuaccuuaacgaaacacauuucuccgaugacauugagcagcaagccgauaauaugaucaccgagaugcugcagaaggaauauauggagagacagggaaaaaccccucucggccuggucgaccuguuuguuuucagcacaucuuuuuaccuuauuagcaucuuccuccaccuggugaagaucccgacccaucggcacauugugggcaaauccugccccaagccucaucgccugaaccacauggggaucuguucuugcggacucuauaaacagcccggcgucccugugaaguggaagagauga

SEQ ID NO: 2274 - RNA, 1476 nt, Artificial Sequence
  derived and/or modified CDS sequence (opt5) from Lassa virus__AIT17130__GPC
augggccagaucgugaccuucuuucaagaggucccccacguuauugaagaggugaugaacaucgugcugauugcccucagcauccuggcuguccuuaaggggcuguacaauuucgccacaugcggauuugugggccucguuacguuccugcuucugugugggagauccugcaccacaucucucuauaaaggaguguacgaacugcagacccuggagcucaacauggaaacacugaauaugaccaugccucuuagcuguacaaagaacaauucccaucacuauauucgggucggcaacgacaccgggcuggagcucacgcugaccaauacaucuaucaucaaccauaaauuuugcaaucuuagcgaugcgcacaagaaaaaccuguacgaccaugcucucauguccauuaucucuaccuuccaccugagcauuccgaauuuuaaccaguaugaggccauguccugugauuucaauggaggcaagaucagcgugcaguacaaccugucucacuccuaugccguugacgcugccagccauugcggcacaauugcuaauggggugcuccaaaccuuuaugcgcauggccuggggaggcucuuacaucgcgcuggauuccgggagagaccggugggauuguauuaugacgagcuaccaguaucuuaucauccagaacacaaccugggaagaccacugccaguucucucgccccuccccuauuggauaccugggccuccugagccaaagaacacgggauaucuauauuucccgcagacuucuggggaccuuuaccuggacacucucugacagcgagggaaaggauacgcccggcggcuacugucugacccgguggaugcugaucgaagccgagcucaaaugcuucgggaacacagcugucgccaaguguaaugagaaacaugacgaagaguuuugcgauaugcugcgccuuuucgacuucaacaagcaggcuauucagagacugaaagccgaagcgcagauguccauccaacucaucaauaaggccgugaacgcucugauuaaugaccagcuuaucaugaagaaccaucugcgggauauuaugggaaucccuuauugcaauuacagcaaauauugguaccucaaccacaccacaaccggcaagacgucucugcccaaauguuggcugguguccaaugggagcuaccucaacgagacacacuuuucugacgauauugaacagcaagccgacaauaugaucaccgagaugcugcagaaggaguauauggaacgccagggaaaaaccccucuuggccuggucgaucucuucguuuuuagcacauccuucuaccugaucucuauuuuucugcaccuugugaagaucccgacccauagacacauuguggggaaaagcugccccaagccucaucggcucaaccacaugggaaucuguuccugcggccuguauaagcagcccggcgucccugugaaauggaagcgcuga

SEQ ID NO: 2275 - RNA, 1476 nt, Artificial Sequence
  derived and/or modified CDS sequence (opt5) from Lassa virus__AIT17134__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauuauggucggcaacgagaccgggcucgagcugacgcuuaccaauacaucuaucaucaaccauaaauucugcaaucugagcgacgcgcacaagaaaaaccucuacgaucaugcucugauguccauuaucucuaccuuucaccugagcauuccgaauuucaaccaguaugaagccauguccugugacuuuaauggaggcaagaucagcgugcaguacaaccucucucacuccuaugccggcgaugcugccaaucauugcgggacaguugcuaacggagugcugcaaaccuucaugcggauggccuggggcgggagcuacauugcgcuugacucuggacgcggcagaugggauuguaucaugacguccuaccaguaucugauuauccagaacacaaccugggaggaccacugccaguuuagccggcccucuccuaucggguaccucggacugcuuucccaacgcacaagagauauuuauaucagccggcgccugcucggcaccuucaccuggacacuguccgacucugaaggcaaggauacgcccgggggauacugucugaccagauggaugcucauugaggccgagcugaaaugcuuuggcaauacagcugucgccaaguguaacgaaaaacaugacgaggaguucugcgauaugcuucggcuguuugacuucaauaagcaggcuauccagcgccucaaagccgaagcgcagaugagcauucaacugaucaacaaggccgugaaugcucuuaucaacgaucagcugauuaugaagaaucaccucagagacaucauggggauuccuuauugcaacuacuccaaauauugguaccugaaucacaccacaaccggaaagacgagccugcccaaauguuggcucgugucuaacggcuccuaccugaaugaaacacauuucagcgacgauaucgagcagcaagccgacaacaugauuaccgagaugcuucagaaggaauauauggagcggcaggggaaaaccccucugggacucgucgaucuguuuguuuucucuaccagcuuuuaccugaucuccaucuuccuucaccucgugaagauuccgacacaucgccacaucgugggcaaaucuugccccaagccucauagacugaaucacaugggcauuuguagcugcgggcuguauaagcagcccggagucccugugaaauggaagcgguga

SEQ ID NO: 2276 - RNA, 1476 nt, Artificial Sequence
  derived and/or modified CDS sequence (opt5) from Lassa virus__AIT17138__GPC
augggccagaucgugaccuucuuucaagaggucccccacguuauugaagaggugaugaacaucgugcugauugcccucagcauccuggcuguccuuaaggggcuguacaaucucgccacaugcggacuggugggccuuguuacguuccugcuccugugugggagauccugcaccacaucucuguauaaaggaguguacgaacuccagacccuggagcuuaacauggaaacacugaauaugaccaugccucucagcuguacaaagaacaauucccaucacuauauuauggucggcaacgagaccgggcuggagcuuacgcugaccaauacaucucucaucaaccauaaauuuugcaaucugagcgacgcgcacaagaaaaaccuguacgaucaugcucucauguccaucauuucuaccuuccaccugagcaucccgaauuuuaaccaguaugaagccauguccugugacuucaauggaggcaagauuagcgugcaguacaaccuuucucacuccuaugccguugaugcugccagccauugcggcacaguggcuaaugggguccugcaaaccuuuaugcggauggccuggggaggcucuuacaucgcgcucgacuccgggcgcggaggcugggauuguauuaugacgagcuaccaguaucugaucauucagaacacaaccugggaggaccacugccaguucucuagacccuccccuaucggguaccuuggacugcucagccaacggacacgcgauaucuauauuuccagacggcugcugggcaccuuuaccuggacacucucugacagcgaaggcaaggauacgcccgggggauacugucugacccgcuggaugcuuaucgaggccgagcugaaaugcuucggcaacacagcuguggccaaguguaaugaaaaacaugacgaggaauuuugcgauaugcucagacuguucgacuuuaacaagcaggcuauucagcggcuuaaagccgaggcgcagauguccauccaacugauuaauaaggccgugaacgcucucaucaaugaucagcugaucaugaagaaccaucugcgcgacauuauggggaucccuuauugcaauuacagcaaauauugguaccucaaccacaccacaaccggaagaacgucucugccccgguguuggcuugucuccaauggcagcuaccugaacgaaacacacuucucugacgauauugagcagcaagccgacaauaugaucaccgagaugcuccagaaggaauauauggagcgccaggggaaaaccccucugggacugguugaucuuuucguguuuagcacauccuucuaccucauuucuaucuuucugcaccuggugaagaucccgacccauagacacauugucggcaaaagcugccccaagccucaucggcucaaccacaugggcaucuguuccugcgggcuguauaaacagcccggagugccuguuaaguggaagcgcuga

SEQ ID NO: 2277 - RNA, 1476 nt, Artificial Sequence
  derived and/or modified CDS sequence (opt5) from Lassa virus__AIT17142__GPC
augggccagaucgugaccuucuuucaagaggucccccacguuauugaagaggugaugaacaucgugcugauugcccucagcguccuggcugugcuuaaggggcuguacaauuucgccacaugcggaaucguuggccucgugacguuucugcuucugugugggagauccugcaccacaucucucuauaaaggagucuacgaacugcagacccuggagcucaacauggaaacacugaauaugaccaugccucuuagcuguacaaagaacaauucccaucacuauauuauggugggcaacgacaccgggcuggagcucacgcugaccaauacaucuaucaucaaccauaaauucugcaaucuuagcgaugcgcacaagaaaaaccuguacgaccaugcucucauguccauuaucucuaccuuucaccugagcauuccgaauuucaaccaguaugaggccauguccugugauuuuaauggaggcaagaucagcguucaguacaaccugucucacuccuaugccggcgacgcugccgaucauugcgggacaguggcuaauggaguccuccaaaccuucaugcggauggccuggggcgggagcuacauugcgcuggacucuggacgcggcagaugggauuguaucaugacguccuaccaguaucuuauuauccagaacacaaccugggaagaccacugccaguuuagccggcccucuccuaucggguaccugggacuccugucccaacgcacaagagauauuuauaucagccggcgccuucugggcaccuucaccuggacacucuccgacucugagggcaaggauacgcccgggggauacugucugaccagauggaugcugauugaagccgagcucaaaugcuuuggcaacacagcuguggccaaguguaaugagaaacaugacgaagaguucugcgauaugcugcggcuuuuugacuucaacaagcaggcuauccagcgccugaaagccgaagcgcagaugagcauucaacucaucaauaaggccgugaacgcucugaucaaugaccagcuuauuaugaagaaccaccugagagauaucauggggauuccuuauugcaauuacuccaaauauugguaccucaaccacaccacaaccggaaagacgagccugcccaaauguuggcuggucucuaauggcuccuaccucaacgagacacauuucagcgacgauaucgaacagcaagccgacaauaugauuaccgagaugcugcagaaggaguauauggaacggcaggggaaaaccccucuuggacugguugaucucuuuguguucucuaccagcuuuuaccugaucuccaucuuccugcaccuugugaagauuccgacacaucgccacaucgucggcaaacccugcccuaagccccauagacucaaccacaugggcauuuguucuugcgggcuguauaagcagccuggagugcccguuaaauggaagcgguga

SEQ ID NO: 2278 - RNA, 1476 nt, Artificial Sequence
  derived and/or modified CDS sequence (opt5) from Lassa virus__AIT17146__GPC
augggccagaucgugaccuucuuucaagaggucccccacguuauugaagaggugaugaacaucgugcugauugcccucagcauccuggcuguccuuaaggggcuguacaaucucgccacaugcggacuggugggccuuguuacguuccugcuccugugugggagauccugcaccacaucucuguauaaaggaguguacgaacuccagacccuggagcuuaacauggaaacacugaauaugaccaugccucucagcuguacaaagaacaauucccaucacuauauuauggucggcaacgagaccgggcuggagcuuacgcugaccaauacaucuaucaucaaccauaaauuuugcaaucucagcgacgcgcacaagaaaaaccuguacgaucaugcucugauguccauuaucucuaccuuccaccucagcauuccgaauuuuaaccaguaugaagccauguccugugacuucaauggaggcaagaucagcgugcaguacaaccugucucacuccuaugccggcgaugcugccaaucauugcgggacaguugcuaacggagugcuucaaaccuuuaugcggauggccuggggcgggagcuacauugcgcuggacucuggacgcggcagaugggauuguaucaugacguccuaccaguaucucauuauccagaacacaaccugggaggaccacugcagcuucucucggcccuccccuaucggguaccugggacuucugagccagcgcacaagagauauuuauaucucccggcgccuccugggcaccuuuaccuggacacugucugacagcgaaggcaaggauacgcccgggggauacugucucaccagauggaugcugauugaggccgagcuuaaaugcuucggcaauacagcugucgccaaguguaacgaaaaacaugacgaggaauuuugcgauaugcugcgccucuucgacuuuaauaagcaagcuauccagcggcugaaagccgaggcgcagauguccauucagcuuaucaacaaggccgugaaugcucugaucaacgaucaacucauuaugaagaaucaccugagagacaucauggggauuccuuauugcaacuacagcaaauauugguaccugaaucacaccacaaccggaaagacgucucuccccaaauguuggcugguguccaacggcagcuaccuuaaugaaacacauuucucugacgauaucgagcagcaggccgacaacaugauuaccgagaugcugcaaaaggaauauauggagcggcaggggaaaaccccucucggacuggucgaucuguucguuuuuagcacauccuucuaccuuaucucuaucuuucuccaccuggugaagauuccgacccaucgccacaucgugggcaaaagcugccccaagccucauagacugaaucacaugggcauuuguuccugcggguucuauaagcagcccggagucccugugaaauggaagcgguga

SEQ ID NO: 2279 - RNA, 1476 nt, Artificial Sequence
  derived and/or modified CDS sequence (opt5) from Lassa virus__AIT17154__GPC
augggccagaucgugaccuucuuucaagaggucccccacguuauugaagaggugaugaacaucgugcugauugcccucagcauccuggcuguccuuaaggggcuguacaauuucgccacaugcggaauugugggccucguuuccuuucugcuucugugugggagaucuugcacgaccagccucuauaaaggaguguacgaacugcagacacuggagcucaacauggaaacccugaauaugacaaugccucuuuccuguaccaagaacaauucucaucacuauaucauggucggcaacgagacagggcuggagcucacccugacgaauaccagcaucauuaaccauaaauucugcaaucuuuccgacgcgcacaagaaaaaccuguacgaucaugcucucaugucuaucauuagcacauuucaccuguccaucccgaauuucaaccaguaugaagccaugagcugugacuuuaauggaggcaagauuucugugcaguacaaccugucccacagcuaugccggcgaugcugccaaucauugcgggaccaucgcuaacggaguucuccaaacauucaugcggauggccuggggcgggucuuacauugcgcuggacuccggacgcgauagaugggacuguaucaugaccagcuaccaguaucuuaucauucagaacacgacaugggaggaucacugccaguuuucucggcccuccccuaucggcuaccuggggcuccugagccaacgcaccagagacauuuauaucucccggcgccuucugggaacauucaccuggacccucucugauagcgaaggcaaggacacacccggcggguacugucugacgagauggaugcugauugaggccgagcucaaaugcuuuggaaauaccgcuguggccaaguguaacgaaaaacaugaugaggaguucugcgacaugcugcggcuuuuugauuucaauaagcaggcuauccagcgccugaaagccgaagcgcagauguccauccaacucauuaacaaggccgucaaugcucugaucaacgaccagcuuauuaugaagaaucaccugagagacaucaugggcauuccuuauugcaacuacagcaaauauugguaccucaaucacacaaccacagggaagaccucucugcccaaauguuggcugguguccaacggaagcuaccucaaugaaacgcauuucucugaugacaucgagcagcaagccgauaacaugaucacagagaugcugcagaaggaauauauggagcggcagggcaaaaccccucuugggcugguggaccucuuugucuucagcaccuccuuuuaccugauuucuaucuuccugcaccuuguuaagauuccgacacaucgccacguggugggaaaaagcugccccaagccucauagacucaaucacaugggcaucuguuccugcggccuguaugggcagcccggagucccugugaaguggaaacgguga

SEQ ID NO: 2280 - RNA, 1476 nt, Artificial Sequence
  derived and/or modified CDS sequence (opt5) from Lassa virus__AIT17158__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauuauggucggcaacgagaccgggcucgagcugacgcuuaccaauacaucuaucaucaaccauaaauucugcaaucugagcgacgcgcacaagaaaaaccucuacgaucaugcucugauguccauuaucucuaccuuucaccugagcauuccgaauuucaaccaguaugaagccauguccugugacuuuaauggaggcaagaucagcgugcaguacaaccucucucacuccuaugccggcgaugcugccaaucauugcgggacaguugcuaacggagugcugcaaaccuucaugcggauggccuggggcgggagcuacauugcgcuugacucuggacgcgauagaugggacuguaucaugacguccuaccaguaucugauuauccagaacacaaccugggaggaucacugccaguuuagccggcccucuccuaucggcuaccucgggcugcuuucccaacgcacaagagacauuuauaucagccggcgccugcucggaaccuucaccuggacacuguccgauucugaaggcaaggacacgcccggcggguacugucugaccagauggaugcucauugaggccgagcugaaaugcuuuggaaauacagcugucgccaaguguaacgaaaaacaugaugaggaguucugcgacaugcuucggcuguuugauuucaauaagcaggcuauccagcgccucaaagccgaagcgcagaugagcauucaacugaucaacaaggccgugaaugcucuuaucaacgaccagcugauuaugaagaaucaccucagagacaucaugggcauuccuuauugcaacuacuccaaauauugguaccugaaucacaccacaaccgggaagacgagccugcccaaauguuggcucgugucuaacggauccuaccugaaugaaacacauuucagcgaugacaucgagcagcaagccgauaacaugauuaccgagaugcuucagaaggaauauauggagcggcagggcaaaaccccucuggggcucgucgaccuguuuguuuucucuaccagcuuuuaccugaucuccaucuuccuucaccucgugaagauuccgacacaucgccacaucgugggaaaaucuugccccaagccucauagacugaaucacaugggcauuuguagcugcggccuguauaagcagcccggggucccugugaaauggaagcgguga

SEQ ID NO: 2281 - RNA, 1476 nt, Artificial Sequence
  derived and/or modified CDS sequence (opt5) from Lassa virus__AIT17164__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccucuagccuguauaaaggaguguacgaacugcagacacucgagcugaacauggaaacccuuaauaugacaaugccucuguccuguaccaagaacaauucucaucacuauauucgggucggcaacgagacagggcucgagcugacccuuacgaauaccagcaucaucgaccauaaauucugcaaccuguccgaugcgcacaagaaaaaucucuacgaccaugcucugaugucuauuaucagcacauuucaccuguccauuccgaacuucaaucaguaugaagccaugagcugugauuuuaacggaggcaagaucucugugcaguacaaucucucccacagcuaugccggcgacgcugccaagcauugcgggaccguugcuaacggagugcugcaaacauucaugcgcauggccuggggcgggucuuacauugcgcuugauuccggacacggcaauugggacuguaucaugaccagcuaccaguaucugauuauccagaacacgacaugggaggaucauugccaguuuucuagacccuccccuaucggguaccucggacugcuuagccaacggacccgcgacauuuauaucuccagacggcugcucggcacauucaccuggacccugucugauagcgaaggcaacgacgcccccgggggauacugucugacacgcuggaugcucauucaggcugagcugaaaugcuuuggcaauacggccgucgcuaaguguaacgagaaacacgaugaagaguucugcgacaugcuuagacuguuugauuucaauaagcaggccauccagcggcucaaagcggaagcccaaauguccauucagcugaucaacaaggcugugaaugcccuuaucaacgaccagcugauuaugaagaaucaccuccgcgacaucauggggauuccuuauugcaacuacagcaaauauugguaccugaaucauaccacaaccggaagaacaucucugccccgguguuggcucguguccaacggcagcuaccugaaugagacccacuucucugaugacaucgaacaacaggcugauaacaugauuacggagaugcuucagaaggaguauauggaacgccaggggaaaacaccucugggacucgucgaccuguuuguuuucagcaccuccuuuuaccugaucucuaucuuccuucaucucgugaagauuccgacccacagacauaucgugggcaaaagcugccccaagccucaccggcugaaucacaugggcauuuguuccugcgggcuguuuaaacaacccggagucccugugaaguggaagcgcuga

SEQ ID NO: 2282 - RNA, 1476 nt, Artificial Sequence
  derived and/or modified CDS sequence (opt5) from Lassa virus__AIT17168__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugcuuacguuucugcuccugugugggagauccugcaccgcgucucgguauaaaggaguuuacgaacugcagacacucgagcugaacauggaaacccuuaauaugacaaugccucugagcuguaccaagaacaauucccaucacuauauuauggugggcaacgagacagggcucgagcugacccuuacgaauaccucuaucaucaaccauaaauucugcaaucugagcgacgcucacaagaaaaaccucuacgaucaugcccugauguccauuaucucuacauuucaccugagcauuccgaauuucaaccaguaugaagccauguccugugacuuuaauggaggcaagaucagcguccaguacaaccucucucacuccuaugcuggcgaugccgcuaaucauugcgggaccguggccaacggaguucugcaaacauucaugcgcauggcguggggcgggagcuacauugcccuugacucuggacacggcuccugggauuguaucaugaccagcuaccaguaucugauuauccagaacacgacaugggaggaccauugccaguuuucuagacccuccccuaucggguaccucggacugcuuagccaacggacccgcgauauuuauaucuccagacggcugcucggcacauucaccuggacccugucugacagcgaaggcaaggauacacccgggggauacugucugacgcgcuggaugcucauugaggcugagcugaaaugcuuuggcaauaccgccguggcuaaguguaacgaaaaacacgacgaggaguucugcgauaugcuuagacuguuugacuucaauaagcaggccauccagcggcucaaagcggaagcccagauguccauucaacugaucaacaaggcugucaaugcccuuaucaacgaucagcugauuaugaagaaucaccuccgcgacaucauggggauuccuuauugcaacuacagcaaauauugguaccugaaucauacaaccacaggaaagaccucucugcccaaauguuggcucguguccaacggcagcuaccugaaugaaacgcacuucucugacgauaucgagcagcaagcugacaacaugauuacagagaugcuucagaaggaauauauggagagacaggggaaaaccccucugggacucguggaucuguuugucuucagcaccuccuuuuaccugaucucuaucuuccuucaucucguuaagauuccgacacaccggcauaucgugggcaaaagcugccccaagccucaccgccugaaucacaugggcauuuguuccugcgggcuguauaagcagcccggagugccugucaaauggaagagauga

SEQ ID NO: 2283 - RNA, 1476 nt, Artificial Sequence
  derived and/or modified CDS sequence (opt5) from Lassa virus__AIT17172__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauuauggucggcaacgagaccgggcucgagcugacgcuuaccaauacaucuaucaucaaccauaaauucugcaaucugagcgacgcgcacaagaaaaaccucuacgaucaugcucugauguccauuaucucuaccuuucaccugagcauuccgaauuucaaccaguaugaagccauguccugugacuuuaauggaggcaagaucagcgugcaguacaaccucucucacuccuaugccggcgaugcugccaaucauugcgggacaguugcuaacggagugcugcaaaccuucaugcggauggccuggggcgggagcuacauugcgcuugacucuggacgcggcagaugggauuguaucaugacguccuaccaguaucugauuauccagaacacaaccugggaggaccacugccaguuuagccggcccucuccuaucggguaccucggacugcuuucccaacgcacaagagauauuuauaucagccggcgccugcucggcaccuucaccuggacacuguccgacucugaaggcaaggauacgcccgggggauacugucugaccagauggaugcucauugaggccgagcugaaaugcuuuggcaauacagcugucgccaaguguaacgaaaaacaugacgaggaguucugcgauaugcuucggcuguuugacuucaauaagcaggcuauccagcgccucaaagccgaagcgcagaugagcauucaacugaucaacaaggccgugaaugcucuuaucaacgaucagcugauuaugaagaaucaccucagagacaucauggggauuccuuauugcaacuacuccaaauauugguaccugaaucacaccacaaccggaaagacgagccugcccaaauguuggcucgugucuaacggcuccuaccugaaugaaacacauuucagcgacgauaucgagcagcaagccgacaacaugauuaccgagaugcuucagaaggaauauauggagcggcaggggaaaaccccucugggacucgucgaucuguuuguuuucucuaccagcuuuuaccugaucuccaucuuccuucaccucgugaagauuccgacacaucgccacaucgugggcaaacccugcccuagaccccaucggcugaaucacaugggcauuuguucuugcgggcuguauaagcagccuggaguccccgugaaguggaaacgcuga

SEQ ID NO: 2284 - RNA, 1476 nt, Artificial Sequence
  derived and/or modified CDS sequence (opt5) from Lassa virus__AIT17176__GPC
augggccagaucgugaccuucuuucaagaggucccccacguuauugaagaggugaugaacaucgugcugauugcccucagccugcuugcuguccugaaggggcucuacaauguggccacaugcggacugaucggccuuauuacguuccugcuccugugugggagauccugcaccacaaaccuguauaaaggaguuuacgaacuccaggcgcuggagcuuaauauggaaacccugaacaugacaaugccucucucuuguaccaagaauaacagccaucacuauaucauggugggcaaugagacagggcuggagcuuacccugacgaacaccuccaucauuaaucauaaauuuugcaaccucucugacgcucacaagaaaaaucuguacgaucaugcccugaugagcaucauuuccacauuccaccucucuaucccgaacuuuaaucaguaugaagccaugagcugugacuucaacggaggccggauuuccguccaguacaaucugagccacucuuaugcuggcgaugccgcuucccauugcgggaccaucgccaacggagugcuucaaacauuuaugcgcauggcguggggcgggagcuacauugcccuggacucuggacacggcgggugggauuguaucaugaccuccuaccaguaucucaucauucagaacacgacaugggaggaccauugccaguucagcagacccucuccuaucggauaccugggccuucugucccaacggacccgcgauauuuauaucagcagacggcuccugggcacauuuaccuggacccuguccgacucugaagggaaggauacacccggaggcuacugucucacgcgcuggaugcugauugaggcugagcuuaagugcuucgggaauaccgccguugcuaaauguaacgaaaagcacgacgaggaauuuugcgauaugcugagacucuucgacuuuaauaaacaggccauccagcggcugaaggcggaggcccagaugagcauccaacuuauuaacaaagcugugaaugcccugaucaacgaucagcucauuaugaagaaucaucugcgcgacaucaugggcauuccuuauugcaacuacuccaaguauugguaccugaaucacacagucaccggaaaaacaagccuccccaaguguuggcuggugucuaacggguccuaccuuaaugaaacccacuucagcgacgauaucgagcagcaagcugacaacaugaucacggagaugcugcagaaagaauauauggagagacagggaaagacaccucucggccugguggaucuguucgucuuuucuaccagcuucuaccuuauuuccaucuuucuccaucugguuaaaauuccgacccaccggcauguggugggcaagcccugcccuaaaccccaccgccugaaucacauggggaucuguucuugcggacucuauaagcagccuggcguccccgugagauggaagcgguga

SEQ ID NO: 2285 - RNA, 1476 nt, Artificial Sequence
  derived and/or modified CDS sequence (opt5) from Lassa virus__AIT17180__GPC
augggccagaucgugaccuucuuucaagaggucccccacguuauugaagaggugaugaacaucgugcugauugcccucagcauccuggcuguccuuaaggggcuguacaauguggccacaugcggacucauuggccugguuacguuccuucugcucugugggagauccugcaccacaacccuguauaaaggaguguacgaacugcagacacucgagcugaacauggaaacccuuaauaugacaaugccucugucuuguaccaagaacaauagccaucacuauauccgggucggcaacgagacggggcucgagcugacccuuacaaauaccuccaucauuaaccauaaauuuugcaaucugucugacgcgcacaagaaaaaccucuacgaucaugcucugaugagcaucauuuccacauuccaccugucuaucccgaauuuuaaccaguaugaagccaugagcugugacuucaauggaggcaagauuuccgugcaguacaaccucagccacucuuaugccggcgaugcugccaaucauugcgggaccguugcuaacggagugcugcaaacguuuaugcgcauggccuggggcggguccuacaucgcgcuugacagcggaagaggcaacugggauuguauuaugacaucuuaccaguaucugaucauccagaauaccacaugggacgaucacugccaguucucccggcccagcccuauuggguaccucggacugcuuucucaacgcaccagagacgucuauaucucccggcgccugcucggcaccuuuacauggacgcugagcgauuccgagggcaaggacacccccgggggauacugucugacaagauggaugcucauugaagccgagcugaaaugcuucggcaacaccgcuguggccaaguguaaugagaaacaugaugaagaguuuugcgacaugcuucggcuguucgauuuuaacaagcaggcuauccagcgccucaaagccgaagcgcagaugucuauucaacugaucaauaaggccgugaacgcucuuaucaaugaccagcugauuaugaagaaccaccucagagacaucauggggauuccuuauugcaauuacagcaaauauugguaccugaacaauacagccaccggaaagacgucccugcccaaauguuggcucaucagcaacggcucuuaccugaaugagacacacuucuccgaugacauugaacaggaggcugauaacaugaucaccgagaugcuucaaaaggaauauauggagcggcaggggaaaaccccucugggacucgucgaccuguucguuuuuagcacaucuuucuaccugaucagcauuuuucuucaucucgugaagaucccgacccaccgccauauugugggcaaauccugccccaagccucacagacugaaucauaugggcaucuguucuugcgggcuguauaagcagcccggagucccugugcgguggaaacgcuga

SEQ ID NO: 2286 - RNA, 1476 nt, Artificial Sequence
  derived and/or modified CDS sequence (opt5) from Lassa virus__AIT17184__GPC
augggccagaucgugaccuucuuucaagaggucccccacguuauugaagaggugaugaacaucgugcugauugcccucagcauccuggcuguccuuaaggggcuguacaauguggccacaugcggacucauuggccugguuacguuccuucugcucugugggagauccugcaccacaacccuguauaaaggaguguacgaacugcaggcgcucgagcugaacauggaaacacuuaauaugaccaugccucugucuuguacaaagaacaauagccaucacuauauccgggucggcaacgagaccgggcucgagcugacgcuuaccaauacauccaucauugaccauaaauuuugcaaccugucugaugcucacaagaaaaaucucuacgaccaugcccugaugagcaucauuuccaccuuccaccugucuaucccgaacuuuaaucaguaugaagccaugagcugugauuucaacggaggcaagauuuccgugcaguacaaucucagccacucuuaugcuggcgacgccgcuaaccauugcgggacaguugccaauggagugcugcaaaccuuuaugcgcauggcguggggcggguccuacaucgcccuugauagcggaagaaacggcugggacuguauuaugacgucuuaccaguaucugaucauccagaacacaaccugggaugaccacugccaguucucccggcccagcccuauuggguaccucggacugcuuucucaacgcacaagagauaucuauauuucccggcgccugcucggcaccuuuaccuggacacugagcgacuccgagggcaaggauacgcccgggggauacugucugaccagauggaugcucaucgaagcugagcugaaaugcuucggcaauacagccgucgcuaaguguaacgagaaacaugacgaagaguuuugcgauaugcuucggcuguucgacuuuaauaagcaggccauucgcagacucaaagcggaagcccagaugucuauccagcugaucaacaaggcugugaaugcccuuauuaacgaccaacugaucaugaagaaucaccuccgggauauuauggggaucccuuauugcaacuacagcaaauauugguaccugaauaacaccgcuacaggaaagaccucccugccccgcuguuggcucgugagcaauggcucuuaccugaacgagacgcacuucuccgacgauauugaacagcaggccgacaauaugaucacagagaugcuucaaagagaguauauggaacggcaggggaaaaccccucugggacucgucgaucuguucguuuuuagcaccucuuucuaccugaucagcauuuuucuucaucucgugaagaucccgacacaccgccauauugugggcaaacccugcccuaagccccacagacugaaccauaugggcaucuguuccugcgggcuguauaaacagccuggaguccccgugaaguggaagcgguga

SEQ ID NO: 2287 - RNA, 1476 nt, Artificial Sequence
  derived and/or modified CDS sequence (opt5) from Lassa virus__AIT17188__GPC
augggccagaucgugaccuucuuucaagaggucccccacguuauugaagaggugaugaacaucgugcugauugcccucagcauccuggcuguccuuaaggggcuguacaauuucgccacaugcggauuugugggccucguuuccuuccugcuucugugugggagaucuugcacgaccagccucuauaaaggaguguacgaacugcagacacuggagcucaacauggaaacccugaauaugacaaugccucuuuccuguaccaagaacaauucucaucacuauauuauggucggcaacgagacagggcuggagcucacccugacgaauaccagcaucaucaaccauaaauuuugcaaucuuuccgacgcgcacaagaaaaaccuguacgaucaugcucucaugucuauuaucagcacauuccaccuguccauuccgaauuuuaaccaguaugaagccaugagcugugacuucaauggaggcaagaucucugugcaguacaaccugucccacagcuaugccguugaugcugccaaucauugcggcaccguggcuaacgggguccuccaaacauuuaugcggauggccuggggaggcucuuacauugcgcuggacuccgggcacggaagcugggauuguaucaugaccucuuaccaguaucuuauuauccagaacacgacaugggaggaccauugccaguucucccgccccagcccuaucggcuaccuggggcuccugucccaaagaacccgggauauuuauaucucucgcagacuucugggaacauuuaccuggacccucagcgacuccgaaggcaaggauacacccggcggguacugucugacgcgguggaugcugauugaggccgagcucaaaugcuucggaaauaccgcuguggccaaguguaacgaaaaacacgacgaggaauuuugcgauaugcugcgccuuuucgacuucaauaagcaggcuauccagagacugcgggccgaggcgcagaugagcauucaacucaucaacaaagccgugaaugcucugaucaacgaucagcuuauuaugaagaaucaucugcgcgacaucaugggcauuccuuauugcaacuacucuaaguauugguaccucaaucacacaaccacagggagaaccucccugcccaaauguuggcuggucagcaacggaucuuaccucaaugaaacgcacuuuagcgacgauaucgagcagcaagccgacaacaugauuacagagaugcugcagaaggaauauauggagcggcagggcaaaaccccucuugggcugguugaucucuucguguuuuccaccucuuucuaccugaucagcaucuuucugcaucuugugaagauuccgacacaccgccauaucgucggaaaauccugccccaagccucacagacucaaucacaugggcauuuguagcugcggccuguaugggcagcccggagugccuguuaaauggaagcgguga

SEQ ID NO: 2288 - RNA, 1476 nt, Artificial Sequence
  derived and/or modified CDS sequence (opt5) from Lassa virus__AIT17192__GPC
augggccagaucgugaccuucuuucaagaggucccccacguuauugaagaggugaugaacaucgugcugauugcccucagcauccuggcuguccuuaaggggcuguacaauuucgccacaugcggauuuauuggccucguguccuuccugcuucugugugggagaucuugcacgaccagccucuauaaaggaguuuacgaacugcagacacuggagcucaacauggaaacccugaauaugacaaugccucuuuccuguaccaagaacaauucucaucacuauaucauggugggcaacgagacagggcuggagcucacccugacgaauaccagcaucauuaaccauaaauuuugcaaucuuuccgacgcgcacaagaaaaaccuguacgaucaugcucucaugucuaucauuagcacauuccaccuguccaucccgaauuuuaaccaguucgaagccaugagcugugacuuuaauggaggcaagauuucuguccaguauaaccugucccacagcuacgccguggaugcugccaaucauugcggcaccguugcuaacggggugcuccaaacauucaugcggauggccuggggaggcucuuauaucgcgcuggacuccgggcacggaagcugggauuguauuaugaccucuuaccaguaccuuaucauccagaacacgacaugggaggaccauugccaguuuucccgccccagcccuauuggcuaucuggggcuccugucccaaagaacccgggauaucuacauuucucgcagacuucugggaacauucaccuggacccucagcgacuccgaaggcaaggauacacccggcggguauugucugacgcgguggaugcugaucgaggccgagcucaaaugcuuuggaaauaccgcugucgccaaguguaacgaaaaacacgacgaggaguucugcgauaugcugcgccuuuucgacuuuaauaagcaggcuauucagagacugaaagccgaagcgcagaugagcauccaacucaucaacaaggccgugaaugcucugauuaacgaucagcuuaucaugaagaaucaucugcgggacauuaugggcaucccuuacugcaacuauucuaaauacugguaucucaaucacacaaccacagggcgcaccucccugcccaaguguuggcuggugagcaacggaucuuaccucaaugaaacgcacuucagcgacgauauugagcagcaagccgacaacaugaucacagagaugcugcagaaagaauacauggagagacagggcaagaccccucuugggcuggucgaucucuuuguuuucuccaccucuuuuuaucugaucagcauuuuccugcaucuugugaaaaucccgacacaccggcauauugugggaaaguccugccccaaaccucaccgccucaaucacaugggcaucuguagcugcggccuguacgggcagcccggagucccugugaaguggaagagauga

SEQ ID NO: 2289 - RNA, 1476 nt, Artificial Sequence
  derived and/or modified CDS sequence (opt5) from Lassa virus__AIT17196__GPC
augggccagaucgugaccuucuuucaagaggucccccacguuauugaagaggugaugaacaucgugcugauugcccucagcauccuggcuguccuuaaggggcuguacaaucucgccacaugcggacuggugggccuuguuacguuccugcuccugugugggagauccugcaccacaucucuguauaaaggaguguacgaacuccagacccuggagcuuaacauggaaacacugaauaugaccaugccucucagcuguacaaagaacaauucccaucacuauauuauggucggcaacgagaccgggcuggagcuuacgcugaccaauacaucuaucaucaaccauaaauuuugcaaucucagcgacgcgcacaagaaaaaccuguacgaucaugcucugauguccauuaucucuaccuuccaccucagcauuccgaauuuuaaccaguaugaagccauguccugugacuucaauggaggcaagaucagcgugcaguacaaccugucucacuccuaugccggcgaugcugccaaucauugcgggacaguugcuaacggagugcuucaaaccuuuaugcggauggccuggggcgggagcuacauugcgcuggacucuggacgcggcagaugggauuguaucaugacguccuaccaguaucucauuauccagaacacaaccugggaggaccacugccaguucagccggcccucuccuaucggguaccugggacuucugucccaacgcacaagagauauuuauaucagccggcgccuccugggcaccuuuaccuggacacuguccgacucugaaggcaaggauacgcccgggggauacugucucaccagauggaugcugauugaggccgagcuuaaaugcuucggcaauacagcugucgccaaguguaacgaaaaacaugacgaggaauuuugcgauaugcugcgccucuucgacuuuaauaagcaggcuauccagcggcugaaagccgaggcgcagaugaacauucaacuuaucaauaaggccgugaacgcucugaucaaugaucagcucauuaugaagaaccaccugagagacaucauggggauuccuuauugcaauuacagcaaauauugguaccugaaccacaccacaaccggaaagacgucccucccccgguguuggcuggugagcaauggcucuuaccuuaacgaaacacauuucuccgacgauaucgagcagcaagccgacaauaugauuaccgagaugcugcagaaagaauauauggagcgccaggggaagaccccucucggacuggucgaucuguucguuuuuagcacaucuuucuaccuuaucagcaucuuucuccaccuggugaaaauuccgacccauagacacaucgugggcaagcccugcccuaaaccccaucggcugaaccacaugggcauuuguuccugcggguucuauaagcagccuggaguccccgugaaguggaaacgcuga

SEQ ID NO: 2290 - RNA, 1476 nt, Artificial Sequence
  derived and/or modified CDS sequence (opt5) from Lassa virus__AIT17204__GPC
augggccagaucgugaccuucuuucaagaggucccccacguuauugaagaggugaugaacaucgugcugauugcccucagcauccuggcuguccuuaaggggcuguacaaucucgccacaugcggacuggugggccuuguuacguuccugcuccugugugggagauccugcaccucuagccuguauaaaggaguguacgaacuccagacacuggagcuuaacauggaaacccugaauaugacaaugccucucuccuguaccaagaacucuagccaucacuauauucgggucggcaaugagacagggcuggagcuuacccugacgaacaccuccaucaucaaucauaaauuuugcaaccucucugacgcgcacaagaaaaaucuguacgaucaugcucugaugagcauuaucuccacauuccaccucagcauuccgaacuuuaaucaguaugaagccaugucuugugacuucaacggaggcaagaucuccgugcaguacaaucugagccacucuuaugccggcgaugcugccaaccauugcgggaccguugcuaauggagugcuucaaacauuuaugcgcauggccuggggcggguccuacauugcgcuggacagcggacacgauagaugggacuguaucaugaccucuuaccaguaucucauuauccagaacacgacaugggaggaucauugccaguucucccggcccagcccuaucggcuaccuggggcuucugucccaacgcaccagagacauuuauaucucucggcgccuccugggaacauuuaccuggacccugagcgauuccgaaggcaaggacacacccggcggguacugucucacgagauggaugcugauugaggccgagcuuaaaugcuucggaaacaccgcugucgccaaguguaaugaaaaacacgaugaggaauuuugcgacaugcugcggcucuuugauuuuaacaagcaggcuauccagcgccugaaagccgaggcgcagaugagcauucaacuuaucaauaaggccgugaacgcucugaucaaugaccagcucauuaugaagaaccaccugagagacaucaugggcauuccuuauugcaauuacucuaaauauugguaccugaaccauacaaucaccgggaagacaucccuccccaaauguuggcuggugagcaauggaucuuaccuuaacaagacccacuucagcgaugacauugaacagcaagccgauaauaugaucacggagaugcugcagaaagaguauauggaacggcagggcaagacaccucucgggcuggucgaccuguucguuuucuccaccucuuucuaccuuaucagcauuuuucuccaucugaucaaaauuccgacccaccgccauaucgugggaaagcccugcccuaagccccacagacugaaccacaugggcauuuguuccugcggccucuauaaacagccuggggugcccgucaaguggaaacgguga

SEQ ID NO: 2291 - RNA, 1476 nt, Artificial Sequence
  derived and/or modified CDS sequence (opt5) from Lassa virus__AIT17208__GPC
augggccagaucgugaccuucuuucaagaggucccccacguuauugaagaggugaugaacaucgugcugauugcccucagcauccuggcuguccuuaaggggcuguacaauuucgccacaugcggacucauuggccuggugacguuucuucugcucugugggagauccugcaccacaucucuguauaaaggaguuuacgaacugcagacccucgagcugaacauggaaacacuuaauaugaccaugccucugagcuguacaaagaacaauucccaucacuauaucauggugggcaacgagaccgggcucgagcugacgcuuaccaauacaucuaucauuaaccauaaauucugcaaucugagcgacgcgcacaagaaaaaccucuacgaucaugcucugauguccaucauuucuaccuuucaccugagcaucccgaauuucaaccaguaugaagccauguccugugacuuuaauggaggcaagauuagcguccaguacaaccucucucacuccuaugccggcgaugcugccaaucauugcgggacaguggcuaacggaguucugcaaaccuucaugcggauggccuggggcgggagcuacaucgcgcuugacucuggacgcggccagugggauuguauuaugacguccuaccaguaucugaucauccagaacacaaccugggaggaccacugccaauuuagcagacccucuccuauuggguaccucggacugcuuucccagcggacacgcgauaucuauauuagcagacggcugcucggcaccuucaccuggacacuguccgacucugaaggcaaggauacgcccgggggauacugucugacccgcuggaugcucaucgaggccgagcugaaaugcuuuggcaauacagcuguggccaaguguaacgaaaaacaugacgaggaguucugcgauaugcuuagacuguuugacuucaauaagcaggcuauucagcggcucaaagccgaagcgcaaaugagcauccagcugaucaacaaggccgucaaugcucuuauuaacgaucagcugaucaugaagaaucaccuccgcgacauuauggggaucccuuauugcaacuacuccaaauauugguaccugaaucacaccacaaccggaaagacgagccugcccaaauguuggcucgugucuaacggcuccuaccugaaugaaacacauuucagcgacgauauugagcaacaggccgacaacaugaucaccgagaugcuucagaaggaauauauggagagacaggggaaaaccccucugggacucguggaucuguuugucuucucuaccagcuuuuaccugaucuccauuuuccuucaccucguuaagaucccgacacaucggcacauugugggcaaaucuugccccaagccucaucgccugaaucacaugggcaucuguagcugcgggcuguauaagcaacccggagugccugucaaauggaagagauga

SEQ ID NO: 2292 - RNA, 1476 nt, Artificial Sequence
  derived and/or modified CDS sequence (opt5) from Lassa virus__AIT17210__GPC
augggccagaucgugaccuucuuucaagaggucccccacguuauugaagaggugaugaacaucgugcugauugcccucagcauccuggcuguccuuaaggggcuguacaaucucgccacaugcggacuggugggccuuguuacguuccugcuccugugugggagauccugcaccacaucucuguauaaaggaguguacgaacuccagacccuggagcuuaacauggaaacacugaauaugaccaugccucucagcuguacaaagaacaauucccaucacuauauuauggucggcaacgagaccgggcuggagcuuacgcugaccaauacaucuaucaucaaccauaaauuuugcaaucucagcgacgcgcacaagaaaaaccuguacgaucaugcucugauguccauuaucucuaccuuccaccucagcauuccgaauuuuaaccaguaugaagccauguccugugacuucaauggaggcaagaucagcgugcaguacaaccugucucacuccuaugccggcgaugcugccaaucauugcgggacaguugcuaacggagugcuucaaaccuuuaugcggauggccuggggcgggagcuacauugcgcuggacucuggacgcgauagaugggacuguaucaugacguccuaccaguaucucauuauccagaacacaaccugggaggaucacugccaguucagccggcccucuccuaucggcuaccuggggcuucugucccaacgcacaagagacauuuauaucagccggcgccuccugggaaccuuuaccuggacacuguccgauucugaaggcaaggacacgcccggcggguacugucucaccagauggaugcugauugaggccgagcuuaaaugcuucggaaauacagcugucgccaaguguaacgaaaaacaugaugaggaauuuugcgacaugcugcgccucuucgauuuuaauaagcaggcuauccagcggcugaaagccgaggcgcagaugagcauucaacuuaucaacaaggccgugaaugcucugaucaacgaccagcucauuaugaagaaucaccugagagacaucaugggcauuccuuauugcaacuacuccaaauauugguaccugaaucacaccacaaccgggaagacgagccuccccaaauguuggcuggugucuaacggauccuaccuuaaugaaacacauuucagcgaugacaucgagcagcaagccgauaacaugauuaccgagaugcugcagaaggaauauauggagcggcagggcaaaaccccucucgggcuggucgaccuguucguuuuuagcacaucuuucuaccuuaucuccaucuuucuccgccuggugaagauuccgacccacagacauaucgugggaaaacccugcccuaagccccaccggcugaaucauaugggcauuuguucuugcggccucuauaagcagccugggguccccgugaaauggaagcgcuga

SEQ ID NO: 2293 - RNA, 1476 nt, Artificial Sequence
  derived and/or modified CDS sequence (opt5) from Lassa virus__AIT17212__GPC
augggccagaucgugaccuucuuucaagaggucccccacguuauugaagaggugaugaacaucgugcugauugcccucagcauccuggcuguccuuaaggggcuguacaaucucgccacaugcggacuggugggccuuguuacguuccugcuccugugugggagauccugcaccacaucucuguauaaaggaguguacgaacuccagacccuggagcuuaacauggaaacacugaauaugaccaugccucucagcuguacaaagaacaauucccaucacuauauuauggucggcaacgagaccgggcuggagcuuacgcugaccaauacaucuaucaucaaccauaaauuuugcaaucucagcgacgcgcaccggaagaaccuguacgaucaugcucugauguccauuaucucuaccuuccaccucagcauuccgaauuuuaaccaguaugaagccauguccugugacuucaauggaggcaaaaucagcgugcaguacaaccugucucacuccuaugccggcgaugcugccaaucauugcgggacaguugcuaacggagugcuucaaaccuuuaugcgcauggccuggggcgggagcuacauugcgcuggacucuggaagaggcaagugggauuguaucaugacguccuaccaguaucucauuauccagaacacaaccugggaggaccacugccaguucagccggcccucuccuaucggguaccugggacuucugucccaacgcacaagagauauuuauaucagccggcgccuccugggcaccuuuaccuggacacuguccgacucugaaggcaaggauacgcccgggggauacugucucaccagauggaugcugauugaggccgagcuuaaaugcuucggcaauacagcugucgccaaguguaacgaaaaacaugacgaggaauuuugcgauaugcugcgccucuucgacuuuaauaagcaggcuauccagcggcugaaagccgaggcgcagaugagcauucaacuuaucaacaaggccgugaaugcucugaucaacgaucagcucauuaugaagaaucaccugagagacaucauggggauuccuuauugcaacuacuccaaauauugguaccugaaucacaccacaaccggaaagacgagccucccccgguguuggcuggugucuaacggcuccuaccuuaaugaaacacauuucagcgacgauaucgagcagcaagccgacaacaugauuaccgagaugcugcagaaagaauauauggagcgccaggggaagaccccucucggacuggucgaucuguucguuuuuagcacaucuuucuaccuuaucuccaucuuucuccaccuggugaaaauuccgacccauagacacaucgugggcaagcccugcccuaaaccccaucggcugaaucacaugggcauuuguucuugcgggcucuauaagcagccuggaguccccgugaaguggaaacgcuga

SEQ ID NO: 2294 - RNA, 1476 nt, Artificial Sequence
  derived and/or modified CDS sequence (opt5) from Lassa virus__AIT17216__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauuauggucggcaacgagaccgggcucgagcugacgcuuaccaauacaucuaucaucaaccauaaauucugcaaucugagcgacgcgcacaagaaaaaccucuacgaucaugcucugauguccauuaucucuaccuuucaccugagcauuccgaauuucaaccaguaugaagccauguccugugacuuuaauggaggcaagaucagcgugcaguacaaccucucucacuccuaugccggcgaugcugccaaucauugcgggacaguugcuaacggagugcugcaaaccuucaugcggauggccuggggcgggagcuacauugcgcuugacucuggacacggccgcugggauuguaucaugacguccuaccaguaucugauuauccagaacacaaccugggaggaccauugccaguuuagcagacccucuccuaucggguaccucggacugcuuucccaacggacacgcgauauuuauaucagcagacggcugcucggcaccuucaccuggacacuguccgacucugaaggcaaggauacgcccgggggauacugucugacccgcuggaugcucauugaggccgagcugaaaugcuuuggcaauacagcugucgccaaguguaacgaaaaacacgacgaggaguucugcgauaugcuuagacuguuugacuucaauaagcaggcuauccagcggcucaaagccgaagcgcagaugagcauucaacugaucaacaaggccgugaaugcucuuaucaacgaucagcugauuaugaagaaucaccuccgcgacaucauggggauuccuuauugcaacuacuccaaauauugguaccugaaucauaccacaaccggaaagacgagccugcccaaauguuggcucgugucuaacggcuccuaccugaaugaaacacacuucagcgacgauaucgagcagcaagccgacaacaugauuaccgagaugcuucagaaggaauauauggagagacaggggaaaaccccucugggacucgucgaucuguuuguuuucucuaccagcuuuuaccugaucuccaucuuccuucaucucgugaagauuccgacacaccggcauaucgugggcaaacccugcccuaagccccaccgccugaauuauaugggcauuuguucuugcgggcuguacaagcagccuggaguccccgugagauggaaacgguga

SEQ ID NO: 2295 - RNA, 1476 nt, Artificial Sequence
  derived and/or modified CDS sequence (opt5) from Lassa virus__AIT17224__GPC
augggccagaucgugaccuucuuucaagaggucccccacguuauugaagaggugaugaacaucgugcugauugcccucagcauccuggcuguccuuaaggggcuguacaauguggccacaugcggacucauuggccugguuacguuccuucugcucugugggagauccugcaccacaacccuguauaaaggaguguacgaacugcaggcgcucgagcugaacauggaaacacuuaauaugaccaugccucugucuuguacaaagaacaauagccaucacuauauccgggucggcaacgacaccgggcucgagcugacgcuuaccaauacauccaucauucagcauaaauuuugcaaccugucugaugcucacaagaaaaaucucuacgaccauacccugaugagcaucauuuccacauuccaccugucuaucccgaacuuuaaucaguaugaggccaugagcugugauuucaacggaggcaagauuuccgugcaauacaaucucagccacucuuaugccggcgacgcugccucccauugcgggaccguugcuaacggagugcugcagacguuuaugcgcauggccuggggcgggagcuacaucgcgcuugauucuggaagaggcaauugggacuguauuaugacauccuaccaguaucugaucauccagaacaccacaugggaagaucacugccaauucagccggcccucuccuauuggguaccucggacugcuuucccagcgcaccagagacaucuauauuagccggcgccugcucggcaccuuuacauggacgcuguccgauucugagggcagagacacccccgggggauacugucugacacgguggaugcucaucgaagccgagcugaagugcuucggcaacaccgcugucgccaaauguaaugagaagcaugaugaagaguuuugcgacaugcuucgccuguucgauuuuaacaaacaggcuauucagagacucaagacagaagcccaaaugagcauccagcugaucaauaaagcggugaacgcccuuauuaaugaccagcugaucaugaagaaccaccuccgggacauuauggggaucccuuauugcaauuacuccaaguauugguaccugaacaauaccauuacgggaaaaagcucucugcccaaguguuggcucguguccaacggcagcuaccugaaugagacacacuucucugaugacaucgaacaagaggcugauaacaugaucaccgagaugcuucagaaagaauauauggagcgccaggggaagaccccucugggacucgucgaccuguucguuuuuagcacauccuucuaccugauuucuaucuuucuucaucucgugaaaauuccgacccacagacauaucgugggcaagcccugcccuaaaccccaccggcugaaucauaugggcgucuguagcugcgggcuguauaagcagccuggagugcccguucgcuggaagagauga

SEQ ID NO: 2296 - RNA, 1476 nt, Artificial Sequence
  derived and/or modified CDS sequence (opt5) from Lassa virus__AIT17228__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugcuuacguuucugcuccugugugggagauccugcaccacaucucuguauaaaggaguuuacgaacuccagacccuggagcuuaacauggaaacacugaauaugaccaugccucucagcuguacaaagaacaauucccaucacuauauuauggugggcaacgagaccgggcuggagcuuacgcugaccaauacaucuaucaucgaccauaaauucugcaaccucagcgaugcgcacaagaaaaaucuguacgaccaugcucugauguccauuaucucuaccuuucaccucagcauuccgaacuucaaucaguaugaagccauguccugugauuuuaacggaggcaagaucagcguccaguacaaucugucucacuccuaugccggcgacgcugccaaccauugcgggacaguggcuaauggaguucuucaaaccuucaugcggauggccuggggcgggagcuacauugcgcuggauucuggacgcggcgggugggacuguaucaugacguccuaccaguaucucauuauccagaacacaaccugggaggaucacugccaguuuagcagacccucuccuaucggauaccugggccuucugucccaacggacacgcgacauuuauaucagcagacggcuccugggcaccuucaccuggacacuguccgauucugaagggaaggacacgcccggaggcuacugucucacccgcuggaugcugauugaggccgagcuuaaaugcuuugggaacacagcuguggccaaguguaaugaaaaacaugaugaggaguucugcgacaugcugagacucuuugauuucaacaagcaggcuauccagcggcugaaagccgaagcgcagaugagcauucaacuuaucaauaaggccgucaacgcucugaucaaugaccagcucauuaugaagaaccaucugcgcgacaucaugggcauuccuuauugcaauuacuccaaauauugguaccugaaccacaccacaaccggaaagacgagccuccccaaauguuggcuggugucuaauggguccuaccuuaacgaaacacacuucagcgaugacaucgagcagcaagccgauaauaugauuaccgagaugcugcagaaggaauauauggagagacagggaaaaaccccucucggccugguggaccuguuugucuucucuaccagcuuuuaccuuaucuccaucuuccuccaccugguuaagauuccgacacaucggcacaucgugggcaaaucuugccccaagccucaucgccugaaccacauggggauuuguagcugcggacucuauaagcagcccggcgugccugucaaauggaagagauga

SEQ ID NO: 2297 - RNA, 1476 nt, Artificial Sequence
  derived and/or modified CDS sequence (opt5) from Lassa virus__AIT17232__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauucgggucggcaacgagaccgggcucgagcugacgcuuaccaauacaucuaucaucaaccauaaauucugcaaucugagcgacgcgcacaagaaaaaccucuacgaucaugcucugauguccauuaucucuaccuuucaccugagcauuccgaauuucaaccaguaugaagccauguccugugacuuuaaugagggaaagaucagcgugcaguacaaccucucucacuccuaugccggcgaugcugccaaucauugcggcacaguugcuaacggggugcugcaaaccuucaugcgcauggccuggggaggcagcuacauugcgcuugacucugggagaggaaagugggauuguaucaugacguccuaccaguaucugauuauccagaacacaaccugggaagaccacugccaguuuagccggcccucuccuaucggcuaccucgggcugcuuucccaacgcacaagagauauuuauaucagccggcgccugcucggaaccuucaccuggacacuguccgacucugagggcaaagauacgcccggcggguacugucugaccagauggaugcucauugaggccgaacugaagugcuuuggaaauacagcugucgccaaauguaacgagaagcaugacgaagaguucugcgauaugcuucggcuguuugacuucaauaaacaggcuaucgaacgccucaaggccgaggcgcagaugagcauucagcugaucaacaaggccgugaaugcucuuaucaacgaucaacugauuaugaaaaaucaccucagagacaucaugggcauuccuuauugcaacuacuccaaguauugguaccugaaucacaccacaaccgggaaaacgagccugcccaaguguuggcucgugucuaacggauccuaccugaaugagacacauuucagcgacgauaucgaacagcaggccgacaacaugauuaccgagaugcuucaaaaagaauauauggagcggcagggcaagaccccucuggggcucgucgaucuguuuguuuucucuaccagcuuuuaccugaucuccaucuuccuucaccucgugaaaauuccgacacaucgccacaucgugggaaagucuugccccaagccucauagacugaaucacaugggcauuuguagcugcggccuguauaaacagcccggggucccugugaaguggaaacgguga

SEQ ID NO: 2298 - RNA, 1476 nt, Artificial Sequence
  derived and/or modified CDS sequence (opt5) from Lassa virus__AIT17236__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauuauggucggcaacgagaccgggcucgagcugacgcuuaccaauacaucuaucaucaaccauaaauucugcaaucugagcgacgcgcacaagaaaaaccucuacgaucaugcucugauguccauuaucucuaccuuucaccugagcauuccgaauuucaaccaguaugaagccauguccugugacuuuaauggaggccggaucagcgugcaguacaaccucucucacuccuaugccggcgaggcugccaaucauugcgggacaguugcuaacggagugcugcaaaccuucaugcgcauggccuggggcgggagcuacauugcgcuugauucuggaagaggcaagugggacuguaucaugacguccuaccaguaucugauuauccagaacacaaccugggaagaucacugccaguuuagccggcccucuccuaucggguaccucggacugcuuucccaacgcacaagagacauuuauaucagccggcgccugcucggcaccuucaccuggacacuguccgauucugagggcaaggacacgcccgggggauacugucugaccagauggaugcucauugaggccgaacugaaaugcuuuggcaauacagcugucgccaaguguaacgagaaacaugaugaagaguucugcgacaugcuucggcuguuugauuucaauaagcaggcuauccagcgccucaaagccgaagcgcagaugagcauucaacugaucaacaaggccgugaaugcucuuaucaacgaccagcugauuaugaagaaucaccucagagauaucauggggauuccuuauugcaacuacucccgguauugguaccugaaucacaccacaaccggaaaaacgagccugcccaaguguuggcucgugucuaacggcuccuaccugaaugagacacauuucagcgacgacaucgagcagcaagccgauaacaugauuaccgaaaugcuucagaaagaguauauggaacgccaggggaagaccccucugggacucgucgaccuguuuguuuucucuaccagcuuuuaccugaucuccaucuuccuucaccucgugaaaauuccgacacauagacacaucgugggcaagucuugccccaaaccucaucggcugaaucacaugggcauuuguagcugcgggcuguauaagcagcccggagucccugugaaguggaaacgcuga

SEQ ID NO: 2299 - RNA, 1476 nt, Artificial Sequence
  derived and/or modified CDS sequence (opt5) from Lassa virus__AIT17240__GPC
augggccagaucgugaccuucuuucaagaggucccccacguuauugaagaggugaugaacaucgugcugauugcccucagcauccuggcuguccuuaaggggcuguacaaucucgccacaugcggacuggugggccuuguuacguuccugcuccugugugggagauccugcaccacaucucuguauaaaggauuuuacgaacuccagacccuggagcuuaacauggaaacacugaauaugaccaugccucucagcuguacaaagaacaauucccaucacuauauucgggugggcaacgagaccgggcuggagcuuacgcugaccaauacaucuaucaucgaccauaaauucugcaaccucagcgaugcgcacaagaaaaaucuguacgaccaugcucugauguccauuaucucuaccuuucaccucagcauuccgaacuucaaucaguaugaagccauguccugugauuuuaacggaggcaagaucagcguccaguacaaucugucucacuccuaugccggcgacgcugccaaccauugcgggacaguggcuaauggaguucuucaaaccuucaugcgcauggccuggggcgggagcuacauugcgcuggauucuggaagaggccggugggacuguaucaugacguccuaccaguaucucauuauccagaacacaaccugggaggaucacugccaguuuagccgccccucuccuaucggguaccugggacuucugucccaaaagacaagagacauuuauaucagccggcgccuccugggcaccuucaccuggacacuguccgauucugaaggcaaagacacgcccgggggauacugucucaccagauggaugcugauugaggccgagcuuaagugcuuuggcaacacagcuguggccaaauguaaugaaaagcaugaugaggaguucugcgacaugcugcggcucuuugauuucaacaaacaggcuauccagcgccugaaggccgaagcgcagaugagcauucaacuuaucaauaaggccgucaacgcucugaucaaugaccagcucauuaugaaaaaccaccugagagacaucauggggauuccuuauugcaauuacuccaaguauugguaccugaaccacaccacaaccggaaaaacgagccuccccaaguguuggcuggugucuaauggcuccuaccuuaacgaaacacauuucagcgaugacaucgagcagcaagccgauaauaugauuaccgagaugcugcagaaagaauauauggagcggcaggggaagaccccucucggacugguggaccuguuugucuucucuaccagcuuuuaccuuaucuccaucuuccuccaccugguuaaaauuccgacacaucgccacaucgugggcaagucuugccccaagccucauagacugaaccacaugggcauuuguagcugcgggcucuauaaacagcccggagugccugucaaguggaaacgguga

SEQ ID NO: 2300 - RNA, 1476 nt, Artificial Sequence
  derived and/or modified CDS sequence (opt5) from Lassa virus__AIT17244__GPC
augggccagaucgugaccuucuuucaagaggucccccacguuauugaagaggugaugaacaucgugcugauugcccucagcauccuggcuguccuuaaggggcuguacaaucucgccacaugcggacuggugggccuuguuacguuccugcuccugugugggagauccugcaccacaaaccuguauaaaggaguguacgaacuccagacccuggagcuuaauauggaaacacugaacaugaccaugccucucucuuguacaaagaauagcucccaucacuauauucgggucggcaacgagaccgggcuggagcuuacgcugaccaauacaucuaucaucgaccauaaauuuugcaaccucagcgaugcgcacaagaaaaaucuguacgaccaugcucugauguccauuaucucuaccuuccaccucagcauuccgaacuuuaaucaguaugaagccauguccugugauuucaacggaggcaagaucagcgugcaguacaaucugucucacuccuauguuggcgacgccgcugaucauugcgggacaguggccaacggaguccuucaaaccuuuaugcgcauggcuuggggcgggagcuacauugcccuggacucuggaagaggcaagugggauuguaucauuacguccuaccaguaucucaucauccagaauacaaccugggaggaccacugccaguucagccggcccucuccuauuggguaccugggacuucugucccaacgcacaagagauaucuauauuagccggcgccuccugggcaccuuuaccuggacacuguccgacucugaaggcaaagauacgcccgggggauacugucucaccagauggaugcugaucgaggcggagcuuaagugcuucggcaacacagccguggcuaaauguaacgaaaagcaugacgaggaauuuugcgauaugcugcgccucuucgacuuuaauaaacaggccauucagcggcugaaggcugaggcccagaugagcauccaacuuaucaacaaggcggugaaugcccugauuaacgaccagcucaucaugaaaaaucaccugagagauauuauggggaucccuuauugcaacuacuccaaguauugguaccugaaucacaccauuacaggaaaaaccagccucccccgguguuggcuggucucuaacggcuccuaccuuaaugaaacgcgcuucagcgacgauaucgagcagcaagcugacaacaugaucacagagaugcugcagaaggaauauauggagagacaggggaaaaccccucucggacugguugaucuguucguguuuucuaccagcuucuaccuuauuuccaucuuucuccaucuggugaagauuccgacacaccggcauaucgucggcaaacccugcccuaagccccaccgccugaaucauaugggcauuuguucuugcgggcucuauaagcagccuggagugcccguuaaauggaagagauga

SEQ ID NO: 2301 - RNA, 1476 nt, Artificial Sequence
  derived and/or modified CDS sequence (opt5) from Lassa virus__AIT17246__GPC
augggccagaucgugaccuucuuucaagaggucccccacguuauugaagaggugaugaacaucgugcugauugcccucagccugcuugcuguccugaaggggcucuacaauguggccacaugcggacugaucggccuuauuacguuccugcuccugugugggagauccugcaccacaaaccuguauaaaggaguuuacgaacuccagacccuggagcuuaauauggaaacacugaacaugaccaugccucucucuuguacaaagaauagcucccaucacuauaucauggugggcaacgagaccgggcuggagcuuacgcugaccaauacaucuaucauuaaccauaaauuuugcaaucucagcgacgcgcacaagaaaaaccuguacgaucauacccugauguccaucauuucuacauuccaccucagcaucccgaauuuuaaccaguaugaagcuauguccugugacuucaauggaggcaagauuagcguccaguacaaccugucucacuccuaugccguggaugccgcuaaucauugcggcaccguugccaacgggauccuucaaacguuuaugcggauggcuuggggaggcagcuacauugcccuggacucugggcgcggaaacugggauuguaucaugacauccuaccaguaucucaucauucagaauaccacaugggaggaccacugccaguucagcagacccucuccuaucggcuaccuggggcuucugucccaacggacccgcgauauuuauaucagcagacggcuccugggaaccuuuacauggacgcuguccgacucugaaggcaacgauacccccggcggguacugucucacacgcuggaugcugauugaggcggagcuuaagugcuucggaaauaccgccguggcuaaauguaacgaaaagcaugacgaggaauuuugcgauaugcugagacucuucgacuuuaauaaacaggccauccagcggcugaaggcugaggcccagaugagcauccaacuuauuaacaaagcggucaaugcccugaucaacgaucagcucauuaugaagaaucaucugcgcgacaucaugggcauuccuuauugcaacuacuccaaguauugguaccugaaucacacaaccacggggaaaacaagccuccccaaguguuggcuggugucuaacggauccuaccuuaaugaaacccacuucagcgacgauaucgagcagcaagcugacaacaugaucaccgagaugcugcagaaagaauauauggagagacagggcaagacaccucucgggcugguggaucuguucgucuuuucuaccagcuucuaccuuauuuccaucuuucuccaccugguuaaaauuccgacacaucggcacaucgugggaaagcccugcccuaaaccccaucgccugaaucacaugggcauuuguucuugcggccucuauaagcagccuggggugcccgucagauggaagcgguga

SEQ ID NO: 2302 - RNA, 1476 nt, Artificial Sequence
  derived and/or modified CDS sequence (opt5) from Lassa virus__AIT17250__GPC
augggccagaucgugaccuucuuucaagaggucccccacguuauugaagaggugaugaacaucgugcugauugcccucagccugcuugcuguccugaaggggcucuacaauguggccacaugcggacugaucggccuuguuacguuccugcuccugugugggagauccugcaccacaaaccuguauaaaggaguguacgaacuccagacccuggagcuuaauauggaaacacugaacaugaccaugccucucucuuguacaaagaauaacagccaucacuauauuauggucggcaaugagaccgggcuggagcuuacgcugaccaacacauccaucaucaaucauaaauuuugcaaccucucugacgcgcacaagaaaaaucuguacgaucauacccugaugagcauuaucuccacauuccaccucucuauuccgaacuuuaaucaguaugaagcuaugagcugugacuucaacggaggcaagaucuccgugcaguacaaucugagccacucuuaugccguugaugccgcuaaccauugcggcaccguggccaacgggguccuucaaacguuuaugcggauggcuuggggaggcuccuacauugcccuggacagcgggcgcggaaauugggauuguaucaugacaucuuaccaguaucucauuauccagaacaccacaugggaggaccacugccaguucuccagacccagcccuaucggcuaccuggggcuucugucucaacggacccgcgauauuuauaucuccagacggcuccugggaaccuuuacauggacgcugagcgacuccgaaggcaaugauacccccggcggguacugucucacacgcuggaugcugauugaggcggagcuuaagugcuucggaaacaccgccguggcuaaauguaaugaaaagcaugacgaggaauuuugcgauaugcugagacucuucgacuuuaacaaacaggccauccagcggcugaaggcugaggcccagaugucuauucaacuuaucaauaaagcggugaacgcccugaucaaugaucagcucauuaugaagaaccaucugcgcgacaucaugggcauuccuuauugcaauuacagcaaguauugguaccugaaccacacaaccacggggaaaacaucccuccccaaguguuggcuggucagcaauggaucuuaccuuaacgaaacccacuucuccgacgauaucgagcagcaagcugacaauaugauuaccgagaugcugcagaaagaauauauggagagacagggcaagacaccucucgggcugguugaucuguucguguuuagcaccucuuucuaccuuaucagcaucuuucuccaccuggugaaaauuccgacacaucggcacaucgucggaaagcccugcccuaaaccccaucgccugaaccacaugggcauuuguuccugcggccucuauaagcagccuggggugcccguuagauggaagcgguga

SEQ ID NO: 2303 - RNA, 1476 nt, Artificial Sequence
  derived and/or modified CDS sequence (opt5) from Lassa virus__AIT17254__GPC
augggccagaucgugaccuucuuucaagaggucccccacguuauugaagaggugaugaacaucgugcugauugcccucagcauccuggcuguccuuaaggggcuguacaauuucgccacaugcggaauugugggccucguuacguuucugcuucugugugggagauccugcaccacaucucucuauaaaggaguguacgaacugcagacccuggagcucaacauggaaacacugaauaugaccaugccucuuagcuguacaaagaacaauucccaucacuauaucauggucggcaacgagaccgggcuggagcucacgcugaccaauacaucuaucauuaaccauaaauucugcaaucuuagcgacgcgcacaagaaaaaccuguacgaucaugcucucauguccaucauuucuaccuuucaccugagcaucccgaauuucaaccaguaugaagccauguccugugacuuuaauggaggcaagauuagcgugcaguacaaccugucucacuccuaugccggcgaugcugccaaucauugcgggacaguugcuaacggagugcuccaaaccuucaugcggauggccuggggcgggagcuacaucgcgcuggacucuggacgcgauagaugggacuguauuaugacguccuaccaguaucuuaucauccagaacacaaccugggaggaucacugccaguuuagccggcccucuccuauuggcuaccuggggcuccugucccaacgcacaagagacaucuauauuagccggcgccuucugggaaccuucaccuggacacucuccgauucugaaggcaagaauacgcccggcggguacugucugaccagauggaugcugaucgaggccgagcucaaaugcuuuggaaacacagcugucgccaaguguaaugaaaaacaugacgaggaguucugcgauaugcugcggcuuuuugacuucaacaagcaggcuauucagcgccugaaagccgaagcgcagaugagcaucucccucaucaauaaggccgugaacgcucugauuaaugaucaacuuaucaugaagaaccaccugagagacauuaugggcaucccuuauugcaauuacagcaaauauugguaccucaaccacaccacaaccgggaagacgucucugccccgguguuggcugguguccaauggaagcuaccucaacgaaacacauuucucugacgauauugagcagcaggccgacaauaugaucaccgagaugcugcaaaaagaauauauggaucgccagggcaagaccccucuugggcuggucgaccucuuuguuuucagcacauccuuuuaccugaucucuauuuuccugcaccuugugaaaaucccgacccauagacacauugugggaaagacaugccccaaaccucaucggcucaaccacaugggcaucuguagcugcggccuguauaagcagcccggggucccugugaaguggaaacgcuga

SEQ ID NO: 2304 - RNA, 1476 nt, Artificial Sequence
  derived and/or modified CDS sequence (opt5) from Lassa virus__AIT17258__GPC
augggccagaucgugaccuucuuucaagaggucccccacguuauugaagaggugaugaacaucgugcugauugcccucagcauccuggcuguccuuaaggggcuguacaauauugccacaugcggacucgugggccugguuacguuccuucugcucugugggagauccugcaccacaucucuguauaaaggaguguacgaacugcagacccucgagcugaacauggaaacacuuaauaugaccaugccucugagcuguacaaagaacaauucccaucacuauaucauggucggcaacgagaccgggcucgagcugacgcuuaccaauacaucuaucauuaaccauaaauuuugcaaucugagcgacgcgcacaagaaaaaccucuacgaucaugcucugauguccaucgugucuaccuuccaccugagcauuccgaauuuuaaccaguaugaagccauguccugugacuucaauggaggcaagaucagcguucaguacaaccucucucacuccuaugccguggaugcugccaaucauugcggcacagucgcuaacggggugcugcaaaccuuuaugcggauggccuggggaggcagcuacauugcgcuugacucugggcgcggaggcugggauuguaucaugacguccuaccaguaucugauuauccagaacgugacaugggaggaccacugccaguucagcagacccucuccuaucggguaccucggacugcuuucccaacggacccgcgaugucuauauuagcagacggcugcucggcacauuuaccuggacccuguccgacucugaaggcaaugauacacccgggggauacugucugacgcgcuggaugcucaucgaggccgagcugaagugcuucggcaacaccgcuguugccaaauguaaugaaaagcaugacgaggaauuuugcgauaugcuuagacuguucgacuuuaacaaacaggcuauucagcggcucaaggccgaggcgcagaugagcauccaacugauuaauaaagccgugaacgcucuuaucaaugaucagcugaucaugaagaaccaccuccgcgacauuauggggaucccuuauugcaauuacuccaaguauugguaccugaaccacacaaccacaggaaaaaccagccugcccaaguguuggcucgugucuaauggcuccuaccugaacgaaacgcauuucagcgacgauauugagcagcaagccgacaauaugaucacagagaugcuucagaaagaauauauggagagacaggggaagaccccucugggacucgucgaucuguucguguuuucuaccagcuucuaccugauuuccaucuuucuucaccucguuaaaaucccgacacaucggcacauugugggcaagcccugcccuaaaccccaucgccugaaccacaugggcaucuguucuugcgggcuguauaagcagccuggaguccccgugaaguggaaaagauga

SEQ ID NO: 2305 - RNA, 1476 nt, Artificial Sequence
  derived and/or modified CDS sequence (opt5) from Lassa virus__AIT17262__GPC
augggccagaucgugaccuucuuucaagaggucccccacguuauugaagaggugaugaacaucgugcugauugcccucagcauccuggcuguccuuaaggggcuguacaaucucgccacaugcggacuggugggccuuguuacguuccugcuccugugugggagauccugcaccacaucucuguauaaaggaguguacgaacuccagacccuggagcuuaacauggaaacacugaauaugaccaugccucucagcuguacaaagaacaauucccaucacuauauuauggucggcaacgagaccgggcuggagcuuacgcugaccaauacaucuaucaucaaccauaaauuuugcaaucucagcgacgcgcacaagaaaaaccuguacgaucaugcucugauguccauuaucucuaccuuccaccucagcauuccgaauuuuaaccaguaugaagccauguccugugacuucaauggaggcaagaucagcgugcaguacaaccugucucacuccuaugccggcgaugcugccacacauugcgggaccguugcuaauggagugcuucaaacguuuaugcggauggccuggggcgggagcuacauugcgcuggacucuggacgcggcaagugggauuguaucaugacauccuaccaguaucucauuauccagaacaccacaugggaggaccacugccaguucagcagacccucuccuaucggguaccugggacuucugucccaacggacccgcgauauuuauaucagcagacggcuccugggcaccuuuacauggacgcuguccgacucugaaggcaaagauacccccgggggauacugucucacacgcuggaugcugauugaggccgagcuuaagugcuucggcaacaccgcugucgccaaauguaaugaaaagcaugacgaggaauuuugcgauaugcugagacucuucgacuuuaacaaacaggcuauccagcggcugaagacagaggcccagaugagcauucaacuuaucaauaaggcggugaacgcccugaucaaugaucagcucauuaugaaaaaccaucugcgcgacaucauggggauuccuuauugcaauuacuccaaguauugguaccugaaccacaccacgacaggaaaaaccagccuccccagauguuggcuggugucuaauggcuccuaccuuaacgaaacccacuucagcgacgauaucgagcagcaagcugacaauaugauuacagagaugcugcagaaggaauauauggagcggcaggggaaaaccccucucggacuggucgaucuguucguuuuuagcacaucuuucuaccuuaucuccaucuuucuccaccuggugaagauuccgacgcaucgccacaucgugggcaaacccugcccuaagccccauagacugaaccacaugggcauuuguucuugcgggcucuauaagcagccuggaguccccgugaaauggaagcgguga

SEQ ID NO: 2306 - RNA, 1476 nt, Artificial Sequence
  derived and/or modified CDS sequence (opt5) from Lassa virus__AIT17266__GPC
augggccagaucgugaccuucuuucaagaggucccccacguuauugaagaggugaugaacaucgugcugauugcccucagcauccuggcuguccuuaaggggcuguacaaucucgccacaugcggacuggugggccuuguuacguuccugcuccugugugggagauccugcaccacaucucuguauaaaggaguguacgaacuccagacccuggagcuuaacauggaaacacugaauaugaccaugccucucagcuguacaaagaacaauucccaucacuauauuauggucggcaacgagaccgggcuggagcuuacgcugaccaauacaucucucaucaaccauaaauuuugcaaucugagcgacgcgcacaagaaaaaccuguacgaucaugcucucauguccaucauuucuaccuuccaccugagcaucccgaauuuuaaccaguaugaagccauguccugugacuucaauggaggcaagauuagcgugcaguacaaccuuucucacuccuaugccguugaugcugccaaucauugcggcacaguggcuaacgggguccugcaaaccuuuaugcggauggccuggggaggcagcuacaucgcgcucgacucugggcgcggaggcugggauuguauuaugacguccuaccaguaucugaucauucagaacacaaccugggaggaccacugccaguucagcagacccucuccuaucggguaccuuggacugcucucccaacggacacgcgauaucuauauuagcagacggcugcugggcaccuuuaccuggacacucuccgacucugaaggcaaggauacgcccgggggauacugucugacccgcuggaugcuuaucgaggccgagcugaaaugcuucggcaauacagcuguggccaaguguaacgaaaaacaugacgaggaauuuugcgauaugcucagacuguucgacuuuaauaagcaggcuauucagcggcuuaaagccgaggcgcagaugagcauccaacugauuaacaaggccgugaaugcucucaucaacgaucagcugaucaugaagaaucaucugcgcgacauuauggggaucccuuauugcaacuacuccaaauauugguaccucaaucacaccacaaccggaagaacgagccugccccgguguuggcuugucucuaacggcuccuaccugaaugaaacacacuucagcgacgauauugagcagcaagccgacaacaugaucaccgagaugcuccagaaggaauauauggagcgccaggggaaaaccccucugggacugguugaucuuuucguguuuucuaccagcuucuaccucauuuccaucuuucugcaccuggugaagaucccgacacauagacacauugucggcaaaucuugccccaagccucaucggcucaaucacaugggcaucuguagcugcgggcuguauaaacagcccggagugccuguuaaguggaagcgcuga

SEQ ID NO: 2307 - RNA, 1476 nt, Artificial Sequence
  derived and/or modified CDS sequence (opt5) from Lassa virus__AIT17270__GPC
augggccagaucgugaccuucuuucaagaggucccccacguuauugaagaggugaugaacaucgugcugauugcccucagcguccuggcugugcuuaaggggcuguacaauuucgccacaugcggacucguuggccuggugacguuucuucugcucugugggagauccugcucuaccagcgucuauaaaggaguguacgaacugcagacacuggagcucaacauggaaacccugaauaugacaaugccucuuuccuguaccaagaacaauucucaucacuauaucaugguuggcaacgagacagggcuggagcucacccugacgaauaccagcauuaucaaccauaaauucugcaaucuuuccgacgcgcacaagaaaaaccuguacgaucaugcucucaugucuaucauuagcacauuucaccuguccaucccgaauuucaaccaguaugaagccaugagcugugacuuuaauggaggcaagauuucugugcaguacaaccugucccacagcuaugccgucgaugcugccaaucauugcggcaccguggcuaacggggugcuccaaacauucaugcggauggccuggggaggcucuuacaucgcgcuggacuccgggcacggaggcugggauuguauuaugaccaacuaccaguaucuuaucauucagaauacgacaugggaggaccauugccaguuuagccgccccucuccuaucggguaccugggacuccugucccaaagaacccgggauaucuauauuagccgcagacuucugggcacauucaccuggacccucuccgacucugaaggcaaggauacacccgggggauacugucugacgcgguggaugcugaucgaggccgagcucaaaugcuuuggcaacaccgcugucgccaaguguaaugaaaaacacgacgaggaguucugcgauaugcugcgccuuuuugacuucaacaagcaggcuauucagagacugaaagccgaagcgcagaugagcauccaacucauuaauaaggccguuaacgcucugaucaaugaucagcuuaucaugaagaaccaucugcgggacauuauggggaucccuuauugcaauuacuccaaauauugguaccucaaccacacaaccacaggacgcaccagccugcccaaguguuggcuggugucuaauggcuccuaccucaacgaaacgcacuucagcgacgauauugagcagcaagccgacaauaugaucacagagaugcugcagagagaauauauggagcggcaggggaaaaccccucuuggacugguggaucucuuugucuucucuaccagcuuuuaccugauuuccaucuuccugcaucuugugaagaucccgacacaccgccauauuguuggcaaaucuugccccaagccucacagacucaaccacaugggcaucuguagcugcgggcuguauaaacagcccggagugccugucaaguggaagcgguga

SEQ ID NO: 2308 - RNA, 1476 nt, Artificial Sequence
  derived and/or modified CDS sequence (opt5) from Lassa virus__AIT17274__GPC
augggccagaucgugaccuucuuucaagaggucccccacguuauugaagaggugaugaacaucgugcugauugcccucagcauccuggcuguccuuaaggggcuguacaauguggccacaugcggacucacgggccugguugcguuccuucugcucugugggagauccugcaccacaacccuguauaaaggaguguacgaacugcaggcucucgagcugaacauggaaacacuuaauaugaccaugccucugucuuguacaaagaacaauagccaucacuauauucgggucggcaacgagaccgggcucgagcugacgcuuaccaauacauccaucaucgaacaucgcuuuugcaaccugucugacgcccacaaaaagaaucucuacgaucaugcccugaugagcauuaucuccaccuuccaccugucuauuccgaacuuuaaucaguaugaggcuaugagcugugacuucaacggaggcaaaaucuccgugcaguacaaucucagccacucuuaugccguugaugcugccaaccauugcggcacaguggcgaaugggguccugcaaaccuuuaugagaauggccuggggaggcuccuacauugcucuugacagcgggcggaacggaugggauuguaucaugacgucuuaccaguaucugauuauccagaacacaaccugggaagaccacugccaguucucccgccccagcccuaucggcuaccucgggcugcuuucucaaagaacacgggauauuuauaucucccgcagacugcucggaaccuuuaccuggacacugagcgacuccgagggcaaggauacgcccggcggguacugucugacccgguggaugcucauugaggccgaacugaagugcuucggaaauacagcuguggccaaauguaacgagaagcaugacgaagaguuuugcgauaugcuucgccuguucgacuuuaauaaacaggcgauccagagacucaaggccgaagcucagaugucuauucaacugaucaacaaagccgugaaugcucuuaucaacgaucagcugauuaugaagaaucaccuccgggacaucaugggcauuccuuauugcaacuacagcaaguauugguaccugaauaacaccgccacagggaaaaccucccugccccgcuguuggcucgucagcaauggaucuuaccugaacgagacgcacuucuccgacgauaucgagcagcaagccgacaauaugauuacagaaaugcuucagaaggaguauauggaaagacagggcaaaaccccucuggggcucguugaucuguucguguuuagcaccucuuucuaccugaucagcaucuuucuucaucucgugaagauuccgacacaccggcauaucgucggaaaacccugcccuaagccccaccgccugaaccauaugggcauuuguuccugcggccuguauaaacagccuggggcucccgugagauggaagcgguga

SEQ ID NO: 2309 - RNA, 1476 nt, Artificial Sequence
  derived and/or modified CDS sequence (opt5) from Lassa virus__AIT17276__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauuauggucggcaacgagaccgggcucgagcugacgcuuaccaauacaucuaucaucaaccauaaauucugcaaucugagcgacgcgcacaagaaaaaccucuacgaucaugcucugauguccauuaucucuaccuuucaccugagcauuccgaauuucaaccaguaugaagccauguccugugacuuuaauggaggcaagaucagcgugcaguacaaccucucucacuccuaugccggcgaugcugccaaucauugcgggacaguugcuaacggagugcugcaaaccuucaugcggauggccuggggcgggagcuacauugcgcuugacucuggacacggcaagugggauuguaucaugacguccuaccaguaucugauuauccagaacacaaccugggaggaccauugccaguuuagccgccccucuccuaucggguaccucggacugcuuucccaaagaacacgggauauuuauaucagccgcagacugcucggcaccuucaccuggacacuguccgacucugaaggcaaagauacgcccgggggauacugucugacccgguggaugcucauugaggccgagcugaagugcuuuggcaauacagcugucgccaaauguaacgaaaagcacgacgaggaguucugcgauaugcuucgccuguuugacuucaauaaacaggcuauccagagacucaaggccgaagcgcagaugagcauucaacugaucaacaaggccgugaaugcucuuaucaacgaucagcugauuaugaaaaaucaccuccgggacaucauggggauuccuuauugcaacuacuccaaguauugguaccugaaucauaccacaaccggaaaaacgagccugcccaaguguuggcucgugucuaacggcuccuaccugaaugaaacacacuucagcgacgauaucgagcagcaagccgacaacaugauuaccgagaugcuucagaaagaauauauggagcgccaggggaagaccccucugggacucgucgaucuguuuguuuucucuaccagcuuuuaccugaucuccaucuuccuucaucucgugaaaauuccgacacacagacauaucgugggcaagucuugccccaagccucaccggcugaaucacaugggcauuuguagcugcgggcuguauaaacagcccggagucccugugcgcuggaagagauga

SEQ ID NO: 2310 - RNA, 1473 nt, Artificial Sequence
  derived and/or modified CDS sequence (opt5) from Lassa virus__AIT17280__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauucgggucggcaacgagaccgggcucgagcugacgcuuaccaauacaucuaucaucgaccauaaauucugcaaccugagcgaugcgcacaagaaaaaucucuacgaccaugcucugauguccauuaucucuaccuuucaccugagcauuccgaacuucaaucaguaugaagccauguccugugauuuuaacggaggcaagaucagcgugcaguacaaucucucucacuccuaugccggcgacgcugccaaccauugcgggacaguugcuaauggagugcugcaaaccuucaugcgcauggccuggggcgggagcuacauugcgcuugauucuggacacgagugggacuguaucaugacguccuaccaguaucugauuauccagaacacaaccugggauaaccauugccaguuuagcagacccucuccuaucggcuaccucgggcugcuuucccaacggacacgcgacauuuauaucagcagacggcugcucggaaccuucaccuggacacuguccgauucugaaggcaaggacacgcccggcggguacugucugacccgcuggaugcucauugaggccgagcugaaaugcuuuggaaauacagcugucgccaaguguaacgaaaaacacgaugaggaguucugcgacaugcuuagacuguuugauuucaauaagcaggcuauccagcggcucaaaguggaagcccagaugagcauucaacugaucaacaaggcggugaaugcccuuaucaacgaccagcugauuaugaagaaucaccuccgcgacaucaugggcauuccuuauugcaacuacuccaaauauugguaccugaaucauaccacaaccgggaagacgagccugcccaaauguuggcucgucucuaacggauccuaccugaaugaaacacacuucagcgaugacaucgagcagcaagcugauaacaugauuaccgagaugcuucagaaggaauauauggagagacagggcaaaaccccucuggggcucguugaccuguuuguguucucuaccagcuuuuaccugaucuccaucuuccuucaucucgugaagauuccgacacaccggcauaucgucggaaaaucuugccccaagccucaccgccugaaucacaugggcauuuguagcugcggcuuuuauaagcagcccggggugccuguuaaauggaagagauga

SEQ ID NO: 2311 - RNA, 1476 nt, Artificial Sequence
  derived and/or modified CDS sequence (opt5) from Lassa virus__AIT17288__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauuauggucggcaacgagaccgggcucgagcugacgcuuaccaauacaucuaucaucaaccauaaauucugcaaucugagcgacgcgcacaagaaaaaccucuacgaucaugcucugauguccauuaucucuaccuuucaccugagcauuccgaauuucaaccaguaugaagccauguccugugacuuuaauggaggcaagaucagcgugcaguacaaccucucucacuccuaugccguugaugcugccaaucauugcggcacaguggcuaacgggguccugcaaaccuucaugcggauggccuggggaggcggguacauugcgcuugacagcggacgcggcaacugggauuguaucaugacgucuuaccaguaucugauuauccagaauacaaccugggaggaccacugccaguuuuccagacccagcccuaucggguaccucggacugcuuucucaacggacacgcgauauuuauaucuccagacggcugcucggcaccuucaccuggacacugagcgacuccgaaggcaaggauacgcccgggggauacugucugacccgcuggaugcucauugaggccgagcugaaaugcuuuggcaacacagcuguggccaaguguaaugaaaaacaugacgaggaguucugcgauaugcuuagacuguuugacuucaacaagcaggcuauccagcggcucaaagccgaagcgcagaugucuauucaacugaucaauaaggccgugaacgcucuuaucaaugaucagcugauuaugaagaaccaccuccgcgacaucauggggauuccuuauugcaauuacagcaaauauugguaccugaaccacaccgucacaggaaagaccucccugcccaaauguuggcucguuagcaauggcucuuaccugaacgaaacgcauuucuccgacgauaucgagcagcaagccgacaauaugauuacagagaugcuucagaaggaauauauggagagacaggggaaaaccccucugggacucguggaucuguuuguguucagcaccucuuuuuaccugaucagcaucuuccuucaccucgucaagauuccgacacaucggcacaucgugggcaaauccugccccaagccucaucgccugaaccacaugggcauuuguucuugcgggcuguauaagcagcccggaguuccugugagauggaaacgguga

SEQ ID NO: 2312 - RNA, 1476 nt, Artificial Sequence
  derived and/or modified CDS sequence (opt5) from Lassa virus__AIT17292__GPC
augggccagaucgugaccuucuuucaagaggucccccacguuauugaagaggugaugaacaucgugcugauugcccucagcaucauggcuguccugaaggggcuuuacaauauugccacaugcggacuggugggccucguuacguuccugcuucugugugggagauccugcaccacaacccucuauaaaggaguguacgaacugcagacacuggagcucaacauggaaacccugaauaugacaaugccucuuucuuguaccaagaacaauagccaucacuauaucauggucggcaacgagacggggcuggagcucacccugacaaauaccuccaucauuaaccauaaauuuugcaaucuuucugacgcgcacaagaaaaaccuguacgaucaugcucucaugagcaucauuuccacauuccaccugucuaucccgaauuuuaaccaguaugaagccaugagcugugacuucaauggaggcaagauuuccgugcaguacaaccugagccacucuuaugccggcgaugcugccaaucauugcgggaccguugcuaacggagugcuccaaacguuuaugcggauggccuggggcggguccuacaucgcgcuggacagcggacacggcgggugggauuguauuaugacaucuuaccaguaucuuaucauccagaacaccacaugggaggaccauugccaguucacccgccccuccccuauuggauaccugggccuccugagccaaagaacccgggauaucuauauuucucgcagacuucugggcacauuuacguggacccucuccgacagcgaagggaaugauacacccggaggcuacugucugacccgguggaugcugaucgaggccgagcucaagugcuucgggaacacagcugucgccaaauguaaugaaaagcacgacgaggaauuuugcgauaugcugcgccuuuucgacuuuaacaaacaggcuauucagagacugcgggccgaggcgcagauguccauccaacucaucaauaaggccgugaacgcucugauuaaugaucagcuuaucaugaaaaaccaucugcgcgacauuaugggaaucccuuauugcaauuacucuaaguauugguaccucaaccacaccacgacaggcagaaccagccugccccgguguuggcugguguccaaugggagcuaccucaacgaaacccacuucucugacgauauugagcagcaagccgacaauaugaucacagagaugcugcagaaggaauauauggagcgccagggaaaaaccccucuuggccuggucgaucucuucguuuuuagcacauccuucuaccugaucucuauuuuucugcaucuuaucaagauuccgacgcacagacauaucgugggcaaacccugcccuaagccccaccggcucaaccacauggggguguguagcugcggacuguauaaacagccuggcguccccgugcgcuggaagagauga

SEQ ID NO: 2313 - RNA, 1476 nt, Artificial Sequence
  derived and/or modified CDS sequence (opt5) from Lassa virus__AIT17294__GPC
augggccagaucgugaccuucuuucaagaggucccccacguuauugaagaggugaugaacaucgugcugauugcccucagcauccuggcuguccuuaaggggcuguacaaucucgccacaugcggacuggugggccuuguuacguuccugcuccugugugggagauccugcaccacaucucuguauaaaggaguguacgaacuccagacccuggagcuuaacauggaaacacugaauaugaccaugccucucagcuguacaaagaacaauucccaucacuauauuauggucggcaacgagaccgggcuggagcuuacgcugaccaauacaucuaucaucgaccauaaauuuugcaaccucagcgaugcgcacaagaaaaaucuguacgaccaugcucugauguccauuaucucuaccuuccaccucagcauuccgaacuuuaaucaguaugaagccauguccugugauuucaacggaggcaagaucagcgugcaguacaaucugucucacuccuaugccggcgacgcugccaaccauugcgggacaguugcuaauggagugcuucaaaccuuuaugcggauggccuggggcgggagcuacauugcgcuggauucuggacgcggcgggugggacuguaucaugacguccuaccaguaucucauuauccagaacacaaccugggaggaucacugccaguucagcagacccucuccugucggauaccugggccuucugucccaacggacacgcgacaucuauauuagcagacggcuccugggcaccuuuaccuggacacuguccgauucugaagggaaggacacgcccggaggcuacugucucacccgcuggaugcugaucgaggccgagcuuaaaugcuucgggaacacagcuguggccaaguguaaugaaaaacaugaugaggaauuuugcgacaugcugagacucuucgauuuuaacaagcaggcuauucagcggcugaaaaccgaggcccagaugagcauccaacuuauuaauaaggcggugaacgcccugaucaaugaccagcucaucaugaagaaccaucugcgcgacauuaugggaaucccuuauugcaauuacuccaaauauugguaccugaaccacacaaccacgggcaagacaagccuccccagauguuggcuggucucuaauggguccuaccuuaacgaaacccacuucagcgaugacauugagcagcaagcugauaauaugaucaccgagaugcugcagaaagaauauauggagcggcagggaaagacaccucucggccugguugaccuguucguguuuucuaccagcuucuaccuuauuuccaucuuucuccaccuggugaaaaucccgacacaucgccacauugucggcaagcccugcccuaaaccccauagacugaaccacauggggaucuguucuugcggacucuauaagcagccuggcgugcccguuaaguggaaacgguga

SEQ ID NO: 2314 - RNA, 1476 nt, Artificial Sequence
  derived and/or modified CDS sequence (opt5) from Lassa virus__AIT17298__GPC
augggccagaucgugaccuucuuucaagaggucccccacguuauugaagaggugaugaacaucgugcugauugcccucagcauccuggcuguccuuaaggggcuguacaauauugccacaugcggacuccugggccuuguguguuuccugcuccugugcgggagauccuguacgaccucucuguauaaaggaguuuacgaacuccagacacuggagcuuaacauggaaacccugaauaugacaaugccucucagcugcaccaagaacaauucccaucacuauaucauggugggcaacgagacagggcuggagcuuacccugacgaauaccucuaucauuaaccauaaauuuuguaaucucagcgacgcgcacaagaaaaaccuguacgaucaugcucugauguccaucauuucuacauuccaccucagcaucccgaauuuuaaccaguaugaagccauguccugcgacuucaauggaggcaagauuagcguccaguacaaccugucucacuccuaugccguggaugcugccagccauuguggcaccaucgcuaaugggguucuucaaacauuuaugcggauggccuggggaggcucuuacauugcgcuggacuccgggcacggaggcugggauugcaucaugaccagcuaccaguaucucaucauucagaacacgacaugggaggaccauugucaguucucucgccccuccccuaucggguaccugggacuucugagccaaagaacccgggauauuuauaucucccgcagacuccugggcacauuuaccuggacccugucugacagcgaaggcaaggauacacccgggggauacugccucacgcgguggaugcugauugaggccgagcuuaaauguuucggcaacaccgcuguggccaagugcaaugaaaaacacgacgaggaauuuugcgauaugcugcgccucuucgacuuuaacaagcaggcuauccagagacugaaagccgaggcgcagauguccauccaacuuauuaauaaggccgucaacgcucugaucaaugaucagcucauuaugaagaaccaucugcgggacaucauggggauuccuuauuguaauuacagcaaauauugguaccugaaccacacaaccacaggaaagaccucucuccccaaaugcuggcugguguccaauggcagcuaccuuaacgaaacgcacuucucugacgauaucgagcagcaagccgacaauaugaucacagagaugcugcagaaggaauauauggagcgccaggggaaaaccccucucggacugguggaucuguucgucuuuagcaccuccuucuaccuuauuucuaucuuucuccaucugguuaagauuccgacacacagacauguggugggcaaacccuguccuaagccccaccggcugaaccacaugggcaucugcagcugugggcucuauggacagccuggcguccccgugaaguggaaacgcuga

SEQ ID NO: 2315 - RNA, 1476 nt, Artificial Sequence
  derived and/or modified CDS sequence (opt5) from Lassa virus__AIT17302__GPC
augggccagaucgugaccuucuuucaagaggucccccacguuauugaagaggugaugaacaucgugcugauugcccucagccugcuugcuguccugaaggggcucuacaauguggccacaugcggacugaucggccuuguuacguuccugcuccugugugggagauccugcaccacaaaccuguauaaaggaguguacgaacuccagacccuggagcuuaauauggaaacacugaacaugaccaugccucucucuuguacaaagaauaacagccaucacuauauuauggucggcaaugagaccgggcuggagcuuacgcugaccaacacauccaucaucucucauaaauuuugcaaucucagcgacgcgcacaagaaaaaccuguacgaucauacccugauguccauuaucucuacauuccaccucagcauuccgaauuuuaaccaguaugaagcuauguccugugacuucaauggaggcaagaucagcgugcaguacaaccugucucacuccuaugccguugaugccgcuaaucauugcggcaccguggccaacgggguccuucaaacguuuaugcggauggcuuggggaggcagcuacauugcccuggacucugggcgcggaaacugggauuguaucaugacauccuaccaguaucucauuauccagaauaccacaugggaggaccacugccaguucagcagacccucuccuaucggcuaccuggggcuucugucccaacggacccgcgauauuuauaucagcagacggcuccugggaaccuuuacauggacgcuguccgacucugaaggcaacgauacccccggcggguacugucucacacgcuggaugcugauugaggcggagcuuaagugcuucggaaauaccgccguggcuaaauguaacgaaaagcaugacgaggaauuuugcgauaugcugagacucuucgacuuuaauaaacaggccauccagcggcugaaggcugaggcccagaugagcauucaacuuaucaacaaagcggugaaugcccugaucaacgaucagcucauuaugaagaaucaucugcgcgacaucaugggcauuccuuauugcaacuacuccaaguauugguaccugaaucacacaaccacggggaaaacaagccuccccaaguguuggcuggucucuaacggauccuaccuuaaugaaacccacuucagcgacgauaucgagcagcaagcugacaacaugauuaccgagaugcugcagaaagaauauauggagagacagggcaagacaccucucgggcugguugaucuguucguguuuucuaccagcuucuaccuuaucuccaucuuucuccaccuggugaaaauuccgacacaucggcacaucgucggaaagcccugcccuaaaccccaucgccugaaucacaugggcauuuguucuugcggccucuauaagcagccuggggugcccguuagauggaagcgguga

SEQ ID NO: 2316 - RNA, 1476 nt, Artificial Sequence
  derived and/or modified CDS sequence (opt5) from Lassa virus__AIT17310__GPC
augggccagaucgugaccuucuuucaagaggucccccacguuauugaagaggugaugaacaucgugcugauugcccucagcauccuggcuguccuuaaggggcuguacaaucucgccacaugcggacuggugggccuuguuacguuccugcuccugugugggagauccugcaccacaucucuguauaaaggaguguacgaacuccagacccuggagcuuaacauggaaacacugaauaugaccaugccucucagcuguacaaagaacaauucccaucacuauauuauggucggcaacgagaccgggcuggagcuuacgcugaccaauacaucuaucaucaaccauaaauuuugcaaucucagcgacgcgcacaagaaaaaccuguacgaucaugcucugauguccauuaucucuaccuuccaccucagcauuccgaauuuuaaccaguaugaagccauguccugugacuucaauggaggcaagaucagcgugcaguacaaccugucucacuccuaugccggcgaugcugccacacauugcgggaccguugcuaauggagugcuucaaacguuuaugcggauggccuggggcgggagcuacauugcgcuggacucuggacgcggcaagugggauuguaucaugacauccuaccaguaucucauuauccagaacaccacaugggaggaccacugccaguucagcagacccucuccuaucggguaccugggacuucugucccaacggacccgcgauauuuauaucagcagacggcuccugggcaccuuuacauggacgcuguccgacucugaaggcaaagauacccccgggggauacugucucacacgcuggaugcugauugaggccgagcuuaagugcuucggcaacaccgcugucgccaaauguaaugaaaagcaugacgaggaauuuugcgauaugcugagacucuucgacuuuaacaaacaggcuauccagcggcugaagacagaggcccagaugagcauucaacuuaucaauaaggcggugaacgcccugaucaaugaucagcucauuaugaaaaaccaucugcgcgacaucauggggauuccuuauugcaauuacuccaaguauugguaccugaaccacaccacgacaggaaaaaccagccuccccagauguuggcuggugucuaauggcuccuaccuuaacgaaacccacuucagcgacgauaucgagcagcaagcugacaauaugauuacagagaugcugcagaaggaauauauggagcggcaggggaaaaccccucucggacuggucgaucuguucguuuuuagcacaucuuucuaccuuaucuccaucuuucuccaccuggugaagauuccgacgcaucgccacaucgugggcaaacccugcccuaagccccauagacugaacuauaugggcauuuguucuugcgggcucuacaagcagccuggaguccccgugaaauggaagcgguga

SEQ ID NO: 2317 - RNA, 1476 nt, Artificial Sequence
  derived and/or modified CDS sequence (opt5) from Lassa virus__AIT17314__GPC
augggccagaucgugaccuucuuucaagaggucccccacguuauugaagaggugaugaacaucgugcugauuacacucagcauccuggccguccuuaaggggcuguacaauguggcuacgugcggacucguuggccuggugaccuuccuucugcucugugggagauccugcacaaccucucuguauaaaggagucuacgaacugcagacacucgagcugaacauggaaacccuuaauaugacaaugccucugagcuguaccaagaacaauucccaucacuauauuauggugggcaacgagacggggcucgagcugacccuuacaaauaccucuaucaucaaccauaaauuuugcaaucugagcgacgcccacaagaaagaucucuacgaccaugcgcugauguccauuaucucuacauuccaccugagcauuccgaacuuuaaucaguaugaagcuauguccugugauuucaacggaggcaagaucagcguucaguacaaucucucucacuccuaugccguggacgccgcuaaccauugcggcaccgucgccaauggggugcugcaaacguuuaugcggauggcuuggggaggcagcuacauugcccuugauucugggcgcggaggcugggacuguaucaugacauccuaccaguaucugauuauccagaacaccacaugggaggaucacugccaguucagcagacccucuccuaucggguaccucggacugcuuucccaacggacccgcgacauuuauaucagcagacggcugcucggcaccuuuacauggacgcuguccgauucugaaggcaacgacacccccgggggauacugucugacacgcuggaugcucauugaggcggagcugaagugcuucggcaauaccgccguggcuaaauguaacgaaaagcaugaugaggaauuuugcgacaugcuuagacuguucgauuuuaauaaacaggccauccagcggcucaaggcugaggcccagaugagcauucaacugaucaacaaagcggucaaugcccuuaucaacgaccagcugauuaugaagaaucaccuccgcgacaucauggggauuccuuauugcaacuacuccaaguauugguaccugaaucacacaaccacgggaaaaacaagccugcccaaguguuggcucguuucuaacggcuccuaccugaaugaaacccauuucagcgaugacaucgagcagcaagcugauaacaugauuaccgagaugcuucagaaagaauauauggagagacaggggaagacaccucugggacucguggaccuguucguguuuucuaccagcuucuaccugaucuccaucuuucuucaccucgucaaaauuccgacacaucggcacaucgugggcaagcccugcccuaaaccccaucgccugaaucacaugggcauuuguucuugcgggcuguauaagcagccuggaguucccgugaaguggaaaagauga

SEQ ID NO: 2318 - RNA, 1476 nt, Artificial Sequence
  derived and/or modified CDS sequence (opt5) from Lassa virus__AIT17318__GPC
augggccagaucgugaccuucuuucaagaggucccccacguuauugaagaggugaugaacaucgugcugauugcccucagccugcuugcuguccugaaggggcucuacaauguggccacaugcggacugaucggccuuguuacguuccugcuccugugugggagauccugcaccacaaaccuguauaaaggaguguacgaacuccagacccuggagcuuaauauggaaacacugaacaugaccaugccucucucuuguacaaagaauaacagccaucacuauauuauggucggcaaugagaccgggcuggagcuuacgcugaccaacacauccaucaucaaucauaaauuuugcaaccucucugacgcgcacaagaaaaaucuguacgaucaugcucugaugagcauuaucuccaccuuccaccucucuauuccgaacuuuaaucaguaugaagccaugagcugugacuucaacggaggcaagaucuccgugcaguacaaucugagccacucuuaugccguugaugcugccaaccauugcggcacaguggcuaacgggguccuucaaaccuuuaugcggauggccuggggaggcuccuacauugcgcuggacagcgggcgcggaaauugggauuguaucaugacgucuuaccaguaucucauuauccagaacaucacaugggaggaccacugccaguucuccagacccagcccuauuggcuaccuggggcuucugucucaacggacccgcgauaucuauauuuccagacggcuccugggaacauuuaccuggacccugagcgacuccgaaggcaaugauacacccggcggguacugucucacgcgcuggaugcugaucgaggccgagcuuaagugcuucggaaacaccgcuguggccaaauguaaugaaaagcaugacgaggaauuuugcgauaugcugagacucuucgacuuuaacaaacaggcuauucagcggcugaaggccgaggcgcagaugucuauccaacuuaucaauaaagccgugaacgcucugauuaaugaucagcucaucaugaagaaccaucugcgcgacauuaugggcaucccuuauugcaauuacagcaaguauugguaccugaaccacacaaccacagggaaaaccucccuccccaaguguuggcuggucagcaauggaucuuaccuuaacgaaacgcacuucuccgacgauauugagcagcaagccgacaauaugaucacagagaugcugcagaaagaauauauggagagacagggcaagaccccucucgggcugguugaucuguucguguuuagcaccucuuucuaccuuaucagcauuuuucuccaccuggugaaaaucccgacacaucggcacauugucggaaagcccugcccuaaaccccaucgccugaaccacaugggcaucuguuccugcggccucuauaagcagccuggggugcccguuagauggaagcgguga

SEQ ID NO: 2319 - RNA, 1476 nt, Artificial Sequence
  derived and/or modified CDS sequence (opt5) from Lassa virus__AIT17322__GPC
augggccagaucgugaccuucuuucaagaggucccccacguuauugaagaggugaugaacaucgugcugauugcccucagccugcuugcuguccugaaggggcucuacaauguggccacaugcggacugaucggccuuguuacguuccugcuccugugugggagauccugcaccacaaaccuguauaaaggagcguacgaacuccagacccuggagcuuaauauggaaacacugaacaugaccaugccucucucuuguacaaagaauaacagccaucacuauauuauggugggcaaugagaccgggcuggagcuuacgcugaccaacacauccaucaucaaucauaaauuuugcaaccucucugacgcucacaagaaaaaucuguacgaucauacccugaugagcauuaucuccacauuccaccucucuauuccgaacuuuaaucaguaugaagccaugagcugugacuucaacggaggcaagaucuccguccaguacaaucugagccacucuuaugccguggaugcugccaaccauugcggcaccguugcuaacggggugcuucaaacguuuaugcggauggccuggggaggcuccuacauugcgcuggacagcgggcgcggaaauugggauuguaucaugacaucuuaccaguaucucauuauccagaacaccacaugggaggaccacugccaguucuccagacccagcccuaucggcuaccuggggcuucugucucaacggacccgcgauauuuauaucuccagacggcuccugggaaccuuuacauggacgcugagcgacuccgaaggcaaugauacccccggcggguacugucucacacgcuggaugcugauugaggccgagcuuaagugcuucggaaacaccgcugucgccaaauguaaugaaaagcaugacgaggaauuuugcgauaugcugagacucuucgacuuuaacaaacaggcuauccagcggcugaaggccgaggcgcagaugucuauucaacuuaucaauaaagccgugaacgcucugaucaaugaucagcucauuaugaagaaccaucugcgcgacaucaugggcauuccuuauugcaauuacagcaaguauugguaccugaaccacacaaccacggggaaaacaucccuccccaaguguuggcuggugagcaauggaucuuaccuuaacgaaacccacuucuccgacgauaucgagcagcaagccgacaauaugauuaccgagaugcugcagaaagaauauauggagagacagggcaagacaccucucgggcuggucgaucuguucguuuuuagcaccucuuucuaccuuaucagcaucuuucuccaccuggugaaaauuccgacacaucggcacaucgugggaaagcccugcccuaaaccccaucgccugaaccacaugggcauuuguuccugcggccucuauaagcagccugggguccccgugagauggaagcgguga

SEQ ID NO: 2320 - RNA, 1476 nt, Artificial Sequence
  derived and/or modified CDS sequence (opt5) from Lassa virus__AIT17328__GPC
augggccagaucgugaccuucuuucaagaggucccccacguuauugaagaggugaugaacaucgugcugauuacacucagcauccuggccguccuuaaggggcuguacaauauugcuacgugcggacucgugggccugguuaccuuccuucugcucugugggaaauccugcacaaccucucuguauaagggaguguacgaacugcagacacucgagcugaacauggaaacccuuaauaugacaaugccucugagcuguaccaaaaacaauucccaucacuauaucagagucggcaacgagacggggcucgagcugacccuuacaaauaccucuaucauuaaccauaaguuuugcaaucugagcgacgcccacaaaaagaaccucuacgaucaugcgcugauguccaucauuucuacauuccaccugagcaucccgaauuuuaaccaguaugaagcuauguccugugacuucaauggaggcaagauuagcgugcaguacaaccucucucacuccuaugccguugaugccgcuaaucauugcggcaccguggccaacgggguccugcaaacguuuaugcggauggcuuggggaggcagcuacaucgcccuugacucugggcacggaaacugggauuguauuaugacauccuaccaguaucugaucauccagaauaccacaugggaggaccauugccaguucagccgccccucuccuauuggcuaccucgggcugcuuucccaaagaacccgggauaucuauauuagccgcagacugcucggaaccuuuacauggacgcuguccgacucugaaggcaacgaugcgcccggcggguacugucugacccgguggaugcucaucgaggccgagcugaaaugcuucggaaauacagcuguggccaaguguaacgaaaaacacgacgaggaauuuugcgauaugcuucgccuguucgacuuuaauaagcaggcuauucagagacucaaagccgaggcgcagaugagcauccaacugaucaacaaggccgugaaugcucuuauuaacgaucagcugaucaugaagaaucaccuccgggacauuaugggcaucccuuauugcaacuacuccaaauauugguaccugaaucauaccacaaccgggaagacgagccugcccaaauguuggcucgucucuaacggauccuaccugaaugaaacacacuucagcgacgauauugagcagcaagccgacaacaugaucaccgagaugcuucagaaggaauauauggagcgccagggcaaaaccccucuggggcucguugaucuguucguguuuucuaccagcuucuaccugaucuccauuuuucuucaucucgugaagaucccgacacacagacaugucgugggaaaaucuugccccaagccucaccggcugaaucacaugggcauuuguagcugcggccuguauaagcagcccgggguuccugugaaauggaagcgcuga

SEQ ID NO: 2321 - RNA, 1476 nt, Artificial Sequence
  derived and/or modified CDS sequence (opt5) from Lassa virus__AIT17332__GPC
augggccagaucgugaccuucuuucaagaggucccccacguuauugaagaggugaugaacaucgugcugauugcccucagcauccuggcuguccuuaaggggcuguacaaucucgccacaugcggacuggugggccuuguuacguuccugcuccugugugggagauccugcaccacaucucuguauaaaggaguguacgaacuccagacccuggagcuuaacauggaaacacugaauaugaccaugccucucagcuguacaaagaacaauucccaucacuauauucgggucggcaacgagaccgggcuggagcuuacgcugaccaauacaucuaucaucaaccauaaauuuugcaaucucagcgacgcgcacaagaaaaaccuguacgaucaugcucugauguccauuaucucuaccuuccaccucagcauuccgaauuuuaaccaguaugaagccauguccugugacuucaauggaggcaagaucagcgugcaguacaaccugucucacuccuaugccguugaugcugccaaucauugcggcacaguggcuaacgggguccuucaaaccuuuaugcgcauggccuggggaggcagcuacauugcgcuggacucugggcacggaagaugggauuguaucaugacguccuaccaguaucucauuauccagaacacaaccugggaggaccauugccuguucagccggcccucuccuaucggcuaccuugggcugcucucccagcgcacaagagauauuuauaucagccggcgccugcugggaaccuuuaccuggacacucuccgacucugaaggcagagauacgcccggcggguacugucugacccgguggaugcuuauugaggccgagcugaagugcuucggaaauacagcuguggccaaauguaacgaaaagcacgacgaggaauuuugcgauaugcuccgccuguucgacuuuaauaaacaagcuauccagagacuuaaggccgaggcgcagaugagcauucagcugaucaacaaagccgugaaugcucucaucaacgaucaacugauuaugaagaaucaucugcgggacaucaugggcauuccuuauugcaacuacuccaaguauugguaccucaaucacaccacaaccgggcgcacgagccugcccagauguuggcuugucucuaacggauccuaccugaaugaaacacacuucagcgacgauaucgagcagcaggccgacaacaugauuaccgagaugcuccaaaaagaauauauggagcggcagggcaagaccccucuggggcugguugaucuuuucguguuuucuaccagcuucuaccucaucuccaucuuucugcaucuggugaaaauuccgacacaccgccauaucgucggaaagucuugccccaaaccucacagacucaaucacaugggcauuuguagcugcggccuguauaagcagcccggggugccuguuaaauggaagcgguga

SEQ ID NO: 2322 - RNA, 1476 nt, Artificial Sequence
  derived and/or modified CDS sequence (opt5) from Lassa virus__AIT17340__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauuauggucggcaacgagaccgggcucgagcugacgcuuaccaauaucucuaucauuaaccauaaauucugcaaucugagcgacgcgcacaagaaaaaccucuacgaucaugcucugauguccaucauuucuacauuucaccugagcaucccgaauuucaaccaguaugaagccauguccugugacuuuaauggaggcaagauuagcgugcaguacaaccucucucacuccuaugccggcgaugcugccaaucauugcgggaccguugcuaacggagugcugcaaacauucaugcggauggccuggggcgggagcuacaucgcgcuugacucuggacgcggcgagugggauuguauuaugaccuccuaccaguaucugaucauccagaacacgacaugggaagaccacugccaguuuagcagacccucuccuauuggguaccucggacugcuuucccaacggacccgcgauaucuauauuagcagacggcugcucggcacauucaccuggacccuguccgacucugagggcaaggauacacccgggggauacugucugacgcgcuggaugcucaucgaggccgaacugaaaugcuuuggcaauaccgcugucgccaaguguaacgagaaacaugacgaagaguucugcgauaugcuuagacuguuugacuucaauaagcaggcuauucagcggcucaaagccgaagcgcagaugagcauccaacugaucaacaaggccgugaaugcucuuauuaacgaucagcugaucaugaagaaucaccuccgcgacauuauggggaucccuuauugcaacuacuccaaauauugguaccugaaucacacaaccacaggaaagaccagccugcccaaauguuggcucgugucuaacggcuccuaccugaaugagacgcauuucagcgacgauauugagcagcaagccgacaacaugaucacagaaaugcuucagaaggaguauauggaaagacaggggaaaaccccucugggacucgucgaucuguuuguuuucucuaccagcuuuuaccugaucuccauuuuccuucaccucgugaagaucccgacacaucggcacauugugggcaaacccugcccucgcccccauagacugaaucacaugggcaucuguucuugcgggcuguauaagcagccuggaguccccgugaaguggaaacgguga

SEQ ID NO: 2323 - RNA, 1476 nt, Artificial Sequence
  derived and/or modified CDS sequence (opt5) from Lassa virus__AIT17344__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauuauggucggcaacgagaccgggcucgagcugacgcuuaccaauacaucuaucaucaaccauaaauucugcaaucugagcgacgcgcacaagaaaaaccucuacaaucaugcucugauguccauuaucucuaccuuucaccugagcauuccgaacuucaaucaguaugaagccauguccugugauuuuaacggaggcaagaucagcgugcaguacaaucucucucacuccuaugccggcgacgcugccagccauugcgggacaguugcuaacggagugcugcaaaccuucaugcggauggccuggggcgggucuuacauugcgcuugauuccggauacggcaagugggacuguaucaugacgagcuaucaguaccugauuauccagaacacaaccugggaggaucacugccaguuuucucgccccuccccuaucggguaucucggacugcuuagccaaagaacacgggacauuuacaucucccgcagacugcucggcaccuucaccuggacacugucugauagcgaaggcaaagacacgcccgggggauauugucugacccgguggaugcucauugaggccgagcugaagugcuuuggcaauacagcugucgccaaauguaacgaaaagcaugaugaggaguucugcgacaugcuucgccuguuugauuucaauaaacaggcuauccagagacucaagaccgaagcccagauguccauucaacugaucaacaaggcggugaaugcccuuaucaacgaccagcugauuaugaaaaaucaccuccgggauaucauggggauuccuuacugcaacuauagcaaguacugguaccugaaucacacaaccacgggaaaaacaucucugcccaaguguuggcucguguccaacggcagcuaucugaaugaaacccauuucucugacgacaucgagcagcaagcugauaacaugauuaccgagaugcuucagaaagaauacauggagcgccaggggaagacaccucugggacucgucgaccuguuuguuuucagcaccuccuuuuaucugaucucuaucuuccuucaccucgugaaaauuccgacacauagacacaucgugggcaagagcugccccaagccucaucggcugaaucacaugggcauuuguuccugcgggcuguacaaacagcccggagucccugugcgcuggaagagauga

SEQ ID NO: 2324 - RNA, 1476 nt, Artificial Sequence
  derived and/or modified CDS sequence (opt5) from Lassa virus__AIT17348__GPC
augggccagaucgugaccuucuuucaagaggucccccacguuauugaagaggugaugaacaucgugcugauugcccucagcauccuggcuguccuuaaggggcuguacaauauugccacaugcggacucaucggccuggugacguuccuucugcucugugggagauccugcaccacaucucuguauaaaggaguuuacgaacugcagacccucgagcugaacauggaaacacuuaauaugaccaugccucugagcuguacaaagaacaauucccaucacuauaucauggugggcaacgagaccgggcucgagcugacgcuuaccaauacaucuauuaucaaccauaaauuuugcaaucugagcgacgcgcacaagaaaaaccucuacgaucaugcucugauguccauuaucucuaccuuccaccugagcauuccgaauuuuaaccaguaugaagccauguccugugacuucaauggaggcaagaucagcguccaguacaaccucucucacuccuaugccggcgaugcugccaaucauugcgggacaguggcuaacggaguucugcaaaccuuuaugcggauggccuggggcgggagcuacauugcgcuugacucuggacgcggcagaugggauuguaucaugacguccuaccaguaucugaucauucagaacacaaccugggaggaccacugccaguucagccggcccucuccuaucggguaccucggacugcuuucccaacgcacaagagauauuuauaucagccggcgccugcucggcaccuuuaccuggacacuguccgacucugaaggcaaugauacgcccgggggauacugucugaccagauggaugcucauugaggccgagcugaagugcuucggcaacacagcuguggccaaauguaaugaaaagcaugacgaggaauuuugcgauaugcuucggcuguucgacuuuaacaaacaggcuauccagcgccucaaggccgaggcgcagaugagcauccaacugauuaauaaagccgucaacgcucuuaucaaugaucagcugauuaugaagaaccaccucagagacaucauggggauuccuuauugcaauuacuccaaguauugguaccugaaccacaccacaaccggaaaaacgagccugcccaaguguuggcucgugucuaauggcuccuaccugaacgaaacacauuucagcgacgauaucgagcagcaagccgacaauaugaucaccgagaugcuucagaaagaauauauggagcggcaggggaagaccccucugggacucguggaucuguucgucuuuucuaccagcuucuaccugauuuccaucuuucuucaccucguuaaaauuccgacacaucgccacaucgugggcaagcccugcccuaaaccccauagacugaaccacaugggcauuuguucuugcgggcuguauaagcagccuggagugcccgucaaguggaaacgguga

SEQ ID NO: 2325 - RNA, 1476 nt, Artificial Sequence
  derived and/or modified CDS sequence (opt5) from Lassa virus__AIT17350__GPC
augggccagaucgugaccuucuuucaagaggucccccacguuauugaagaggugaugaacaucgugcugauugcccucagcauccuggcuguccuuaaggggcuguacaauguggccacaugcggacucauuggccugguuacguuccuucugcucugugggagauccugcaccacaacccuguauaaaggaguguacgaacugcaggcgcucgagcugaacauggaaacacuuaauaugaccaugccucugucuuguacaaagaacaauagccaucacuauaucauggucggcaacgagaccgggcucgagcugacgcuuaccaauacauccaucauugaccauaaauuuugcaaccugucugaugcucacaagaaaaaucucuacgaccaugcccugaugagcaucauuuccaccuuccaccugucuaucccgaacuuuaaucaguaugaagccaugagcugugauuucaacggaggcaagauuuccgugcaguacaaucucagccacucuuaugcuggcgacgccgcuaagcauugcgggacaguugccaacggagugcugcaaaccuuuaugcggauggcguggggcggguccuacaucgcccuugauagcggacgcaauggcugggacugugucaugacgucuuaccaguaucugauuauccagaacacaaccugggaggaucacugccaguucuccagacccagcccuaucggguaccucggacugcuuucucaacggacacgcgacauuuauaucuccagacggcugcucggcaccuuuaccuggacacugagcgauuccgaaggcaaagacacgcccgggggauacugucugacccgcuggaugcucauugaggcugagcugaagugcuucggcaacacagccguggcuaaauguaaugaaaagcaugaugaggaauuuugcgacaugcuuagacuguucgauuuuaacaaacaggccauccagcggcucaagaccgaggcgcagaugucuauucaacugaucaauaaggccgugaacgcucuuaucaaugaccagcugauuaugaaaaaccaccuccgcgacaucauggggauuccuuauugcaauuacagcaaguauugguaccugaaccacacagucaccggaaaaacgucccugcccagauguuggcucguuagcaauggcucuuaccugaacgaaacacauuucuccgaugacaucgagcagcaagccgauaauaugauuaccgagaugcuucagaaggaauauaucgagcggcaggggaaaaccccucugggacucguggaccuguucguguuuagcacaucuuucuaccugaucagcauuuuucuucaccucgucaagaucccgacccaucgccacauuaucggcaaacccugcccuaagccccauagacugaaccacaugggcauuuguuccugcgggcuguauaagcagccuggagugcccguucgguggaaacgcuga

SEQ ID NO: 2326 - RNA, 1476 nt, Artificial Sequence
  derived and/or modified CDS sequence (opt5) from Lassa virus__AIT17354__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauuauggucggcaacgagaccgggcucgagcugacgcuuaccaauaucucuaucauuaaccauaaauucugcaaucugagcgacgcgcacaagaaaaaccucuacgaucaugcucugauguccaucauuucuacauuucaccugagcaucccgaauuucaaccaguaugaagccauguccugugacuuuaauggaggcaagauuagcgugcaguacaaccucucucacuccuaugccggcgaugcugccaaucauugcgggaccguugcuaacggagugcugcaaacauucaugcggauggccuggggcgggagcuacaucgcgcuugacucuggacacggcgggugggauuguauuaugaccuccuaccaguaucugaucauccagaacacgacaugggaggaccauugccaguuuagccgccccucuccuauuggauaccucggccugcuuucccaaagaacccgggauaucuauauuagccgcagacugcucggcacauucaccuggacccuguccgacucugaagggaaggauacacccggaggcuacugucugacgcgguggaugcucaucgaggccgagcugaaaugcuuugggaauaccgcugucgccaaguguaacgaaaaacacgacgaggaguucugcgauaugcuucgccuguuugacuucaauaagcaggcuauucagagacucaaagccgaagcgcagaugagcauccaacugaucaacaaggccgugaaugcucuuauuaacgaucagcugaucaugaagaaucaccuccgggacauuaugggaaucccuuauugcaacuacuccaaauauugguaccugaaucauacaaccacaggcaagaccagccugcccaaauguuggcucgugucuaacggguccuaccugaaugaaacgcacuucagcgacgauauugagcagcaagccgacaacaugaucacagagaugcuucagaaggaauauauggagcgccagggaaaaaccccucugggccucgucgaucuguuuguuuucucuaccagcuuuuaccugaucuccauuuuccuucaucucgugaagaucccgacacacagacauauugugggcaaacccugcccucggccccaccgccugaaucacauggggaucuguucuugcggacuguauaagcagccuggcguccccgugaaguggaaaagauga

SEQ ID NO: 2327 - RNA, 1476 nt, Artificial Sequence
  derived and/or modified CDS sequence (opt5) from Lassa virus__AIT17360__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauucgggucggcaacgagaccgggcucgagcugacgcuuaccaauacaucuaucaucaaccaucgcuucugcaaucugagcgacgcgcacaaaaagaaccucuacgaucaugcucugauguccauuaucucuaccuuucaccugagcauuccgaauuucaaccaguaugaagccauguccugugacuuuaauggaggcaaaaucagcgugcaguacaaccucucucacuccuaugccggcgaugcugccaaucauugcgggacaguugcuaacggagugcugcaaaccuucaugagaauggccuggggcgggagcuacauugcgcuugacucuggacacggcaagugggauuguaucaugacguccuaccaguaucugauuauccagaacacaaccugggacgaucauugccaguuuagccggcccucuccuaucggguaccucggacugcuuucccaacgcacaagagacauuuauaucagccggcgccugcucggcaccuucaccuggacacuguccgauucugagggcaaggacacgcccgggggauacugucugaccagauggaugcucauugaagccgagcugaaaugcuuuggcaauacagcugucgccaaguguaacgagaaacacgaugaagaguucugcgacaugcuucggcuguuugauuucaauaagcaggcuauccgcagacucaaagccgaagcgcagaugagcauucagcugaucaacaaggccgugaaugcucuuaucaacgaccaacugauuaugaagaaucaccuccgggacaucauggggauuccuuauugcaacuacuccaaauauugguaccugaaucauaccacaaccggaaagacgagccugccccgcuguuggcucgugucuaacggcuccuaccugaaugagacacacuucagcgaugacaucgaacagcaggccgauaacaugauuaccgagaugcuucaaaaagaguauauggaaagacaggggaagaccccucugggacucgucgaccuguuuguuuucucuaccagcuuuuaccugaucuccaucuuccuucaucucgugaaaauuccgacacaccggcauaucgugggcaagucuugccccaaaccucaccgccugaaucacaugggcauuuguagcugcggguuuuauaagcagcccggagucccugugaaguggaaaagauga

SEQ ID NO: 2328 - RNA, 1476 nt, Artificial Sequence
  derived and/or modified CDS sequence (opt5) from Lassa virus__AIT17364__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauuauggucggcaacgagaccgggcucgagcugacgcuuaccaauacaucuaucaucaaccauaaauucugcaaucugagcgacgcgcacaagaaaaaccucuacgaucaugcucugauguccauuaucucuaccuuucaccugagcauuccgaauuucaaccaguaugaagccauguccugugacuuuaauggaggcaagaucagcgugcaguacaaccucucucacuccuaugccggcgaugcugccaaucauugcgggacaguugcuaacggagugcugcaaaccuucaugcggauggccuggggcgggagcuacauugcgcuugacucuggacgcgauagaugggacuguaucaugacguccuaccaguaucugauuauccagaacacaaccugggaggaucacugccaguuuagccggcccucuccuaucggcuaccucgggcugcuuucccaacgcacaagagacauuuauaucagccggcgccugcucggaaccuucaccuggacacuguccgauucugaaggcaaggacacgcccggcggguacugucugaccagauggaugcucauugaggccgagcugaaaugcuuuggaaauacagcugucgccaaguguaacgaaaaacaugaugaggaguucugcgacaugcuucggcuguuugauuucaauaagcaggcuauccagcgccucaaagccgaagcgcagaugagcauucaacugaucaacaaggccgugaaugcucuuaucaacgaccagcugauuaugaagaaucaccucagagacaucaugggcauuccuuauugcaacuacuccaaauauugguaccugaaucacaccacaaccgggaagacgagccugcccaaauguuggcucgugucuaacggauccuaccugaaugaaacacauuucagcgaugacaucgagcagcaagccgauaacaugauuaccgagaugcuucagaaggaauauaucgagcggcagggcaaaaccccucuggggcucgucgaccuguuuguuuucucuaccagcuuuuaccugaucuccauuuuccuucaccucgugaagaucccgacacaucgccacauugugggaaaacccugcccuaagccccauagacugaaucacaugggcaucuguucuugcggccuguauaagcagccuggggucagcgugaaauggaagcgguga

SEQ ID NO: 2329 - RNA, 1476 nt, Artificial Sequence
  derived and/or modified CDS sequence (opt5) from Lassa virus__AIT17368__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauuauggucggcaacgagaccgggcucgagcugacgcuuaccaauacaucuaucaucaaccauaaauucugcaaucugagcgacgcgcacaagaaaaaccucuacgaucaugcucugauguccauuaucucuaccuuucaccugagcauuccgaauuucaaccaguuugaagccauguccugugacuucaauggaggcaagaucagcgugcaguauaaccucucucacuccuacgccggcgaugcugccaaucauugcgggacaguugcuaacggagugcugcaaaccuuuaugcggauggccuggggcgggagcuauauugcgcuugacucuggacacuccaagugggauuguaucaugacgagcuaccaguaccugauuauccagaacacaaccugggacgaucauugccaguucucucgccccuccccuaucggcuaucucgggcugcuuagccaaagaacacgggacauuuacaucucccgcagacugcucggaaccuuuaccuggacacugucugauagcgagggcaaagacacgcccggcggguauugucugacccgguggaugcucauugaagccgagcugaagugcuucggaaauacagcugucgccaaauguaacgagaagcacgaugaagaguuuugcgacaugcuucgccuguucgauuucaauaaacaggcuauccagagacucaaggccgaagcgcagauguccauucaacugaucaacaaggccgugaaugcucuuaucaacgaccagcugauuaugaaaaaucaccuccgggacaucaugggcauuccuuacugcaacuauagcaaguacugguaucugaaucauaccacaaccgggaaaacgucucugcccaaguguuggcucguguccaacggaagcuaccugaaugagacacacuuuucugaugacaucgaacagcaagccgauaacaugauuaccgagaugcuucagaaagaguacauggaacgccagggcaagaccccucuggggcucgucgaccuguucguuuuuagcacauccuucuaucugaucucuaucuuucuucaucucgugaaaauuccgacccacagacauaucgugggaaagagcugccccaagccucaccggcugaauuacaugggcauuuguuccugcggcuucuauaaacagcccggggucccugugaaguggaaacgcuga

SEQ ID NO: 2330 - RNA, 1476 nt, Artificial Sequence
  derived and/or modified CDS sequence (opt5) from Lassa virus__AIT17370__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauuauggucggcaacgagaccgggcucgagcugacgcuuaccaauacaucuaucaucaaccauaaauucugcaaucugagcgacgcgcacaagaaaaaccucuacgaucaugcucugauguccauuaucucuaccuuucaccugagcauuccgaauuucaaccaguaugaagccauguccugugacuuuaauggaggcaagaucagcgugcaguacaaccucucucacuccuaugccggcgaugcugccaaucauugcgggacaguugcuaacggagugcugcaaaccuucaugcggauggccuggggcgggagcuacauugcgcuugacucuggacgcgauagaugggacuguaucaugacguccuaccaguaucugauuauccagaacacaaccugggaggaucacugccaguuuagccggcccucuccuaucggcuaccucgggcugcuuucccaacgcacaagagacauuuauaucagccggcgccugcucggaaccuucaccuggacacuguccgauucugaaggcaaggacacgcccggcggguacugucugaccagauggaugcucauugaggccgagcugaaaugcuuuggaaauacagcugucgccaaguguaacgaaaaacaugaugaggaguucugcgacaugcuucggcuguuugauuucaauaagcaggcuauccagcgccucaaagccgaagcgcagaugagcauucaacugaucaacaaggccgugaaugcucuuaucaacgaccagcugauuaugaagaaucaccucagagacaucaugggcauuccuuauugcaacuacuccaaauauugguaccugaaucacaccacaaccgggaagacgagccugcccaaauguuggcucgugucuaacggauccuaccugaaugaaacacauuucagcgaugacaucgagcagcaagccgauaacaugauuaccgagaugcuucagaaggaauauauggagcggcagggcaaaaccccucuggggcucgucgaccuguuuguuuucucuaccagcuuuuaccugaucuccaucuuccuucaccucgugaagauuccgacacaucgccacaucgugggaaaacccugcccuaagccccauagacugaaucacaugggcauuuguucuugcggccuguauaagcagccuggggucagcgugaaauggaagcgguga

SEQ ID NO: 2331 - RNA, 1476 nt, Artificial Sequence
  derived and/or modified CDS sequence (opt5) from Lassa virus__AIT17378__GPC
augggccagaucgugaccuucuuucaagaggucccccacguuauugaagaggugaugaacaucgugcugauugcccucagcauccuggcuguccuuaaggggcuguacaaucucgccacaugcggacuggugggccuuguuacguuccugcuccugugugggagauccugcaccacaucucuguauaaaggaguguacgaacuccagacccuggagcuuaacauggaaacacugaauaugaccaugccucucagcuguacaaagaacaauucccaucacuauauuauggucggcaacgagaccgggcuggagcuuacgcugaccaauacaucuaucaucaaccauaaauuuugcaaucucagcgacgcgcacaagaaaaaccuguacgaucauacccugauguccauuaucucuacauuccaccucagcauuccgaauuuuaaccaguaugaagcuauguccugugacuucaauggaggcaagaucagcgugcaguacaaccugucucacuccuaugccguugaugccgcuaaucauugcggcaccguggccaacgggguccuucaaacguuuaugcggauggcuuggggaggcagcuacauugcccuggacucugggcgcuccggaugggauuguaucaugacaagcuaccaguaucucgugauucagaacaccacaugggaggaccacugccaguucucuagacccuccccuaucggcuaccuggggcuucugagccaacggacccgcgauaucuauauuuccagacggcuccugggaaccuuuacauggacgcugucugacagcgaaggcaagaauacccccggcggguacugucucacacgcuggaugcugaucgaggcggagcuuaaaugcuucggaaacaccgccguggcuaaguguaaugaaaaacaugaugaggaauuuugcgacaugcugagacucuucgauuuuaacaagcaggccauucagcggcugaaagcugaggcccagauguccauccaacuuauuaauaaggcggucaacgcccugaucaaugaccagcucaucaugaagaaccaucugcgcgauauuaugggcaucccuuauugcaauuacagcaaauauugguaccugaaccacacaaccacggggagaacaucucucccccgguguuggcugguuuccaauggaagcuaccuuaacgaaacccacuucucugacgacauugagcagcaagcugauaauaugaucaccgagaugcugcagaaggaauauauggagcgccagggcaaaacaccucucgggcugguggaccuguucguguuuagcaccuccuucuaccuuauuucuaucuuucuccaccuggucaagaucccgacacauagacacauugugggaaaaagcugccccaagccucaucggcugaaccacaugggcaucuguuccugcggcuucuauaaacagcccgggguuccugugaaguggaagcgcuga

SEQ ID NO: 2332 - RNA, 1476 nt, Artificial Sequence
  derived and/or modified CDS sequence (opt5) from Lassa virus__AIT17388__GPC
augggccagaucgugaccuucuuucaagaggucccccacguuauugaagaggugaugaacaucgugcugauugcccucagcauccuggcuguccuuaaggggcuguacaauguggccacaugcggacucauuggccugguuacguuccuucugcucugugggagauccugcaccacaacccuguauaaaggaguguacgaacugcaggcgcucgagcugaacauggaaacacuuaauaugaccaugccucugucuuguacaaagaacaauagccaucacuauauccgggucggcaacgagaccgggcucgagcugacgcuuaccaauacauccaucauuaaccauaaauuuugcaaucugucugacgcucacaagaaaaaccucuacgaucaugcccugaugagcaucauuuccaccuuccaccugucuaucccgaauuuuaaccaguaugaagccaugagcugugacuucaauggaggcauuaucuccgugcaguacaaccucagccacucuuaugcuggcgaugccgcuaaucauugcgggacaguugccaacggagugcugcaaaccuuuaugcgcauggcguggggcggguccuacauugcccuugacagcggaagaaacggcugggauuguaucaugacgucuuaccaguaucugaucauucagaauacaaccugggacgaucacugccaguucucccggcccagcccuaucggguaccucggacugcuuucucaacgcacaagagacauuuauaucucccggcgccugcucggcaccuuuaccuggacacugagcgauuccgagggcaaggacacgcccgggggauacugucugaccagauggaugcucauugaagcugagcugaagugcuucggcaacacagccgucgcuaaauguaaugagaagcaugaugaagaguuuugcgacaugcuucggcuguucgauuuuaacaaacaggccauccagcgccucaagaccgaagcgcagaugaauauccaacugauuaacaaagccgugaaugcucuuaucaacgaccagcugauuaugaagaaucaccucagagacaucauggggauuccuuauugcaacuacucuaaguauugguaccugaauaacacagccaccggaaaaacgagccugccccgguguuggcucguguccaauggcagcuaccugaacgagacacacuucucugaugacaucgaacagcaagcugauaauaugaucaccgagaugcuucagaaggaguauauggaacgccaggggaaaaccccucugggacucgucgaccuguucguuuuuagcacauccuucuaccugauuucuaucuuucuucaucucgugaagauuccgacccacagacauaucgugggcaaacccugcccuaagccccaccggcugaaccauauuggcaucuguagcugcgggcuguauaaacagccuggaguccccgugaaguggaagcgcuga

SEQ ID NO: 2333 - RNA, 1473 nt, Artificial Sequence
  derived and/or modified CDS sequence (opt5) from Lassa virus__AIT17404__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacgcuuaugccgucgacgcugccaaccauugcggcacaauugcgaauggggugcuccaaaccuucaugcggauggccuggggaggcucuuacaucgcucuggauuccgggaagggaagcugggacuguaucaugacaucuuaccaguaucuuauuauccagaacaccacgugggaagaucacugccaguuuucccgccccagcccuauuggcuaccuggggcuccugucccaaagaacacgggacaucuauauuucucgcagacuucugggaaccuucacauggacccucagcgauuccgagggcaacgaaacccccggcggguacugucugacacgguggaugcugaucgaggccgagcucaaaugcuuuggaaauacggcuguugccaaguguaacgaaaaacaugacgaggaguucugcgauaugcugcgccuuuuugacuucaauaagcaggcgaucagacggcugaaaaccgaagcccagaugagcauucagcucaucaacaaggcugugaaugcccugauuaacgaucaacuuaucaugaagaaucaucugcgcgacauuaugggcaucccuuauugcaacuacucuaaauauugguaccucaaucacacagucaccgggaagacaucccugcccagauguuggcuggugagcaacggaucuuaccucaaugaaacccacuucagcgacgauaucgagcagcaggcugacaacaugauuacggagcugcuucaaaaagaauauauggaucggcagggcaagacaccucuggggcucguggaccuguuugucuucuccaccucuuuuuaccugaucagcauuuuccuucaccucaucaaaauuccgacccaucgccacaucacaggaaagcccugcccuaaaccccauagacugaaucacaugggcauuuguuccugcggccuguauaagcacccugggguucccgugaaguggaaacgguga

SEQ ID NO: 2334 - RNA, 1473 nt, Artificial Sequence
  derived and/or modified CDS sequence (opt5) from Lassa virus__AIT17408__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccguggccaaugggguucuccaaacauucaugcggauggcguggggaggcucuuacauugcccuggauuccgggaagggaagcugggacuguaucaugaccucuuaccaguaucuuaucauucagaacacgacaugggaagaucacugccaguuuucccgccccagcccuaucggcuaccuggggcuccugucccaaagaacccgggacauuuauaucucucgcagacuucugggaacauucaccuggacccucagcgauuccgagggcaacgaaacacccggcggguacugucugacgcgguggaugcugauugaggcugagcucaaaugcuuuggaaauaccgccguggcuaaguguaacgaaaaacaugacgaggaguucugcgauaugcugcgccuuuuugacuucaauaagcaggccaucagacggcugaaaacagaagcgcagaugagcauccagcucauuaacaaggccgucaaugcucugaucaacgaucaacuuauuaugaagaaucaucugcgcgacaucaugggcauuccuuauugcaacuacucuaaauauugguaccucaaucacaccgugacagggaagaccucccugcccagauguuggcuggugagcaacggaucuuaccucaaugaaacgcacuucagcgacgauaucgagcagcaggccgacaacaugaucacagagcugcuucaaaaagaauauauggaucggcagggcaagaccccucuggggcucgucgaccuguuuguuuucuccaccucuuuuuaccugauuagcaucuuccuucaccucgugaaaauuccgacacaucgccacgugaucggaaagcccugcccuaaaccccauagacugaaucacaugggcauuuguuccugcggccuguauaagcacccugggguccccgugaaguggaaacgguga

SEQ ID NO: 2335 - RNA, 1473 nt, Artificial Sequence
  derived and/or modified CDS sequence (opt5) from Lassa virus__AIT17412__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacgcuuaugccgucgacgcugccaaccauugcggcacaauugcgaauggggugcuccaaaccuucaugcggauggccuggggaggcucuuacaucgcucuggauuccgggaagggaagcugggacuguaucaugacaucuuaccaguaucuuauuauccagaacaccuccugggaagaucacugccaguuuagccgccccuccccuauuggcuaccuggggcuccugucucaaagaacgcgggacaucuauauuagccgcagacuucugggaacauucaccuggacacucuccgauagcgagggcaacgaaacccccggcggguacugucugacccgguggaugcugaucgaggccgagcucaaaugcuuuggaaauacagcuguugccaaguguaacgaaaaacaugacgaggaguucugcgauaugcugcgccuuuuugacuucaauaagcaggcgaucagacggcugaaaacggaagcccagaugucuauucagcucaucaacaaggcugugaaugcccugauuaacgaucaacuuaucaugaagaaucaucugcgcgacauuaugggcaucccuuauugcaacuacuccaaauauugguaccucaaucacaccgucacagggaagaccagccugcccagauguuggcuggugucuaacggaagcuaccucaaugaaacacacuucuccgacgauaucgagcagcaggcugacaacaugauuaccgagcugcuucaaaaagaauauaucgaucggcagggcaagacgccucuggggcucguggaccuguuugucuucucuaccagcuuuuaccugauuuccaucuuccuucaccucguuaaaauuccgacacaucgccacgugaucggaaagcccugcccuaaaccccauagacugaaucacaugggcauuuguagcugcggccuguauaagcacccuggggugcccgucaaguggaaacgguga

SEQ ID NO: 2336 - RNA, 1473 nt, Artificial Sequence
  derived and/or modified CDS sequence (opt5) from Lassa virus__AIT17416__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucaccggaagaaucuguacgaccaugcccucaugagcauuaucuccaccuuucaccugagcauuccgaacuucaaucaguaugaggccaugucuugugauuuuaacggaggcaaaaucuccgugcaguacaaucugagccacgcuuaugccgucgacgcugccaaccauugcggcacaauugcgaauggggugcuccaaaccuucaugcgcauggccuggggaggcucuuacaucgcucuggauuccgggaagggaagcugggacuguaucaugacaucuuaccaguaucuuauuauccagaacaccuccugggaagaucacugccaguuuagcagacccuccccuauuggcuaccuggggcuccugucucaacggacgcgcgacaucuauauuagcagacggcuucugggaacauucaccuggacacucuccgauagcgagggcaacgaaacccccggcggguacugucugacccgcuggaugcugaucgaggccgagcucaagugcuuuggaaauacagcuguugccaaauguaacgaaaagcaugacgaggaguucugcgauaugcugagacuuuuugacuucaauaaacaggcgauccggcgccugaagacggaagcccagaugucuauucagcucaucaacaaagcugugaaugcccugauuaacgaucaacuuaucaugaagaaucaccugagagacauuaugggcaucccuuauugcaacuacuccaaguauugguaccucaaucacaccgucacagggaaaaccagccugccccgguguuggcuggugucuaacggaagcuaccucaaugaaacacauuucuccgacgauaucgagcagcaggcugacaacaugauuaccgagcugcuucaaaaggaauauaucgaucgccagggcaaaacgccucuggggcucguggaccuguuugucuucucuaccagcuuuuaccugauuuccaucuuccuucaccucguuaagauuccgacacauagacacgugaucggaaaacccugcccuaagccccaucggcugaaucacaugggcauuuguagcugcggccuguauaaacacccuggggugcccgucaaguggaagcgcuga

SEQ ID NO: 2337 - RNA, 1473 nt, Artificial Sequence
  derived and/or modified CDS sequence (opt5) from Lassa virus__AIT17420__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggaagggaagcugggacuguaucaugaccucuuaccaguaucuuauuauccagaacacgacaugggaagaucacugccaguuuucccgccccagcccuauuggcuaccuggggcuccugucccaaagaacccgggacaucuauauuucucgcagacuucugggaacauucaccuggacccucagcgauuccgagggcaacgaaacacccggcggguacugucugacgcgguggaugcugaucgaggcugagcucaaaugcuuuggaaauaccgccguugcuaaguguaacgaaaaacaugacgaggaguucugcgauaugcugcgccuuuuugacuucaauaagcaggccaucagacggcugaaaacagaagcgcagaugagcauucagcucaucaacaaggccgugaaugcucugauuaacgaucaacuuaucaugaagaaucaucugcgcgacauuaugggcaucccuuauugcaacuacucuaaauauugguaccucaaucacaccgucacagggaagaccucccugcccagauguuggcuggugagcaacggaucuuaccucaaugaaacgcacuucagcgacgauaucgagcagcaggccgacaacaugauuacagagcugcuucaaaaagaauauauggaucggcagggcaagaccccucuggggcucguggaccuguuugucuucuccaccucuuuuuaccugaucagcauuuuccuucaccucaucaaaauuccgacacaucgccacaucaccggaaagcccugcccuaaaccccauagacugaaucacaugggcauuuguuccugcggccuguauaagcacccugggguucccgugaaguggaaacgguga

SEQ ID NO: 2338 - RNA, 1473 nt, Artificial Sequence
  derived and/or modified CDS sequence (opt5) from Lassa virus__AIT17424__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacaugaccaaccugaauaugacaaugccucuuuccuguaccaagaacaauucucaucacuauaucaugguuggcaacgaaacagggcuggagcucacccugacgaauaccagcauuaucaaccauaaauucugcaaucuuuccgaugcgcacaagaaaaaccuguacaaucaugcucucaugucuauuaucagcacauuucaccuguccauuccgaacuucaaucaguaugaggccaugagcugugacuuuaacggaggcaagaucucugugcaguacaaucugucccacgccuaugcugucgaugccgcuaaccauugcggcaccauugccaacggggugcuccaaacauucaugcggauggcguggggaggcagcuacaucgcccuggacucugggaagggauccugggauuguaucaugaccagcuaccaguaucuuauuauccagaauacgacaugggaagaccacugccaguuuucucgccccuccccuauuggcuaccuggggcuccugagccaaagaacccgggauaucuauauuucccgcagacuucugggaacauucaccuggacccucucugacagcgagggcaacgaaacacccggcggguacugucugacgcgguggaugcugaucgaggcugagcucaaaugcuuuggaaauaccgccguugcuaaguguaacgaaaaacaugaugaggaguucugcgacaugcugcgccuuuuugauuucaauaagcaggccaucagacggcugaaaacagaagcgcagaccaacauucagcucaucaauaaggccgugaacgcucugauuaaugaccaacuuaucaugaagaaccaucugcgcgauauuaugggcaucccuuauugcaauuacuccaaauauugguaccucaaccacacagucaccgggaagacgagccugcccagauguuggcuggugucuaauggauccuaccucaacgaaacacacuucagcgacgacaucgagcagcaggccgauaauaugauuaccgagcugcuucaaaaagaauauauggaccggcagggcaagaccccucuggggcucguggaucuguuugucuucucuaccagcuuuuaccugaucuccauuuuccuucaccucguuaaaaucccgacacaucgccacauuaucggaaagcccugcccuaaaccccauagacugaaccacaugggcauuuguucuugcggccuguauaagcacccuggggugcccgugaaguggaaacgguga

SEQ ID NO: 2339 - RNA, 1473 nt, Artificial Sequence
  derived and/or modified CDS sequence (opt5) from Lassa virus__AIT17428__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggaagggaagcugggacuguaucaugaccucuuaccaguaucuuauuauccagaacacgacaugggaagaucacugccaguuuucccgccccagcccuauuggcuaccuggggcuccugucccaaagaacccgggacaucuauauuucucgcagacuucugggaacauucaccuggacccucagcgauuccgagggcaacgaaacacccggcggguacugucugacgcgguggaugcugaucgcugccgaccucaaaugcuuuggaaauaccgcuguugccaaguguaacgagaaacaugaugaggaguucugcgacaugcugcgccuuuuugauuucaauaagcaggcgaucgaaagacugaaaacagaagcccagaugagcauucagcucaucaacaaggcugugaaugcccugauuaacgaccaacuuaucaugaagaaucaucugcgggacauuaugggcaucccuuauugcaacuacucuaaauauugguaccucaaucacaccgucacagggcgcaccucccugcccagauguuggcuggugagcaacggaucuuaccucaaugagacgcacuucagcgaugacaucgaacagcaggcugauaacaugauuacagagcugcuucaaaaggaguauauggaccggcagggcaaaaccccucuggggcucguggaucuguuugucuucuccaccucuuuuuaccugaucagcauuuuccuucaccucguucgcaucccgacacauagacacgugauuggaaagcccugcccuaaaccccaucggcugaaucacaugggcaucuguuccugcggccuguauaagcacccuggggugcccgucaaauggaagcgcuga

SEQ ID NO: 2340 - RNA, 1473 nt, Artificial Sequence
  derived and/or modified CDS sequence (opt5) from Lassa virus__AIT17430__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggccggaucuccgugcaguacaaucugagccacacauaugcugucgacgccgcuaagcauugcggcaccauugccaacggggugcuccaaacauucaugcgcauggcguggggaggcucuuacaucgcccuggauuccgggaagggaagcugggacuguaucaugaccucuuaccaguaucuuauuauccagaauacgacaugggaagaucacugccaguuuuccagacccagcccuauuggcuaccuggggcuccugucccaacggacccgcgacaucuauauuucuagacggcuucugggaacauucaccuggacccucagcgauuccgagggcaacgaaacacccggcggguacugucugacgcgcuggaugcugaucgaggcugagcucaaaugcuuuggaaacaccgccguugcuaaguguaaugaaaaacaugacgaggaguucugcgauaugcugagacuuuuugacuucaacaagcaggccauccggcgccugaaaacagaagcgcagaugagcauucagcucaucaauaaggccgugaacgcucugauuaaugaucaacuuaucaugaagaaccaccugagagacauuaugggcaucccuuauugcaauuacucuaaauauugguaccucaaccacaccgucacagggaagaccucccugccccgguguuggcuggugagcaauggaucuuaccucaacgaaacgcauuucagcgacgauaucgagcagcaggccgacaauaugauuacagagcugcuucaaaaagaauauaucgaucgccagggcaagaccccucuggggcucguggaccuguuugucuucuccaccucuuuuuaccugauuagcaucuuccuucaccucguuaaaauuccgacacauagacacgugaucggaaagcccugcccuaaaccccaucggcugaaccacaugggcauuuguuccugcggccuguauaagcacccuggggugcccgucaaguggaaacgcuga

SEQ ID NO: 2341 - RNA, 1473 nt, Artificial Sequence
  derived and/or modified CDS sequence (opt5) from Lassa virus__AIT17438__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgaaccugaauaugaccaugccucuuuccuguacaaagaacaauucucaucacuauauccggguuggcaacgaaaccgggcuggagcucacacugaccaauacgagcauuaucucccauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcgcauggcguggggaggcucuuacaucgcccuggauuccgggaagggaagcugggacuguaucaugaccucuuaccaguaucuuauuauccagaacacgacaugggaagaucacugccaguuuuccagacccagcccuauuggcuaccuggggcuccugucccaacggacccgcgacaucuauauuucuagacggcuucugggaacauucaccuggacccucagcgauuccgagggcaaagaaacacccggcggguacugucugacgcgcuggaugcugaucgaggcugagcucaagugcuuuggaaacaccgccguugcuaaauguaaugaaaagcaugacgaggaguucugcgauaugcugagacuuuuugacuucaacaaacaggccauccggcgccugaagacagaagcgcagaugaauauucagcucaucaacaaggccgugaaugcucugauuaacgaucaacuuaucaugaaaaaucaccugagagacauuaugggcaucccuuauugcaacuacagcaaguauugguaccucaaucacaccgucacagggaaaaccucucugccccgguguuggcugguguccaacggaagcuaccucaaugaaacgcauuucucugacgauaucgagcagcaggccgacaacaugauuacagagcugcuucaaaaggaauauaucgaucgccagggcaaaaccccucuggggcucguggaccuguuugucuucagcaccuccuuuuaccugauuucuaucuuccuucaccucguuaagauuccgacacauagacacgugaucggaaaacccugcccuaagccccaucggcugaaucagaugggcauuuguagcugcggccuguauaagcagccuggggugcccgucaaauggaagcgcuga

SEQ ID NO: 2342 - RNA, 1473 nt, Artificial Sequence
  derived and/or modified CDS sequence (opt5) from Lassa virus__AIT17442__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucaccggaagaaucuguacgaccaugcccucaugagcauuaucuccaccuuucaccugagcauuccgaacuucaaucaguaugaggccaugucuugugauuuuaacggaggcaaaaucuccgugcaguacaaucugagccacgcuuaugccgucgacgcugccaaccauugcggcacaauugcgaauggggugcuccaaaccuucaugcgcauggccuggggaggcucuuacaucgcucuggauuccgggaagggaagcugggacuguaucaugacaucuuaccaguaucuuauuauccagaacaccuccugggaagaucacugccaguuuagcagacccuccccuauuggcuaccuggggcuccugucucaacggacgcgcgacaucuauauuagcagacggcuucugggaacauucaccuggacacucuccgauagcgagggcaacgaaacccccggcggguacugucugacccgcuggaugcugaucgaggccgagcucaagugcuuuggaaauacagcuguugccaaauguaacgaaaagcaugacgaggaguucugcgauaugcugagacuuuuugacuucaauaaacaggcgauccggcgccugaagacggaagcccagaugucuauucagcucaucaacaaagcugugaaugcccugauuaacgaucaacuuaucaugaagaaucaccugagagacauuaugggcaucccuuauugcaacuacuccaaguauugguaccucaaucacaccgucacagggaaaaccagccugccccgguguuggcuggugucuaacggaagcuaccucaaugaaacacauuucuccgacgauaucgagcagcaggcugacaacaugauuaccgagcugcuucaaaaggaauauaucgaucgccagggcaaaacgccucuggggcucguggaccuguuugucuucucuaccagcuuuuaccugauuuccaucuuccuucaccucguuaagauuccgacacauagacacgugaucggaaaacccugcccuaagccccaucggauuaaucacaugggcaucuguagcugcggccuguauaaacacccuggggugcccgucaaguggaagcgcuga

SEQ ID NO: 2343 - RNA, 1473 nt, Artificial Sequence
  derived and/or modified CDS sequence (opt5) from Lassa virus__AIT17446__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuucucauugcggcaccguggccaacgggguucuccaaacauucaugcggauggcguggggaggcuccuacauugcccuggauagcgggaagggaucuugggacuguaucaugaccuccuaccaguaucuuaucauucagaauacgacaugggaagaucacugccaguuuagccgccccuccccuaucggcuaccuggggcuccugucucaaagaacccgggacauuuauaucagccgcagacuucugggaacauucaccuggacccucuccgauagcgagggcaacgaaacacccggcggguacugucugacgcgguggaugcugauugaggcugagcucaaaugcuuuggaaacaccgccguggcuaaguguaaugaaaaacaugacgaggaguucugcgauaugcugcgccuuuuugacuucaacaagcaggccaucagacggcugaaaacagaagcgcagaugucuauccagcucauuaauaaggccgucaacgcucugaucaaugaucaacuuauuaugaagaaccaucugcgcgacaucaugggcauuccuuauugcaauuacuccaaauauugguaccucaaccacaccgugacagggaagaccagccugcccagauguuggcuggugucuaauggaagcuaccucaacgaaacgcacuucuccgacgauaucgagcagcaggccgacaauaugaucacagagcugcuucaaaaagaauauauggaucggcagggcaagaccccucuggggcucgucgaccuguuuguuuucucuaccagcuuuuaccugauuuccaucuuccuucaccucgugaaaauuccgacacaucgccacgugaucggaaagcccugcccuaaaccccauagacugaaccacaugggcauuuguagcugcggccuguauaagcacccugggguccccgugaaguggaaacgguga

SEQ ID NO: 2344 - RNA, 1473 nt, Artificial Sequence
  derived and/or modified CDS sequence (opt5) from Lassa virus__AIT17450__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggaagggaagcugggacuguaucaugaccucuuaccaguaucuuauuauccagaacacgacaugggaagaucacugccaguuuucccgccccagcccuauuggcuaccuggggcuccugucccaaagaacccgggacaucuauauuucucgcagacuucugggaacauucaccuggacccucagcgauuccgagggcaacgaaacacccggcggguacugucugacgcgguggaugcugaucgaggcugagcucaaaugcuuuggaaauaccgccguugcuaaguguaacgaaaaacaugacgaggaguucugcgauaugcugcgccuuuuugacuucaauaagcaggccaucagacggcugaaaacagaagcgcagaugagcauucagcucaucaacaaggccgugaaugcucugauuaacgaucaacuuaucaugaagaaucaucugcgcgacauuaugggcaucccuuauugcaacuacucuaaauauugguaccucaaucacaccgucacagggaagaccucccugcccagauguuggcuggugagcaacggaucuuaccucaaugaaacgcacuucagcgacgauaucgagcagcaggccgacaacaugauuacagagcugcuucaaaaagaauauaucgaucggcagggcaagaccccucuggggcucguggaccuguuugucuucuccaccucuuuuuaccugauuagcaucuuccuucaccucguuaaaauuccgacacaucgccacaucauuggaaagcccugcccuaaaccccauagacugaaucacaugggcaucuguuccugcggccuguauaagcacccuggggugcccgugaaguggaaacgguga

SEQ ID NO: 2345 - RNA, 1473 nt, Artificial Sequence
  derived and/or modified CDS sequence (opt5) from Lassa virus__AIT17454__GPC
augggccagaucauuaccuucuuucaagaggugccccacgucaucgaagagguuaugaacauugugcugaucgccuucagccuccuggcuauucuuaaggggaucuacaauguggccacaugcggacuguuuggccucgucuccuuccugcuucugugugggagaucuugcagcacgaccuauaaaggaguguacgaacuccagacacuggagcuggacauggcgucccucaacaugaccaugccucugucuuguacaaagaauaacagccaucacuauaucaugguuggcaaugaaaccgggcuugagcugacacucaccaacacguccauuaucaaucauaaauuuugcaaccugucugaugcucacaagcggaaucuuuacgaccaugcccugaugagcauuaucuccaccuuccaccucagcauuccgaacuuuaaucaguaugaggccaugucuugugauuucaacggaggcaaaaucuccgugcaguacaaucugagccacacauaugcugucgacgccgcuggccauugcgggaccauugccaacggagugcugcaaacauuuaugcgcauggcguggggcgggucuuacaucgcccucgauuccggaaagggcagcugggacuguaucaugaccucuuaccaguaucugauuauccagaauacgacaugggaagaucacugccaguucuccagacccagcccuauuggguaccuuggacugcucucccaacggacccgcgacaucuauauuucuagacggcugcuuggcacauuuaccuggacccugagcgauuccgagggcaacgaaacacccgggggauacugucucacgcgcuggaugcugaucgaggcugagcugaagugcuucggcaacaccgccguugcuaaauguaaugaaaagcaugacgaggaauuuugcgauaugcucagacuguucgacuucaacaaacaggccauccggcgccuuaagacagaggcgcagaugagcauucagcugaucaauaaagccgugaacgcucucauuaaugaucaacugaucaugaagaaccaccuuagagacauuauggggaucccuuauugcaauuacucuaaguauugguaccugaaccacaccaucacaggaaaaaccucccucccccgguguuggcuggucagcaauggcucuuaccugaacgaaacgcauuuuagcgacgauauugagcagcaggccgacaauaugaucacagagcuccugcaaaaggaauauauggaucgccaggggaaaaccccucuuggacugguggaccucuucguguuuuccaccucuuucuaccugauuagcaucuuucugcaccuugucaagauuccgacacauagacacaucauuggcaaacccugcccuaagccccaucggcucaaccacaugggcaucuguuccugcgggcuguauaaacacccuggaguucccgugcgcuggaagagauga

SEQ ID NO: 2346 - RNA, 1473 nt, Artificial Sequence
  derived and/or modified CDS sequence (opt5) from Lassa virus__AIT17458__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcuauugacgccgcuaaccauugcggcaccaucgccaaugggguccuccaaacauucaugcggauggcguggggaggcucuuacaucgcccuggauuccgggaagggaagcugggacuguauuaugaccacguaccaguaucuuaucauucagaacacaaccugggaagaucacugccaguuuucucgccccuccccuaucggcuaccuggggcuccugagccaaagaacacgggacauuuauaucucccgcagacuucugggaaccuucaccuggacacucucugauagcgagggcaacgaaacgcccggcggguacugucugacccgguggaugcugaucgaggcugagcucaaaugcuuuggaaauacagccguggcuaaguguaacgaaaaacaugacgaggaguucugcgauaugcugcgccuuuuugacuucaauaagcaggccauuagacggcugaaaaccgaagcgcagauguccauccagcucauuaacaaggccguuaaugcucugaucaacgaucaacuuauuaugaagaaucaucugcgcgacaucaugggcaucccuuauugcaacuacagcaaauauugguaccucaaucacacagugaccgggaagacgucucugcccagauguuggcuggucuccaacggaagcuaccucaaugaaacacacuucucugacgauauugagcagcaggccgacaacaugaucaccgagcugcuucaaaaagaauauauggaucggcagggcaagaccccucuggggcucguggaccuguuuguguucagcacauccuuuuaccugauuucuaucuuccuucaccucgucaaaauuccgacccaucgccacguuaucggaaagcccugcccuaaaccccauagacugaaucacaugggcauuuguagcugcggccuguauaagcacccuggggugcccgugaaguggaaacgguga

SEQ ID NO: 2347 - RNA, 1473 nt, Artificial Sequence
  derived and/or modified CDS sequence (opt5) from Lassa virus__AIT17462__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacgcuuaugccgucgacgcugccaaccauugcggcacaauugcgaauggggugcuccaaaccuucaugcggauggccuggggaggcucuuacaucgcucuggauuccgggaagggaagcugggacuguaucaugacaucuuaccaguaucuuauuauccagaacaccacgugggaagaucacugccaguuuucccgccccagcccuauuggcuaccuggggcuccugucccaaagaacacgggacaucuauauuucucgcagacuucugggaaccuucacauggacccucagcgauuccgagggcaacgaaacccccggcggguacugucugacacgguggaugcugaucgaggccgagcucaaaugcuuuggaaauacggcuguugccaaguguaacgaaaaacaugacgaggaguucugcgauaugcugcgccuuuuugacuucaauaagcaggcgaucagacggcugaaaaccgaagcccagaugagcauucagcucaucaacaaggcugugaaugcccugauuaacgaucaacuuaucaugaagaaucaucugcgcgacauuaugggcaucccuuauugcaacuacucuaaauauugguaccucaaucacacagucaccgggaagacaucccugcccaaauguuggcuggugagcaacggaucuuaccucaaugaaacccacuucagcgacgauaucgagcagcaggcugacaacaugauuacggagcugcuucaaaaggaauauaucgauagacagggcaaaacaccucuggggcucguggaccuguuugucuucuccaccucuuuuuaccugauuagcaucuuccuucaccucguuaagauuccgacccaucggcacgugaucggaaaacccugcccuaagccccaucgccugaaucacaugggcauuuguuccugcggccuguauaagcacccuggggugcccgucaaauggaagagauga

SEQ ID NO: 2348 - RNA, 1473 nt, Artificial Sequence
  derived and/or modified CDS sequence (opt5) from Lassa virus__AIT17466__GPC
augggccagaucauuaccuucuuucaagaggugccccaggucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaccauuauaucaugguuggcaaugaaaccgggcuggagcucacacugaccaaccaguccauuaucaaucacaaauucugcaaccuuucugaugcucauaagaaaaaucuguacgaccacgcccucaugagcauuaucuccacguuucaucugagcauuccgaacuucaaucaauaugaggccaugucuugugauuuuaacggaggcaagaucuccgugcaguacaaucugagccacaccuucgcugucgacgccgcuaaccacugcggcacaauugccaauggggugcuccagaccuuuaugcggauggcguggggaggcucuuauaucgcccuggauuccgggcgcggaagcugggacuguaucaugacaucuuaccaguaccuuauuauccaaaacaccacgugggaagaucauugccaguucuccagacccagcccuauuggcuaucuggggcuccugucccagcggacacgcgacaucuacauuucuagacggcuucugggaaccuuuacauggacccucagcgauuccgagggcaacgaaacccccggcggguauugucugacacgcuggaugcugaucgaggcugagcucaagugcuucggaaauacggccguugcuaaauguaacgaaaagcacgacgaggaauuuugcgauaugcugagacuuuucgacuucaauaaacaggccauccggcgccugaagaccgaggcgcaaaugagcauucagcucaucaacaaagccgugaaugcucugauuaacgaucagcuuaucaugaagaaucaucugagagacauuaugggcaucccuuacugcaacuauucuaaguacugguaucucaaucacacaaucaccgggaaaacaucccugccccgguguuggcuggucagcaacggaucuuaccucaaugaaacccacuuuagcgacgauauugagcaacaggccgacaacaugaucacggagcugcuucagaaggaauacauggaucgccagggcaaaacaccucuggggcucguggaccuguucguguuuuccaccucuuucuaucugauuagcaucuuucuucaucucgucaagauuccgacccacagacauguuaucggaaaacccugcccuaagccccaccggcugaaucauaugggcauuuguuccugcggccuguacaaacacccuggggugcccgugaaguggaagcgcuga

SEQ ID NO: 2349 - RNA, 1473 nt, Artificial Sequence
  derived and/or modified CDS sequence (opt5) from Lassa virus__AIT17470__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucaccggaagaaucuguacgaccaugcccucaugagcauuaucuccaccuuucaccugagcauuccgaacuucaaucaguaugaggccaugucuugugauuuuaacggaggcaaaaucuccgugcaguacaaucugagccacacauaugcugucgacgccgcuaaccauugcggcaccauugccaauggggugcuccaaacauucaugcgcauggcguggggaggcucuuacaucgcccuggauuccgggaagggaagcugggacuguaucaugaccucuuaccaguaucuuauuauccagaacacgacaugggaagaucacugccaguuuuccagacccagcccuauuggcuaccuggggcuccugucccaacggacccgcgacaucuauauuucuagacggcuucugggaacauucaccuggacccucagcgauuccgagggcaacgaaacacccggcggguacugucugacgcgcuggaugcugaucgaggcugagcucaagugcuuuggaaauaccgccguugcuaaauguaacgaaaagcaugacgaggaguucugcgauaugcugagacuuuuugacuucaauaaacaggccauccggcgccugaagacagaagcgcagaugagcauucagcucaucaacaaagccgugaaugcucugauuaacgaucaacuuaucaugaagaaucaccugagagacauuaugggcaucccuuauugcaacuacucuaaguauugguaccucaaucacaccgucacagggaaaaccucccugccccgguguuggcuggugagcaacggaucuuaccucaaugaaacgcauuucagcgacgauaucgagcagcaggccgacaacaugauuacagagcugcuucaaaaggaauauaucgaucgccagggcaaaaccccucuggggcucguggaccuguuugucuucuccaccucuuuuuaccugauuagcaucuuccuucaccucguuaagauuccgacacauagacacgugaucggaaaacccugcccuaagccccaucggcugaaucacaugggcauuuguuccugcggccuguauaaacacccuggggugcccgucaaguggaagcgcuga

SEQ ID NO: 2350 - RNA, 1473 nt, Artificial Sequence
  derived and/or modified CDS sequence (opt5) from Lassa virus__AIT17474__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccauucaguacaaucugagccacacauaugcuguggacgccgcuaaccauugcggcaccaucgccaaugggguccuccaaacauucaugcggauggcguggggaggcucuuacaucgcccuggauuccgggaagggaagcugggacuguauuaugaccucuuaccaguaucuuaucauucagaacacgacaugggaagaucacugccaguuuucccgccccagcccuaucggcuaccuggggcuccugucccaaagaacccgggacauuuauaucucucgcagacuucugggaacauucaccuggacccucagcgauuccgagggcaacgaaacacccggcggguacugucugacgcgguggaugcugaucgaggcugagcucaaaugcuuuggaaauaccgccguggcuaaguguaacgaaaaacaugacgaggaguucugcgauaugcugcgccuuuuugacuucaauaagcaggccauuagacggcugaaaacagaagcgcagaugagcauccagcucauuaacaaggccguuaaugcucugaucaacgaucaacuuauuaugaagaaucaucugcgcgacaucaugggcaucccuuauugcaacuacucuaaauauugguaccucaaucacaccauuacagggaagaccucccugcccagauguuggcuggugagcaacggaucuuaccucaaugaaacgcacuucagcgacgauaucgagcagcaggccgacaacaugauuacagagcugcuucaaaaagaauauaucgaucggcagggcaagaccccucuggggcucgucgaccuguuuguguucuccaccucuuuuuaccugauuagcaucuuccuucaccucgugaaaauuccgacacaucgccacaucaccggaaagcccugcccuaaaccccauagacugaaucacaugggcaucuguuccugcggccuguauaagcacccugggguccccguucgguggaagcgcuga

SEQ ID NO: 2351 - RNA, 1473 nt, Artificial Sequence
  derived and/or modified CDS sequence (opt5) from Lassa virus__AIT17478__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcugaucauugcggcaccauugccaacggggugcuccaaacauucaugcggauggcguggggaggcucuuacaucgcccuggacuccgggaagggaagcugggauuguaucaugaccucuuaccaguaucuuauuauccagaauacgacaugggaagaccacugccaguuuucccgccccagcccuauuggcuaccuggggcuccugucccaaagaacccgggauaucuauauuucucgcagacuucugggaacauucaccuggacccucagcgacuccgagggcaacgaaacacccggcggguacugucugacgcgguggaugcugaucgaggcugagcucaaaugcuuuggaaacaccgccguugcuaaguguaaugaaaaacaugaugaggaguucugcgacaugcugcgccuuuuugauuucaacaagcaggccaucagcagacugaaaacagaagcgcagaugucuauucagcucaucaauaaggccgugaacgcucugauuaaugaccaacuuaucaugaagaaccaucugcgggacauuaugggcaucccuuauugcaauuacuccaaauauugguaccucaaccacaccgucacagggaagaccagccugccccgcuguuggcuggugucuaauggaagcuaccucaacgaaacgcacuucuccgaugacaucgagcagcaggccgauaauaugauuacagagaugcugcaaaaagaauauaucgacagacagggcaagaccccucuugggcugguggaucucuuugucuucucuaccagcuuuuaccugauuuccaucuuccugcaccuuguuaaaauuccgacacaucggcacgugaucggaaagcccugcccuaaaccccaucgccucaaccacaugggcauuuguagcugcggccuguauaagcacccuggggugcccgucaaguggaaaagauga

SEQ ID NO: 2352 - RNA, 1473 nt, Artificial Sequence
  derived and/or modified CDS sequence (opt5) from Lassa virus__AIT17482__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacgcuuaugccgucgacgcugccaaccauugcggcacaauugcgaauggggugcuccaaaccuucaugcggauggccuggggaggcucuuacaucgcucuggauuccgggaagggaagcugggacuguaucaugacaucuuaccaguaucuuauuauccagaacauuaccugggaagaucacugccaguuuucccgccccagcccuaucggcuaccuggggcuccugucccaaagaacgcgggacauuuauaucucucgcagacuucugggaacauucaccuggacacucagcgauuccgagggcaacgaaacccccggcggguacugucugacccgguggaugcugaucgaggccgagcucaaaugcuuuggaaauacagcuguugccaaguguaacgaaaaacaugacgaggaguucugcgauaugcugcgccuuuuugacuucaauaagcaggcgauuagacggcugaaaacggaagcccagaugagcauccagcucauuaacaaggcugugaaugcccugaucaacgaucaacuuauuaugaagaaucaucugcgcgacaucaugggcaucccuuauugcaacuacucuaaauauugguaccucaaucacaccgucacagggaagaccucccugcccagauguuggcuggugagcaacggaucuuaccucaaugaaacacacuucagcgacgauauugagcagcaggcugacaacaugaucaccgagcugcuucaaaaagaauauauugaucggcagggcaagacgccucuggggcucguggaccuguuugucuucuccacaucuuuuuaccugaucagcauuuuccuucaccucguuaaaaucccgacccaucgccacguggugggaaagcccugcccuaaaccccauagacugaaucacaugggcauuuguuccugcggccuguauaagcacccugggguccccgugaaguggaaacgguga

SEQ ID NO: 2353 - RNA, 1473 nt, Artificial Sequence
  derived and/or modified CDS sequence (opt5) from Lassa virus__AIT17486__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggaagggaagcugggacuguaucaugaccucuuaccaguaucuuauuauccagaacacgacaugggaagaucacugccaguuuucccgccccagcccuguuggcuaccuggggcuccugucccaaagaacccgggacauuuauaucucucgcagacuucugggaacauucaccuggacccucagcgauuccgagggcaacgaaacacccggcggguacugucugacgcgguggaugcugauugaggcugagcucaaaugcuuuggaaauaccgccguggcuaaguguaacgaaaaacaugacgaggaguucugcgauaugcugcgccuuuuugacuucaauaagcaggccaucagacggcugaaaacagaagcgcagaugagcauccagcucauuaacaaggccgucaaugcucugaucaacgaucaacuuauuaugaagaaucaucugcgcgacaucaugggcauuccuuauugcaacuacucuaaauauugguaccucaaucacaccgugacagggaagaccucccugcccagauguuggcuggugagcaacggaucuuaccucaaugaaacgcacuucagcgacgauaucgagcagcaggccgacaacaugaucacagagcugcuucaaaaagaauauauugaucggcagggcaagaccccucuggggcucgucgaccuguuuguuuucuccaccucuuuuuaccugaucagcauuuuccuucaccucgugaaaaucccgacacaucgccacgugauuggaaagcccugcccuaaaccccauagacugaaucacaugggcaucuguuccugcggccuguauaagcacccugggguccccgugaaguggaaacgguga

SEQ ID NO: 2354 - RNA, 1473 nt, Artificial Sequence
  derived and/or modified CDS sequence (opt5) from Lassa virus__AIT17490__GPC
augggccagaucauuaccuucuuucaagaggugccccacgucaucgaagagguuaugaacauugugcugaucacacucagccugcuugccauucugaaggggaucuacaauguggcuacgugcggacucuucggccuggucuccuuucuucugcucugugggagaucuugcagcaccacauauaaaggaguguacgaacugcagacccuggagcucgacauggccaaccugaauaugacaaugccucuuuccuguaccaagaacaauucucaucacuauaucaugguuggcaacgaaacagggcuggagcucacccugacgaauaccagcauuaucaaccauaaauucugcaaucuuuccgaugcgcacaagaaaaaccuguacgaccaugcucucaugucuauuaucagcacauuucaccuguccauuccgaauuucaaccaguaugaggccaugagcugugauuuuaauggaggcaagaucucugugcaguacaaccugucccacaccuucgccgucgacgcugccaaucauugcggcacaauugcuaacggggugcuccaaaccuuuaugcggauggccuggggaggcagcuauaucgcgcuggauucugggaagggauccugggacuguaucaugacgagcuaccaguaccuuauuauccagaacacaaccugggaagaucacugccaguucucucgccccuccccuauuggcuaucuggggcuccugagccaaagaacacgggacaucuacauuucccgcagacuucugggaaccuuuaccuggacacucucugauagcgagggcaaugaaacgcccggcggguauugucugacccgguggaugcugaucgaggccgagcucaaaugcuucggaaacacagcuguugccaaguguaaugaaaaacaugacgaggaauuuugcgauaugcugcgccuuuucgacuucaacaagcaggcuaucagacggcugaaaaccgaggcccagauguccauucagcucaucaauaaggcggugaacgcccugauuaaugaucaacuuaucaugaagaaccaucugcgcgacauuaugggcaucccuuacugcaauuauagcaaauacugguaucucaaccacacagucaccgggaagacgucucugcccagauguuggcugguguccaauggaagcuaccucaacgaaacacacuuuucugacgauaucgagcagcaggcugacaauaugauuaccgagcugcuucaaaaagaauacauggaucggcagggcaagaccccucuggggcucguggaccuguucgucuuuagcacauccuucuaucugaucucuauuuuucuucaccucguuaaaaucccgacccaucgccacauuaucggaaagcccugcccuaaaccccauagacugaaccacaugggcauuuguagcugcggccuguacaagcacccuggggugcccgugaaguggaaacgguga

SEQ ID NO: 2355 - RNA, 1473 nt, Artificial Sequence
  derived and/or modified CDS sequence (opt5) from Lassa virus__AIT17494__GPC
augggccagaucauuaccuucuuucaagaggugccccacgucaucgaagagguuaugaacauugugcugaucgcccucagccugcuugcuauucugaaggggguguacaaugucgccacaugcggacucuucggccugguguccuuucuucugcucugugggagaucuugcagcacgaucuauaaaggaguuuacgaacugcagacccuggagcucgacauggcgucccugaacaugacaaugccucuuucuuguaccaagaauaacagccaucacuauaucauggugggcaaugaaacagggcuggagcucacccugacaaacaccuccauuaucaaucauaaauucugcaaccuuucugaugcucacaagaaaaaucuguacgaccaugcccucaugagcauuaucuccacguuucaccugagcauuccgaacuucaaucaguaugaggccaugucuugugauuuuaacggaggcaagaucuccguccaguacaaucugagccacaccuaugcuguggacgccgcuaaccauugcggcacaauugccaaugggguucuccaaaccuucaugcggauggcguggggaggcucuuacaucgcccuggauuccgggaagggaagcugggacuguaucaugacaucuuaccaguaucuuauuauccagaacaccuccugggaagaucacugccaguuuagccgccccuccccuauuggcuaccuggggcuccugucucaaagaacgcgggacaucuauauuagccgcagacuucugggaacauucaccuggacacucuccgauagcgagggcaacgaaacccccggcggguacugucugacccgguggaugcugaucgaggcugagcucaaaugcuuuggaaauacagccguggcuaaguguaacgaaaaacaugacgaggaguucugcgauaugcugcgccuuuuugacuucaauaagcaggccaucagacggcugaaaacggaagcgcagaugucuauucagcucaucaacaaggccgucaaugcucugauuaacgaucaacuuaucaugaagaaucaucugcgcgacauuaugggcaucccuuauugcaacuacuccaaauauugguaccucaaucacaccgugacagggaagaccagccugcccagauguuggcuggugucuaacggaagcuaccucaaugaaacacacuucuccgacgauaucgagcagcaggccgacaacaugauuaccgagcugcuucaaaaagaauauaucgaucggcagggcaagacgccucuggggcucgucgaccuguuuguuuucucuaccagcuuuuaccugauuuccaucuuccuucaccucgugaaaauuccgacacaucgccacgugaucggaaagcccugcccuaaaccccauagacugaaucacaugggcauuuguagcugcggccuguauaagcacccugggguccccgugaaguggaaacgguga

SEQ ID NO: 2356 - RNA, 1473 nt, Artificial Sequence
  derived and/or modified CDS sequence (opt5) from Lassa virus__AIT17498__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggaagggaaacugggacuguaucaugaccagcuaccaguaucuuauuauccagaacacgacaugggaagaucacugccaguuuucucgccccuccccuauuggcuaccuggggcuccugagccaaagaacccgggacaucuauauuucccgcagacuucugggaacauucaccuggacccucucugauagcgagggcaaugaaacacccggcggguacugucugacgcgguggaugcugaucgagaccgagcucaaaugcuuuggaaacacagcuguugccaaguguaaugaaaaacaugacgaggaguucugcgauaugcugcgccuuuuugacuucaacaagcaggcuaucuccagacugcggagcgaagcccagaugucuauucagcucaucaauaaagcggugaacgcccugauuaaugaucaacuuaucaugaagaaccaucugcgcgacauuaugggcaucccuuauugcaauuacuccaaguauugguaccucaaccacaccgucacagggaaaaccagccugcccaaguguuggcuggugucuaauggaagcuaccucaacgaaacgcacuucuccgacgauaucgagcagcaggcugacaauaugauuacagagaugcugcaaaaagaauauaucgauagacagggcaagaccccucuugggcugguggaccucuuugucuucucuaccagcuuuuaccugauuuccaucuuccugcaccuuguuaaaauuccgacacaucggcacaucaccggaaagcccugcccuaaaccccaucgccucaaccacaugggcauuuguagcugcggccuguauaagcacccuggggugcccgugaaguggaaaagauga

SEQ ID NO: 2357 - RNA, 1473 nt, Artificial Sequence
  derived and/or modified CDS sequence (opt5) from Lassa virus__AIT17502__GPC
augggccagaucauuaccuucuuucaagagaucccccacgugauugaagaggucaugaacaucguucugauuacacucagccugcuugccauccugaaggggaucuacaauguggcuacgugcggacucuucggccugguguccuuucuucugcucugugggaaaucuugcagcaccacauauaagggagucuacgaacugcagacccuggagcucgacauggccucccugaacaugacaaugccucuuucuuguaccaaaaauaacagccaucacuauauuauggugggcaaugaaacagggcuggagcucacccugacgaacaccuccaucauuaaucauaaguucugcaaccuuucugaugcgcaccggaaaaaucuguacgaccauacacucaugagcaucauuuccaccuuucaccugagcaucccgaacuucaaucaguaugaggcuaugucuugugauuuuaacggaggcaagauuuccguucaguacaaucugagccacgccuaugccaucgacgcugccacacauugcggcaccaucgcuaacggggugcuccaaacguucaugagaauggccuggggaggcucuuacauugcgcuggauuccgggaagggaggcugggacuguaucaugacaagcuaccaguaucuuauuauccagaauaccacaugggaagaucacugccaguuuucucgccccuccccuauuggguaccugggacuccugagccaaagaacccgggacaucuauaucucccgcagacuucugggcaccuucacauggacgcucucugauagcgagggcaacgaaacccccgggggauacugucugacacgguggaugcugauugaggccgagcucaaaugcuuuggcaacaccgcugucgccaaguguaaugaaaaacaugacgaggaguucugcgauaugcugcgccuuuuugacuucaacaagcaggcuaucagacggcugaaaacagaagcccagauguccauucagcucaucaauaaggcggugaacgcccugauuaaugaucaacuuaucaugcgcaaccaccugagagacaucauggggauuccuuauugcaauuacagcaaguauugguaccucaaccacaccguuacgggaaaaacaucucugcccaaguguuggcugguguccaauggcagcuaccucaacgaaacccauuucucugacgauaucgagcagcaggcugacaauaugauuaccgagcugcuucaaaaagaauauauggaucggcaggggaagacaccucugggacucgucgaccuguuuguguucagcaccuccuuuuaccugaucucuauuuuccuucaccucgugaaaaucccgacacaucgccacgucauuggcaagcccugcccuaaaccccauagacugaaccacaugggcguuuguagcugcgggcuguauaagcacccuggagugcccgugaaguggaaacgguga

SEQ ID NO: 2358 - RNA, 1473 nt, Artificial Sequence
  derived and/or modified CDS sequence (opt5) from Lassa virus__AIT17506__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacgcuuaugccgucgacgcugccgaacauugcggcacaauugcgaacggggugcuccaaaccuucaugcggauggccuggggaggcucuuacaucgcucuggauuccgggaagggaagcugggacuguguuaugacaucuuaccaguaucuuaucauucagaauaccacgugggaggaucacugccaguuuucccgccccagcccuaucggcuaccuggggcuccugucccaaagaacacgggacauuuauaucucucgcagacuucugggaaccuucacauggacccucagcgauuccgaaggcaacgagacccccggcggguacugucugacacgguggaugcugauugaggccgaacucaaaugcuuuggaaacacggcuguggccaaguguaaugagaaacaugacgaagaguucugcgauaugcugcgccuuuuugacuucaacaagcaggcgaucgaaagacugaaaaccgaggcccagaugagcauccagcucauuaauaaggcugucaacgcccugaucaaugaucaacuuauuaugaagaaccaucugcgggacaucaugggcauuccuuauugcaauuacucuaaauauugguaccucaaccacacagugaccgggaagacaucccugccccgcuguuggcuggugagcaauggaucuuaccucaacgagacccacuucagcgacgauaucgaacagcaggcugacaauaugaucacggagaugcugcaaaaagaauauauugauagacagggcaagacaccucuugggcuggucgaccucuuuguuuucuccaccucuuuuuaccugaucagcauuuuccugcaccuugugaaaaucccgacccaucggcacgugauuggaaagcccugcccuaaaccccaucgccucaaccacaugggcaucuguuccugcggccuguauaagcacccugggguccccgugaaguggaaaagauga

SEQ ID NO: 2359 - RNA, 1473 nt, Artificial Sequence
  derived and/or modified CDS sequence (opt5) from Lassa virus__AIT17510__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggaagggaagcugggacuguaucaugaccucuuaccaguaucuuauuauccagaacacgacaugggaagaucacugccaguuuucccgccccagcccuauuggcuaccuggggcuccugucccaaagaaccaaagacaucuauauuucucggcgccuucugggaacauucaccuggacccucagcgauuccgagggcaacgaaacacccggcggguacugucugacgagauggaugcugaucgaggcugagcucaagugcuuuggaaauaccgccguugcuaaauguaacgaaaagcaugacgaggaguucugcgauaugcugcggcuuuuugacuucaauaaacaggccauccgcagacugaagacagaagcgcagaugagcauucagcucaucaacaaggccgugaaugcucugauuaacgaucaacuuaucaugaaaaaucaucugcgggacauuaugggcaucccuuauugcaacuacucuaaguauugguaccucaaucacaccgucacagggaaaaccucccugccccgcuguuggcuggugagcaacggaucuuaccucaaugaaacgcacuucagcgacgauaucgagcagcaggccgacaacaugauuacagagcugcuucaaaaggaauauaucgauagacagggcaaaaccccucuggggcucguggaccuguuugucuucuccaccucuuuuuaccugauuagcaucuuccuucaccucguuaagauuccgacacaucggcacgugaucggaaaacccugcccuaagccccaucgccugaaucacaugggcauuuguuccugcggccuguauaagcacccuggggugcccgucaaauggaagagauga

SEQ ID NO: 2360 - RNA, 1473 nt, Artificial Sequence
  derived and/or modified CDS sequence (opt5) from Lassa virus__AIT17514__GPC
augggccagaucauuaccuucuuucaagaggugccccacgucaucgaagagguuaugaacauugugcugaucgcccucagccugcuugcugugcugaaggggauuuacaaugucgccacaugcggacucuucggccugguguccuuucuucugcucugugggagaucuugcagcacgaccuauaaaggaguuuacgaacugcagacacuggagcucgacauggcgucccugaacaugaccaugccucuuucuuguacaaagaauaacagccaucacuauaucauggugggcaaugaaaccgggcuggagcucacacugaccaacacguccaucauuaaucauaaauucugcaaccuuucugaugcucacaagaaaaaucuguacgaccaugcccucaugagcaucauuuccaccuuucaccugagcaucccgaacuucaaucaguaugaggccaugucuugugauuuuaacggaggcaagauuuccguccaguacaaucugagccacacauaugcuguggacgccgcuaaccauugcggcaccaucgccaaugggguucuccaaacauucaugcggauggcguggggaggcucuuacauugcccuggauuccgggaagggaagcugggacuguaucaugaccucuuaccaguaucuuaucauucagaacacgacaugggaagaucacugccaguuuucccgccccagcccuaucggcuaccuggggcuccugucccaaagaacccgggacauuuauaucucucgcagacuucugggaacauucaccuggacccucagcgauuccgagggcaacgaaacacccggcggguacugucugacgcgguggaugcugauugaggcugagcucaaaugcuuuggaaauaccgccguggcuaaguguaacgaaaaacaugacgaggaguucugcgauaugcugcgccuuuuugacuucaauaagcaggccaucagacggcugaaaacagaagcgcagaugagcauccagcucauuaacaaggccgucaaugcucugaucaacgaucaacuuauuaugaagaaucaucugcgcgacaucaugggcauuccuuauugcaacuacucuaaauauugguaccucaaucacaccgugacagggaagaccucccugcccagauguuggcuggugagcaacggaucuuaccucaaugaaacgcacuucagcgacgauaucgagcagcaggccgacaacaugaucacagagcugcuucaaaaagaauauauugaucggcagggcaagaccccucuggggcucgucgaccuguuuguuuucuccaccucuuuuuaccugaucagcauuuuccuucaccucgugaaaaucccgacacaucgccacgugauuggaaagcccugcccuaaaccccauagacugaaucacaugggcaucuguuccugcggccuguaucggcacccugggguccccgugaaguggaagcgcuga

SEQ ID NO: 2361 - RNA, 1473 nt, Artificial Sequence
  derived and/or modified CDS sequence (opt5) from Lassa virus__AIT17518__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacgcuuaugccgucgacgcugccaaccauugcggcacaauugcgaauggggugcuccaaaccuucaugcggauggccuggggaggcucuuacaucgcucuggauuccgggaagggaagcugggacuguaucaugacaucuuaccaguaucuuauuauccagaacaccacgugggaagaucacugccaguuuucccgccccagcccuauuggcuaccuggggcuccugucccaaagaacacgggacaucuauauuucucgcagacuucugggaaccuucacauggacccucagcgauuccgagggcaacgaaacccccggcggguacugucugacacgguggaugcugaucgaggccgagcucaaaugcuuuggaaauacggcuguugccaaguguaacgaaaaacaugacgaggaguucugcgauaugcugcgccuuuuugacuucaauaagcaggcgaucagacggcugaaaaccgaagcccagaugagcauucagcucaucaacaaggcugugaaugcccugauuaacgaucaacuuaucaugaagaaucaucugcgcgacauuaugggcaucccuuauugcaacuacucuaaauauugguaccucaaucacacagucaccgggaagacaucccugcccagauguuggcuggugagcaacggaucuuaccucaaugaaacccacuucagcgacgauaucgagcagcaggcugacaacaugauuacggagcugcuucaaaaagaauauauggaucggcagggcaagacaccucuggggcucguggaccuguuugucuucuccaccucuuuuuaccugaucagcauuuuccuucaccucguuaaaaucccgacccaucgccacgugauuggaaagcccugcccuaaaccccauagacugaaucacaugggcaucuguuccugcggccuguauaagcacccuggggugcccgucaaguggaaacgguga

SEQ ID NO: 2362 - RNA, 1473 nt, Artificial Sequence
  derived and/or modified CDS sequence (opt5) from Lassa virus__AIT17524__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcuauugacgccgcuaaccauugcggcaccaucgccaaugggguccuccaaacauucaugcggauggcguggggaggcucuuacaucgcccuggauuccgggaagggaagcugggacuguauuaugaccucuuaccaguaucuuaucauucagaacacgacaugggaagaucacugccaguuuucccgccccagcccuaucggcuaccuggggcuccugucccaaagaacccgggacauuuauaucucucgcagacuucugggaacauucaccuggacccucagcgauuccgagggcaacgaaacacccggcggguacugucugacgcgguggaugcugaucgaggcugagcucaaaugcuuuggaaauaccgccguggcuaaguguaacgaaaaacaugacgaggaguucugcgauaugcugcgccuuuuugacuucaauaagcaggccauuagacggcugaaaacagaagcgcagaugagcauccagcucauuaacaaggccguuaaugcucugaucaacgaucaacuuauuaugaagaaucaucugcgcgacaucaugggcaucccuuauugcaacuacucuaaauauugguaccucaaucacaccgugacagggaagaccucccugcccagauguuggcuggucagcaacggaucuuaccucaaugaaacgcacuucagcgacgauauugagcagcaggccgacaacaugaucacagagaugcugcaaaaagaauauauggaucggcagggcaagaccccucuugggcugguggaccucuuuguguucuccaccucuuuuuaccugauuagcaucuuccugcaccuugucaaaauuccgacacaucgccacguuaucggaaagcccugcccuaaaccccauagacucaaucacaugggcauuuguuccugcggccuguauaagcacccuggggugcccgugaaguggaaacgguga

SEQ ID NO: 2363 - RNA, 1473 nt, Artificial Sequence
  derived and/or modified CDS sequence (opt5) from Lassa virus__AIT17528__GPC
augggacagaucauuaccuucuuucaagaggugccccacgucaucgaagagguuaugaacauugugcugaucgcccucagccugcuugcuaugcugaaggggauuuacaauaucgccacaugcggacucuucggccugaucuccuuucuucugcucugugggagaucuugcagcacgaccuauaaaggaguguacgaacugcaggcgcuggagcucgacauggcuaaccugaauaugacaaugccucuuuccuguaccaagaacaauucucaucacuauauuauggucggcaacgaaacagggcuggagcucacccugacaaauaccagcaucauuaaccauaaauucugcaaucuuuccgaugcccacaagaaaaaccuguacgaccaugcccucaugucuaucauuagcacguuucaccuguccaucccgaauuucaaccaguaugaggcuaugagcugugauuuuaauggaggcaagauuucugugcaguacaaccugucccacaccuaugccggcgacgcugccaagcauugcgggacaaucgcgaauggaguucuccaaaccuucaugcggauggccuggggcgggagcuacaucgcucuggauucuggaaaaggcaacugggacuguauuaugacauccuaccaguaucuuaucauucagaacaccacgugggaagaucacugccaguuuagccgccccucuccuaucggguaccugggacuccugucccaaagaacacgggacauuuauaucagccgcagacuucugggcaccuucacauggacccucuccgauucugagggcaaugaaacccccgggggauacugucugacacgguggaugcugaucgaggccgagcucaagugcuuuggcaacacggcuguggccaaauguaaugaaaagcaugacgaggaguucugcgauaugcugcgccuuuuugacuucaacaaacaggcgauuagacggcugaagaccgaagcccagaugagcauccagcucauuaauaaggcugucaacgcccugaucaaugaucaacuuauuaugaaaaaccaucugcgcgacaucauggggaucccuuauugcaauuacuccaaguauugguaccucaaccacagcgugacaggaagaaccucucugccccgguguuggcugguuuccaauggcagcuaccucaacgaaacacaguucucugacgauauugagcagcaagcugacaauaugaucaccgagaugcugcagaaagaauauauugaucgccaggggaagacgccucuuggacugguggaccucuuugucuucagcacauccuuuuaccugaucucuauuuuccugcaccuuaucaaaauuccgacccacagacauaucgugggcaagcccugcccuaaaccccaccggcucaaccauaugggcaucuguagcugcgggcuguauaagcacccuggcauucccgugaaguggaaacgcuga

SEQ ID NO: 2364 - RNA, 1473 nt, Artificial Sequence
  derived and/or modified CDS sequence (opt5) from Lassa virus__AIT17538__GPC
augggccagaucauuaccuucuuucaagaggugccccacgucaucgaagagguuaugaacauugugcugaucgcccucagccugcuugcuauucugaaggggaucuacaauaucgccacaugcggacucuucggccugauuuccuuucuucugcucugugggagaucuugcagcacgaccuauaaaggaguguacgaacugcagacacuggagcucgacauggcgaaccugaauaugaccaugccucuuuccuguacaaagaacaauucucaucacuauaucauggucggcaacgaaaccgggcuggagcucacacugaccaauacgagcauuaucaaccauaaauucugcaaucuuuccgaugcucacaagaaaaaccuguacgaccaugcccucaugucuauuaucagcaccuuucaccuguccauuccgaauuucaaccaguaugaggccaugagcugugauuuuaaugaaggaaagaucucugugcaguacaaccugucccacagcuaugcuaucgacgccgcuggccauugcggcacaauugccaaugggguucuccaaaccuucaugcggauggcguggggaggcucuuacaucgcccuggauuccgggaagggaaacugggacuguauuaugacaagcuaccaguaucuuaucauucagaacaccacgugggaggaucacugccaguuuucucgccccuccccuaucggcuaccuggggcuccugagccaaagaacacgggacaucuauauuucccgcagacuucugggaaccuucacauggacccucucugauagcgaaggcaaugaggcucccggcggguacugucugacccgguggaugcugaucgaggccgaacucaaaugcuuuggaaacacagcuauugccaaguguaaugagaaacaugacgaagaguucugcgauaugcugcgccuuuuugacuucaacaagcaggcgaucaaaagacugaaggccgaagcucagauguccauucaccucaucaauaaggccgugaacgcucugaucaaugaucagcuuauuaugaaaaaccaucugcgggacaucaugggcauuccuuauugcaauuacagcaaguauugguaccucaaccacacggucaccgggaaaacaucucugcccaaguguuggcugguguccaauggaagcuaccucaacgagacccacuucucugacgauaucgagcaacaggccgacaauaugauuacagaacugcuucagaaagaguauauggaucgccaaggcaagaccccucuggggcucguugaccuguuuguguucagcacguccuuuuaccugaucucuauuuuccuucaucucgucaaaaucccgacacacagacauaucgugggacggcccugcccuaagccccaccgccugaaccacaugggcauuuguagcugcggccuguauaagcauccuggggugcccgucaaauggaagagauga

SEQ ID NO: 2365 - RNA, 1473 nt, Artificial Sequence
  derived and/or modified CDS sequence (opt5) from Lassa virus__AIT17540__GPC
augggccagaucgugaccuucuuucaagaggucccccacguuauugaagagaucaugaacauugugcugaucacacucagccugcuugccauucugaaggggaucuacaauuucgcuacgugcggacucaucggccugauuaccuuucuuuuccugugugggagauccugcucuacaaucuauaaaggaagcuaccagcuccagacccuggaacugaacauggagacacucaauaugaccaugccucuguccuguacaaagaacaauucucaucacuauauucgggugggcaacgaaaccgggcuugagcugacgcucaccaauacaagcaucauuaaccauaaauuuugcaaucuguccgaggcccacaagaaaaaccuuuacgaccaugcgcugaugucuaucauuagcaccuuccaccucuccaucccgaauuuuaaccaguaugaagcuaugagcugugauuucaauggaggcaagaucucuguccaauacaaccugucccacagcuaugccguggacgccgcuaaucauugcggcacaguugccaacggggugcugcagaccuuuaugcgcauggcuuggggaggcucuuacauugcccucgauuccgggagaggaaacugggacuguaucaugacgagcuaccaguaucugauuauccagaauacaaccugggaggaucacugccaauucucucggcccuccccuauuggcuaccuugggcugcucagccagcgcacaagagacaucuauaucucccggcgccugcuuggaaccuuuaccuggacacugucugauagcgaaggcaaggagacgcccggcggguacugucucaccagauggaugcugauugaggcggaacugaaaugcuucggaaacacagccgucgcuaaguguaaugagaaacaugacgaagaguuuugcgauaugcuccggcuguucgacuucaacaagcaggccauccagcgccuuaaaaccgaagcucaaauguccauucagcugaucaauaaggccgugaacgcgcucauuaaugaucagcugaucaugaagaaccaccuuagagacaucaugggcauuccuuauugcaauuacagcaaauauugguaccugaaccacacaucuaccgggcggacgucccuccccaaguguuggcugguuagcaauggaucuuaccugaacgagacacauuuuagcgaugacaucgagcaacaggccgacaauaugauuaccgaaaugcuccagaaagaguauaucgaucgccagggcaagaccccucuggggcuuguggaccuguucgucuuuuccacaucuuucuaccucauuagcaucuuucugcaccuggugaaaauuccgacccauagacacaucgugggaaaguccugccccaaaccucaucggcuuaaccacaugggcaucuguagcugcggccucuauaagcaacccggggucccuguuaaguggaaacgcuga

SEQ ID NO: 2366 - RNA, 1473 nt, Artificial Sequence
  derived and/or modified CDS sequence (opt5) from Lassa virus__AIT17544__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacaugggcucccugaacaugaccaugccucuuucuuguacaaagaauaacagccaucacuauaucaugguugggaaugaaaccggacuggagcucacacugaccaacacguccauuaucaaucauaaauucugcaaccuuucugaugcgcacaagaaaaaucuguacgaccaugcucucaugagcauuaucuccaccuuucaccugagcauuccgaacuucaaucaguaugaggccaugucuugugauuuuaacggcggcaagaucuccgugcaguacaaucugagccacucuuaugccgucgacgcugccaaccauugcgggacaauugcuaauggagugcuccaaaccuucaugcggauggccuggggcggguccuacaucgcgcuggauagcggaaagggcucuugggacuguaucaugacauccuaccaguaucuuauuauccagaacaccacgugggaagaucacugccaguuuagccgccccuccccuauuggguaccugggacuccugucucaaagaacacgggacaucuauauuagccgcagacuucugggcaccuucacauggacccucuccgauagcgagggcaacgaaacccccgggggauacugucugacacgguggaugcugaucgaggccgagcucaaaugcuuuggcaauacggcuguugccaaguguaacgaaaaacaugacgaggaguucugcgauaugcugcgccuuuuugacuucaauaagcaggcuaucagacggcugaaaaccgaagcccagaugucuauucagcucaucaacaaggcggugaaugcccugauuaacgaucaacuuaucaugaagaaucaucugcgcgacauuauggggaucccuuauugcaacuacuccaaauauugguaccucaaucacacagucaccggaaagacaagccugcccagauguuggcuggugucuaacggcagcuaccucaaugaaacccacuucuccgacgauaucgagcagcaggcugacaacaugauuacggagcugcuucaaaaagaauauauggaucggcaggggaagacaccucugggacucguggaccuguuugucuucucuaccagcuuuuaccugaucuccauuuuccuucaccucguuaaaaucccgacccaucgccacauuaucggcaagcccugcccuaaaccccauagacugaaucacaugggcauuuguagcugcgggcuguauaagcacccuggagugcccgugaaguggaaacgguga

SEQ ID NO: 2367 - RNA, 1473 nt, Artificial Sequence
  derived and/or modified CDS sequence (opt5) from Lassa virus__AIT17548__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuuuuccugugugggagaucuugcagcacgaccuauaaaggaguguacgaacuccagacacuggagcuggacauggcgucccucaacaugaccaugccucugucuuguacaaagaauaacagccaucacuauaucaugguuggcaaugaaaccgggcuugagcugacacucaccaacacguccauuaucaaucauaaauuuugcaaccugucugaugcucacaagcggaaucuuuacgaccaugcccugaugagcauuaucuccaccuuccaccucagcauuccgaacuuuaaucaguaugaggccaugucuugugauuucaacggaggcaaaaucuccgugcaguacaaucugagccacgcuuaugccggcgacgcugccaagcauugcgggacaauugcgaacggaguccugcaaaccuuuaugcgcauggccuggggcgggucuuacaucgcucucgauuccggaaagggcagcugggacuguaucaugacaucuuaccaguaucugauuauccagaauaccacgugggaagaucacugccaguucuccagacccagcccuauuggguaccuuggacugcucucccaacggacacgcgacaucuauauuucuagacggcugcuuggcaccuuuacauggacccugagcgauuccgagggcaacgaaacccccgggggauacugucucacacgcuggaugcugaucgaggccgagcugaaaugcuucggcaacacggcuguggccaaguguaaugaaaaacaugacgaggaauuuugcgauaugcucagacuguucgacuucaacaagcaggcgauccggcgccuuagaaccgaggcccagaugagcauucagcugaucaauaaagcuguuaacgcccucauuaaugaucaacugaucaugaagaaccaccuucgggacauuauggggaucccuuauugcaauuacucuaaguauugguaccugaaccacacagugaccggaaaaacaucccuccccaaguguuggcuggucagcaauggcucuuaccugaacgaaacccauuuuagcgacgauaucgagcagcaggcugacaauaugauuacggagaugcuccaaaaagaauauaucgaucgccaggggaagacaccucugggacuuguggaccuguucguguuuuccaccucuuucuaccucauuagcaucuuucugcaccuggucaaaauuccgacccauagacacguuaucggcaagcccugcccuaaaccccaucggcuuaaccacaugggcauuuguuccugcgggcucuauaagcacccuggagugcccgugaaguggaaacgcuga

SEQ ID NO: 2368 - RNA, 1473 nt, Artificial Sequence
  derived and/or modified CDS sequence (opt5) from Lassa virus__AIT17552__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacgcuuaugccgucaacgcugccaaucauugcggcacaauugcgaacggggugcuccaaaccuucaugcggauggccuggggaggcucuuacaucgcucuggacuccgggaagggaagcugggauuguaucaugacaucuuaccaguaucuuauuauccagaacaccacgugggaagaccacugccaguuuucccgccccagcccuauuggcuaccuggggcuccugucccaaagaacacgggauaucuauauuucucgcagacuucugggaaccuucacauggacccucagcgacuccgagggcaaugaaacccccggcggguacugucugacacgguggaugcugaucgaggccgagcucaaaugcuuuggaaacacggcuguugccaaguguaaugaaaaacaugaugaggaguucugcgacaugcugcgccuuuuugauuucaacaagcaggcgaucagacggcugaaaaccgaagcccagaugagcauucagcucaucaauaaggcugugaacgcccugauuaaugaccaacuuaucaugaagaaccaucugcgcgauauuaugggcaucccuuauugcaauuacucuaaauauugguaccucaaccacacagucaccgggaagacaucccugcccagauguuggcuggugagcaauggaucuuaccucaacgaaacccacuucagcgacgacaucgagcagcaggcugauaauaugauuacggagcugcuucaaaaagaauauauggaccggcagggcaagacaccucuggggcucguggaucuguuugucuucuccaccucuuuuuaccugaucagcauuuuccuucaccucguuaaaaucccgacccaucgccacgugauuggaaagcccugcccuaaaccccauagacugaaccacaugggcaucuguuccugcggccuguauaagcacccuggggugcccgucaaguggaaaaaguga

SEQ ID NO: 2369 - RNA, 1473 nt, Artificial Sequence
  derived and/or modified CDS sequence (opt5) from Lassa virus__AIT17556__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggcgcggaagcugggacuguaucaugaccucuuaccaguaucuuauuauccagaacacgacaugggaagaucacugccaguuuuccagacccagcccuauuggcuaccuggggcuccugucccaacggacccgcgacaucuauauuucuagacggcuucugggaacauucaccuggacccucagcgauuccgagggcaacgaaacacccggcggguacugucugacgcgcuggaugcugaucgaggcugagcucaagugcuuuggaaauaccgccguugcuaaauguaacgaaaagcaugacgaggaguucugcgauaugcugagacuuuuugacuucaauaaacaggccauccggcgccugaagacagaagcgcagaugagcauucagcucaucaacaaagccgugaaugcucugauuaacgaucaacuuaucaugaagaaucaccugagagacauuaugggcaucccuuauugcaacuacucuaaguauugguaccucaaucacaccaucacagggaaaaccucccugccccgguguuggcuggucagcaacggaucuuaccucaaugaaacgcauuucagcgacgauauugagcagcaggccgacaacaugaucacagagcugcuucaaaaggaauauauugaucgccagggcaaaaccccucuggggcucguggaccuguuuguguucuccaccucuuuuuaccugaucagcauuuuccuucaccucgucaagaucccgacacauagacacauuaccggaaaacccugcccuaagccccaucggcugaaucacaugggcaucuguuccugcggccuguauaaacacccugggguucccgugcgcuggaagagauga

SEQ ID NO: 2370 - RNA, 1473 nt, Artificial Sequence
  derived and/or modified CDS sequence (opt5) from Lassa virus__AIT17560__GPC
augggccagaucauuaccuucuuucaagaggugccccacgucaucgaagagguuaugaacauugugcugaucgcccucagccugcuugcugugcugaaggggauuuacaaugucgccacaugcggacucuucggccugguguccuuucuucugcucugugggagaucuugcagcacgaccuauaaaggaguuuacgaacugcagacacuggagcucgacauggcgucccugaacaugaccaugccucuuucuuguacaaccaauaacagccaucacuauaucauggugggcaaugaaacagggcuggagcucacccugacgaacaccuccaucauuaaucauaaguucugcaaccuuucugaugcucacaaaaagaaucuguacgaccaugcccucaugagcaucauuuccacauuucaccugagcaucccgaacuucaaucaguaugaggccaugucuugugauuuuaacggaggcaaaauuuccguccaguacaaucugagccacgcuuaugccggcgaagcugccaaccauugcgggaccaucgcgaauggagugcuccaaacauucaugcggauggccuggggcgggucuuacauugcucuggacuccggaaagggcagcugggauuguaucaugaccucuuacaaguaucuuaucauucagaacacgacauggggagaccacugccaguuuucccgccccagcccuaucggauaccugggccuccugucccagagaacccgggauauuuauaucucucgcagacuucugggcacauucaccuggacccucagcgacuccgaggggaacgaaacacccggaggcuacugucugacgcgguggaugcugauugaggccgagcucaaaugcuuugggaauaccgcuguugccaaguguaacgaaaaacaugaugaggaguucugcgacaugcugcgccuuuuugauuucaauaagcaagcgaucagaaaacugaagacagaagcccagaugagcauccagcucauuaacaaggcugugaaugcccugaucaacgaccagcuuauuaugaaaaaucaucugcgggauaucauggggauuccuuauugcaacuacucucgcuauugguaccucaaucacaccgucacaggcagaaccucccugccccgguguuggcuggugagcaacgggucuuaccucaaugaaacgcacuucagcgacgacaucgagcaacaggcugauaacaugaucacagagcugcuucagaaggaauauauugaccgccaaggaaaaaccccucugggccucguggaucuguuugucuucuccaccucuuuuuaccugaucagcauuuuccuucaccucguuaagaucccgacacauagacacauuaucggcaaacccugcccuaagccccaucggcugaaucacauggggauuuguuccugcggacuguauaaacacccuggcgugcccgugaaguggaagcgcuga

SEQ ID NO: 2371 - RNA, 1473 nt, Artificial Sequence
  derived and/or modified CDS sequence (opt5) from Lassa virus__AIT17564__GPC
augggccagaucauuaccuucuuucaagaggugccccacgucaucgaagagguuaugaacauugugcugaucgcccucagccugcuugcuauucugaaggggaucuacaauguggccacaugcggacucuucggccugcuuuccuuucugcuccugugugggagaucuugcagcacgaccuauaaaggagucuacgaacugcagacacucgagcuggacauggcgucccuuaacaugaccaugccucugucuuguacaaagaauaacagccaucacuauaucauggugggcaaugaaaccgggcucgagcugacacuuaccaacacguccauuaucaaucauaaauucugcaaccugucugaugcucacaagaaagaccucuacgaucaugcccugaugagcauuaucuccaccuuucaccugagcauuccgaauuucaaccaguaugaggccaugucuugugacuuuaauggaggcaagaucuccguucaguacaaccucagccacgcuuaugccguggaugcugccaagcauugcggcacaauugcgaaugggguccugcaaaccuucaugcggauggccuggggaggcucuuacaucgcucuugacuccgggaaaggaagcugggauuguaucaugacaucuuaccaguaucugauuauccagaacaccuccugggaagaccacugccaguuuagccgccccuccccuauuggcuaccucgggcugcuuucucaaagaacgcgggauaucuauauuagccgcagacugcucggaacauucaccuggacacuguccgacagcgagggcaaugaaacccccggcggguacugucugacccgguggaugcucaucgaggccgagcugaagugcuuuggaaacacagcuguggccaaauguaacgaaaagcaugaugaggaguucugcgacaugcuucgccuguuugauuucaauaaacaggcgaucaagagacucaagacggaagcccagaugucuauucagcugaucaacaaagcuguuaaugcccuuauuaacgaccaacugaucaugaagaaucaccuccgggacauuaugggcaucccuuauugcaacuacuccaaauauugguaccugaaucacaccgugacagggaagaccagccugccccgcuguuggcucgucucuaacggaagcuaccugaaugaaacacauuucuccgaugacaucgagcagcaggcugauaacaugauuaccgagcuucugcaaaaagaauauaucgacagacagggcaagacgccucucgggcugguggaucuguuuguguucucuaccagcuuuuaccuuauuuccaucuuccuccaccuggucaaaauuccgacacaucggcacguuaucggaaagcccugcccuaagccccaucgccugaaucacaugggcauuuguagcugcggccucuauaaacacccuggggugcccgugaaguggaaaagauga

SEQ ID NO: 2372 - RNA, 1473 nt, Artificial Sequence
  derived and/or modified CDS sequence (opt5) from Lassa virus__AIT17572__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgaaccugaauaugaccaugccucuuuccuguacaaagaacaauucucaucacuauaucaugguuggcaacgaaaccgggcuggagcucacacugaccaauacgagcauuaucaaccauaaauucugcaaucuuuccgaugcucacaagaaaaaccuguacgaccaugcccucaugucuauuaucagcaccuuucaccuguccauuccgaauuucaaccaguaugaggccaugagcugugauuuuaauggaggcaagaucucugugcaguacaaccugucccacaauuaugcugucgacgccgcuaaccauugcggcacaauugccaacggggugcuccaaaccuucaugcggauggcguggggaggcagcuacaucgcccuggauucugggaagggaaauugggacuguaucaugacauccuaccaguaucuuauuauccagaacaccacgugggaagaucacugccaguuuagccgccccucuccuauuggcuaccuggggcuccugucccaaagaacacgggacaucuauauuagccgcagacuucugggaaccuucacauggacccucuccgauucugagggcaaugacaugcccggcggguacugucugacccgguggaugcugaucgaagcugagcucaaaugcuuuggaaacacagccguugcuaaguguaaugagaaacaugaugaagaguucugcgacaugcugcgccuuuuugauuucaacaagcaggccaucagacggcugaaaacggaagcgcagaugaauauucagcucaucaacaaggccgugaaugcucugauuaacgaccaacuuaucaugaagaaucaucugcgcgacauuaugggcaucccuuauugcaacuacagcaaauauugguaccucaaucacaccgucacagggaagaccucccugcccagauguuggcuggugagcaacggaucuuaccucaaugagacacacuucuccgaugacaucgaacagcaggccgauaacaugauuaccgagcugcuucaaaaagaguauauggaccggcagggcaagacgccucuggggcucguggaucuguuugucuucagcacaucuuuuuaccugaucagcauuuuccuucaccucguuaaaaucccgacccaucgccacauuaucggaaagcccugcccuaaaccccauagacugaaccacaugggcauuuguuccugcggccuguauaagcacccuggggugcccgugaaguggaaacgguga

SEQ ID NO: 2373 - RNA, 1473 nt, Artificial Sequence
  derived and/or modified CDS sequence (opt5) from Lassa virus__AIT17576__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggaagggaaacugggacuguaucaugaccagcuaccaguaucuuauuauccagaacacgacaugggaagaucacugccaguuuucucgccccuccccuauuggcuaccuggggcuccugagccaaagaacccgggacaucuauauuucccgcagacuucugggaacauucaccuggacccucucugauagcgagggcaaugaaacacccggcggguacugucugacgcgguggaugcugaucgaggcugagcucaaaugcuuuggaaacaccgccguugcuaaguguaaugaaaaacaugacgaggaguucugcgauaugcugcgccuuuuugacuucaacaagcaggccaucuccagacugaaaacagaagcgcagaugagcauucagcucaucaauaaggccgugaacgcucugauuaaugaucaacuuaucaugaagaaccaucugcgggacauuaugggcaucccuuauugcaauuacucuaaauauugguaccucaaccacaccgucacagggaagaccucccugccccgcuguuggcuggugagcaauggaucuuaccucaacgaaacgcacuucagcgacgauaucgagcagcaggccgacaauaugauuacagagaugcugcaaaaagaauauaucgauagacagggcaagaccccucuugggcugguggaccucuuugucuucuccaccucuuuuuaccugauuagcaucuuccugcaccuuguuaaaauuccgacacaucggcacaucaccggaaagcccugcccuaaaccccaucgccucaaccacaugggcauuuguuccugcggccuguauaagcacccuggggugcccgugaaguggaaaagauga

SEQ ID NO: 2374 - RNA, 1473 nt, Artificial Sequence
  derived and/or modified CDS sequence (opt5) from Lassa virus__AIT17580__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggaagggaagcugggacuguaucaugaccucuuaccaguaucuuauuauccagaacacgacaugggaagaucacugccaguuuucccgccccagcccuauuggcuaccuggggcuccugucccaaagaacccgggacaucuauauuucucgcagacuucugggaacauucaccuggacccucagcgauuccgagagcaacgaaacacccggcggcuacugucugacgcgguggaugcugaucgaggcugagcucaaaugcuuugggaauaccgccguugcuaaguguaacgaaaaacaugacgaggaguucugcgauaugcugcgccuuuuugacuucaauaagcaggccaucagacggcugaaagcggaagcccagaugucuauucagcucaucaacaaggcugugaaugcccugauuaacgaucaacuuaucaugaagaaucaucugcgcgacauuaugggaaucccuuauugcaacuacuccaaauauugguaccucaaucacacagucaccggcagaacaagccugccccgguguuggcuggugucuaacgggagcuaccucaaugaaacccacuucuccgacgauaucgagcagcaggcugacaacaugauuacggagcugcuucaaaaggaauauauggaucgccagggaaaaacaccucugggccucguggaccuguuugucuucucuaccagcuuuuaccugaucuccauuuuccuucaccucguuaagaucccgacccauagacacgugauugggaaacccugcccuaagccccaucggcugaaucacaugggaaucuguagcugcggccuguauaaacacccuggcgugcccgucaaguggaagcgcuga

SEQ ID NO: 2375 - RNA, 1473 nt, Artificial Sequence
  derived and/or modified CDS sequence (opt5) from Lassa virus__AIT17584__GPC
augggccagaucauuaccuucuuucaagaggugccccaggucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaccauuauaucaugguuggcaaugaaaccgggcuggagcucacacugaccaaccaguccauuaucaaucacaaauucugcaaccuuucugaugcucauaagaaaaaucuguacgaccacgcccucaugagcauuaucuccacguuucaucugagcauuccgaacuucaaucaauaugaggccaugucuugugauuuuaacggaggcaagaucuccgugcaguacaaucugagccacucuuucgcugucgacgccgcuaaccacugcggcaccauugccaauggggugcuccagacauuuaugcggauggcguggggaggcuccuauaucgcccuggauagcgggaagggaucuugggacuguaucaugaccuccuaccaguaccuuauuauccaaaacacaaccugggaagaucauugccaguucagccgccccuccccuauuggcuaucuggggcuccugucucagagaacgcgggacaucuacauuagccgcagacuucugggaacauuuaccuggacacucuccgauagcgagggcaacgaaacccccggcggguauugucugacccgguggaugcugaucgaggcugagcucaaaugcuucggaaauacagccguugcuaaguguaacgaaaaacacgacgaggaauuuugcgauaugcugcgccuuuucgacuucaauaagcaggccaucagacggcugaaaacggaggcgcaaaugucuauucagcucaucaacaaggccgugaaugcucugauuaacgaucagcuuaucaugaagaaucaucugcgcgacauuaugggcaucccuuacugcaacuauuccaaauacugguaucucaaucacaccaagacagggaaaaccagccugcccagauguuggcuggucucuaacggaagcuaccucaaugaaacacacuuuuccgacgauaucgagcaacaggccgacaacaugauuaccgagcugcuucagaaggaauacauggaucggcagggcaaaacgccucuggggcucguggaccuguucguguuuucuaccagcuucuaucugaucuccauuuuucuucaucucgucaagaucccgacacaccgccauguuauuggaaaacccugcccuaagccccacagacugaaucauaugggcaucuguagcugcggccuguacaagcacccuggggugcccgugaaauggaagcgguga

SEQ ID NO: 2376 - RNA, 1473 nt, Artificial Sequence
  derived and/or modified CDS sequence (opt5) from Lassa virus__AIT17588__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacgcuuaugccgucgacgcugccaaccauugcggcacaauugcgaauggggugcuccaaaccuucaugcggauggccuggggaggcucuuacaucgcucuggauuccgggaagggaagcugggacuguaucaugacaucuuaccaguaucuuauuauccagaacaccacgugggaagaucacugccaguuuucccgccccagcccuauuggcuaccuggggcuccugucccaaagaacacgggacaucuauauuucucgcagacuucugggaaccuucacauggacccucagcgauuccgagggcaacgaaacccccggcggguacugucugacacgguggaugcugaucgaggccgagcucaaaugcuuuggaaauacggcuguugccaaguguaacgaaaaacaugacgaggaguucugcgauaugcugcgccuuuuugacuucaauaagcaggcgaucagacggcugaaagccgaagcucagaugagcauucagcucaucaacaaggccgugaaugcucugauuaacgaucaacuuaucaugaagaaucaucugcgcgacauuaugggcaucccuuauugcaacuacucuaaauauugguaccucaaucacaccgucacagggaagaccucccugcccagauguuggcuggugagcaacggaucuuaccucaaugaaacacacuucagcgacgauaucgagcagcaggccgacaacaugauuaccgagcugcuucaaaaagaauauaucgaucggcagggcaagacgccucuggggcucguggaccuguuugucuucuccacaucuuuuuaccugauuagcaucuuccuucaccucguuaaaauuccgacccaucgccacgugaucggaaagcccugcccuaaaccccauagacugaaucacaugggcauuuguuccugcggccuguauaagcacccuggggugcccgucaaguggaaacgguga

SEQ ID NO: 2377 - RNA, 1473 nt, Artificial Sequence
  derived and/or modified CDS sequence (opt5) from Lassa virus__AIT17592__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccauacccucaugagcauuaucuccacauuucaccugagcauuccgaacuucaaucaguaugaggccaugucuugugauuuuaacggaggccggaucuccgugcaguacaaucugagccacgccuaugcugucgacgccgcuaaccauugcggcaccauugccaauggggugcuccaaacauucaugcgcauggcguggggaggcucuuacaucgcccuggauuccgggaagggaagcugggacuguaucaugaccucuuaccaguaucuuauuauccagaacacgacaugggaagaucacugccaguuuuccagacccagcccuauuggcuaccuggggcuccugucccaacggacccgcgacaucuauauuucuagacggcuucugggaacauucaccuggacccucagcgauuccgagggcaacgaaacacccggcggguacugucugacgcgcuggaugcugaucgaggcugagcucaagugcuuuggaaauaccgccguugcuaaauguaacgaaaagcaugacgaggaguucugcgauaugcugagacuuuuugacuucaauaaacaggccauccggcgccugaagacagaagcgcagaugagcauucagcucaucaacaaagccgugaaugcucugauuaacgaucaacuuaucaugaagaaucaccugagagacauuaugggcaucccuuauugcaacuacucuaaguauugguaccucaaucacaccaucacagggaaaaccucccugccccgguguuggcuggucagcaacggaucuuaccucaaugaaacgcauuucagcgacgauauugagcagcaggccgacaacaugaucacagagcugcuucaaaaggaauauauugaucgccagggcaaaaccccucuggggcucguggaccuguuuguguucuccaccucuuuuuaccugaucagcauuuuccuucaccucgucaagaucccgacacauagacacguugugggaaaacccugcccuaagccccaucggcugaaucacaugggcauuuguuccugcggccuguauaaacacccuggggugcccgucaaguggaagcgcuga

SEQ ID NO: 2378 - RNA, 1473 nt, Artificial Sequence
  derived and/or modified CDS sequence (opt5) from Lassa virus__AIT17596__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggaagggaagcugggacuguaucaugaccucuuaccaguaucuuauuauccagaacacguccugggaagaucacugccaguuuagccgccccuccccuauuggcuaccuggggcuccugucucaaagaacacgggacaucuauauuagccgcagacuucugggaaccuucacauggacccucuccgauagcgagggcaacgaaacccccggcggguacugucugacacgguggaugcugaucgaggcugagcucaaaugcuuuggaaauacggccguugcuaaguguaacgaaaaacaugacgaggaguucugcgauaugcugcgccuuuuugacuucaauaagcaggccaucagacggcugaaaaccgaagcgcagaugucuauucagcucaucaacaaggccgugaaugcucugauuaacgaucaacuuaucaugaagaaucaucugcgcgacauuaugggcaucccuuauugcaacuacuccaaauauugguaccucaaucacacagucaccgggaagacaagccugcccagauguuggcuggugucuaacggaagcuaccucaaugaaacccacuucuccgacgauaucgagcagcaggccgacaacaugauuacggagcugcuucaaaaagaauauaucgaucggcagggcaagacaccucuggggcucguggaccuguuugucuucucuaccagcuuuuaccugauuuccaucuuccuucaccucguuaaaauuccgacccaucgccacgugaucggaaagcccugcccuaaaccccauagacugaaucacaugggcauuuguagcugcggccuguauaagcacccuggggugcccgucaaguggaaacgguga

SEQ ID NO: 2379 - RNA, 1473 nt, Artificial Sequence
  derived and/or modified CDS sequence (opt5) from Lassa virus__AIT17600__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacgcuuaugccggcgacgcugccaaccauugcgggacaauugcgaauggaguccuccaaaccuucaugcggauggccuggggcgggucuuacaucgcucuggauuccggaaagggcagcugggacuguaucaugacaucuuaccaguaucuuauuauccagaacaccacgugggaagaucacugccaguuuucccgccccagcccuauuggguaccugggacuccugucccaaagaacacgggacaucuauauuucucgcagacuucugggcaccuucacauggacccucagcgauuccgagggcaacgaaacccccgggggauacugucugacacgguggaugcugaucgaggccgagcucaaaugcuuuggcaauacggcuguggccaaguguaacgaaaaacaugacgaggaguucugcgauaugcugcgccuuuuugacuucaauaagcaggcgaucagacggcugaaaaccgaagcccagaugagcauucagcucaucaacaaggcuguuaaugcccugauuaacgaucaacuuaucaugaagaaucaucugcgcgacauuauggggaucccuuauugcaacuacucuaaauauugguaccucaaucacacagugaccggaaagacaucccugcccagauguuggcuggucagcaacggcucuuaccucaaugaaacccacuucagcgacgauaucgagcagcaggcugacaacaugauuacggagcugcuucaaaaagaauauaucgaucggcaggggaagacaccucugggacucguggaccuguuuguguucuccaccucuuuuuaccugauuagcaucuuccuucaccucgucaaaauuccgacccaucgccacguuaucggcaagcccugcccuaaaccccauagacugaaucacaugggcauuuguuccugcgggcuguauaagcacccuggagugcccgugaaguggaaacgguga

SEQ ID NO: 2380 - RNA, 1473 nt, Artificial Sequence
  derived and/or modified CDS sequence (opt5) from Lassa virus__AIT17604__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacaugaccucccugaacaugacaaugccucuuucuuguaccaagaauaacagccaucacuauaucaugguuggcaaugaaacagggcuggagcucacccugacgaacaccuccauuaucaaucauaaauucugcaaccuuucugaugcgcacaagaaagaccuguacgaucaugcucucaugagcauuaucuccacauuucaccugagcauuccgaauuucaaccaguaugaggccaugucuugugacuuuaauggaggcaagaucuccgugcaguacaaccugagccacaccuaugccgucgaugcugccaagcauugcggcacaauugcuaauggggugcuccaaaccuucaugcggauggccuggggaggcucuuacaucgcgcuggacuccgggaaaggaagcugggauuguaucaugacgucuuaccaguaucuuauuauccagaacacaaccugggaagaccacugccaguuuucccgccccagcccuguuggcuaccuggggcuccugucccaaagaacacgggauauuuauaucucucgcagacuucugggaaccuucaccuggacacucagcgacuccgagggcaaugaaacgcccggcggguacugucugacccgguggaugcugauugaggccgagcucaagugcuuuggaaacacagcuguggccaaauguaacgaaaagcaugaugaggaguucugcgacaugcugcgccuuuuugauuucaauaaacaggcuaucagacggcugaagaccgaagcccagaugagcauccagcucauuaacaaggcggucaaugcccugaucaacgaccaacuuauuaugaaaaaucaucugcgcgacaucaugggcauuccuuauugcaacuacucuaaguauugguaccucaaucacacagugaccgggaaaacgucccugcccagauguuggcuggugagcaacggaucuuaccucaaugaaacacacuucagcgaugacaucgagcagcaggcugauaacaugaucaccgagcugcuucaaaaggaauaucuggaccggcagggcaaaaccccucucgggcuggucgaucuguuuguuuucuccacaucuuuuuaccuuauuagcaucuuccuccaccuggugaagauuccgacccaucgccacgugaucggaaaacccugcccuaagccccauagacugaaucacaugggcauuuguuccugcggccucuauaagcacccugggguccccgugaaauggaagcgguga

SEQ ID NO: 2381 - RNA, 1473 nt, Artificial Sequence
  derived and/or modified CDS sequence (opt5) from Lassa virus__AIT17608__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagcggaaucuguacaaccaugcccucaugagcauuaucuccaccuuucaccugagcauuccgaauuucaaccaguaugaggccaugucuugugacuuuaauggaggcaaaaucuccgugcaguacaaccugagccacacauaugcugucgaugccgcuaaucauugcggcaccauugccaacggggugcuccaaacauucaugcgcauggcguggggaggcucuuacaucgcccuggacuccgggaagggaagcugggauuguaucaugaccucuuaccaguaucuuauuauccagaacacgacaugggaagaccacugccaguuuuccagacccagcccuauuggcuaccuggggcuccugucccaacggacccgcgauaucuauauuucuagacggcuucugggaacauucaccuggacccucagcgacuccgagggcaaugaaacacccggcggguacugucugacgcgcuggaugcugaucgaggcugagcucaagugcuuuggaaacaccgccguugcuaaauguaaugaaaagcaugaugaggaguucugcgacaugcugagacuuuuugauuucaacaaacaggccauccggcgccugaagacagaagcgcagaugagcauucagcucaucaauaaagccgugaacgcucugauuaaugaccaacuuaucaugaagaaccaccugagagauauuaugggcaucccuuauugcaauuacucuaaguauugguaccucaaccacaccgucacagggaaaaccucccugccccgguguuggcuggugagcaauggaucuuaccucaacgaaacgcauuucagcgacgacaucgagcagcaggccgauaauaugauuacagagcugcuucaaaaggaauauaucgaccgccagggcaaaaccccucuggggcucguggaucuguuugucuucuccaccucuuuuuaccugauuagcaucuuccuucaccucguuaagauuccgacacauagacacaucauuggaaaacccugcccuaagccccaucggcugaaccacaugggcaucuguuccugcggccuguauaaacacccuggggugcccgugaaguggcgcagauga

SEQ ID NO: 2382 - RNA, 1473 nt, Artificial Sequence
  derived and/or modified CDS sequence (opt5) from Lassa virus__AIT17612__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauauccggguuggcaaugaaaccgggcuggagcucacacugaccaacacguccauuaucaaucauaaauucugcaaccuuucugaugcucacaagaaaaaucuguacgaccauagccucauguccauuaucagcaccuuucaccugucuauuccgaacuucaaucaguaugaggccauguccugugauuuuaacggaggcaagaucagcgugcaguacaaucugucucacacauaugccgucgacgcugccaaccauugcggcaccauugcuaauggggugcuccaaacauucaugcgcauggccuggggaggcuccuacaucgcgcuggauagcgggaagggaaacugggacuguaucaugaccucuuaccaguaucuuauuauccagaacacgacaugggaagaucacugccaguuuuccagacccagcccuauuggcuaccuggggcuccugucccaacggacccgcgacaucuauauuucuagacggcuucugggaacauucaccuggacccucagcgauuccgagggcaaugaaacacccggcggguacugucugacgcgcuggaugcugaucgaggccgagcucaaaugcuuuggaaacaccgcuguugccaaguguaaugaaaaacaugacgaggaguucugcgauaugcugagacuuuuugacuucaacaagcaggcuauccggcgccugaaaacagaagcccagaugagcauucagcucaucaauaaggcggugaacgcccugauuaaugaucaacuuaucaugaagaaccaccugagagacauuaugggcaucccuuauugcaauuacucuaaauauugguaccucaaccacaccgucacagggaagaccucccugccccgguguuggcuggugagcaauggaucuuaccucaacgaaacgcauuucagcgacgauaucgagcagcaggcugacaauaugauuacagagcugcuucaaaaagaauauaucgaucgccagggcaagaccccucuggggcucguggaccuguuugucuucuccaccucuuuuuaccugauuagcaucuuccuucaccucguuaaaauuccgacacauagacacguggugggaaagcccugcccuaaaccccaucggcugaaccacaugggcaucuguuccugcggccuguauaagcacccugggguccccgugaaguggaaacgcuga

SEQ ID NO: 2383 - RNA, 1473 nt, Artificial Sequence
  derived and/or modified CDS sequence (opt5) from Lassa virus__AIT17616__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacgcuuaugccgucgacgcugccaaccauugcggcacaauugcgaauggggugcuccaaaccuucaugcggauggccuggggaggcucuuacaucgcucuggauuccgggaagggaagcugggacuguaucaugacaucuuaccaguaucuuauuauccagaacaccacgugggaagaucacugccaguuuucccgccccagcccuauuggcuaccuggggcuccugucccaaagaacacgggacaucuauauuucucgcagacuucugggaaccuucacauggacccucagcgauuccgagggcaacgaaacccccggcggguacugucugacacgguggaugcugaucgaggccgagcucaaaugcuuuggaaauacggcuguugccaaguguaacgaaaaacaugacgaggaguucugcgauaugcugcgccuuuuugacuucaauaagcaggcgaucagacggcugaaaaccgaagcccagaugagcauucagcucaucaacaaggcugugaaugcccugauuaacgaucaacuuaucaugaagaaucaucugcgcgacauuaugggcaucccuuauugcaacuacucuaaauauugguaccucaaucacacagucaccgggaagacaucccugcccagauguuggcuggugagcaacggaucuuaccucaaugaaacccacuucagcgacgauaucgagcagcaggcugacaacaugauuacggagcugcuucaaaaagaauauaucgaucggcagggcaagacaccucuggggcucguggaccuguuugucuucuccaccucuuuuuaccugauuagcaucuuccuucaccucguuaaaauuccgacccaucgccacgugaucggaaagcccugcccuaaaccccauagacugaaucacaugggcauuuguuccugcggccuguauaagcacccuggggugcccgucaaguggaaacgguga

SEQ ID NO: 2384 - RNA, 1473 nt, Artificial Sequence
  derived and/or modified CDS sequence (opt5) from Lassa virus__AIT17620__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucucucauaaauucugcaaucuuagcgaugcucacaagaaaaaccuguacgaccaugcccucauguccauuaucagcaccuuucaccugucuauuccgaauuucaaccaguaugaggccauguccugugauuuuaauggaggcaagaucagcgugcaguacaaccugucucacgcuuaugccauugacgcugccaaucauugcggcacagucgcgaacggggugcuccaaaccuucaugcggauggccuggggaggcuccuacaucgcucuggauagcgggaagggaucuugggacuguaucaugacauccuaccaguaucuuauuauccagaauaccacgugggaagaucacugccaguuuagccgccccuccccuauuggcuaccuggggcuccugucucaaagaacacgggacaucuauauuagccgcagacuucugggaaccuucacauggacccucuccgauagcgagggcaacgaaacccccggcggguacugucugacacgguggaugcugaucgaggccgagcucaaaugcuuuggaaacacggcuguugccaaguguaaugaaaaacaugacgaggaguucugcgauaugcugcgccuuuuugacuucaacaagcaggcgaucagacggcugaaagccgaagcucagaugucuauucagcucaucaauaaggccgugaacgcucugauuaaugaucaacuuaucaugaagaaccaucugcgcgacauuaugggcaucccuuauugcaauuacuccaaauauugguaccucaaccacaccgucacagggaagaccagccugcccagauguuggcuggugucuaauggaagcuaccucaacgaaacacacuucuccgacgauaucgagcagcaggccgacaauaugauuaccgagcugcuucaaaaagaauauauggaucggcagggcaagacgccucuggggcucguggaccuguuugucuucucuaccagcuuuuaccugaucuccauuuuccuucaccucguuaaaaucccgacacaucgccacgugauuggaaagcccugcccuaaaccccauagacugaaccacaugggcaucuguagcugcggccuguauaagcacccuggggugcccgucaaguggaaacgguga

SEQ ID NO: 2385 - RNA, 1473 nt, Artificial Sequence
  derived and/or modified CDS sequence (opt5) from Lassa virus__AIT17626__GPC
augggccagaucauuaccuucuuucaagaggugccccacgucaucgaagagguuaugaacauugugcugaucgcccucagccugcuugcuauucugaaggggguguacaaugucgccacaugcggacucuucggccugguguccuuucuucugcucugugggagaucuugcagcacgaccuauaaaggaguuuacgaacugcagacacuggagcucgacauggcgucccugaacaugaccaugccucuuucuuguacaaagaauaacagccaucacuauaucauggugggcaaugaaaccgggcuggagcucacacugaccaacacguccaucauucagcauaaauucugcaaucuuucugaugcucacaagaaaaaccuguacgaccaugcccucaugagcaucauuuccaccuuucaccugagcaucccgaauuucaaccaguaugaggccaugucuugugauuuuaauggaggcaagauuacaguccaauacaaccugucccacagcuaugcuaucgacgccgcuaaucauugcggcaccauugccaacggggugcuccagacauucaugcggauggcguggggaggcucuuacaucgcccuggauuccgggaagggaagcugggacuguaucaugaccucuuaccaguaucuuauuauccagaauacgacaugggaagaucacugccaauuuucccgccccagcccuauuggcuaccuggggcuccugucccagagaacccgggacaucuauauuucucgcagacuucugggaacauucaccuggacccucagcgauuccgagggcaacgaaacacccggcggguacugucugacgcgguggaugcugaucgaggcugagcucaaaugcuuuggaaacaccgccguugcuaaguguaaugaaaaacaugacgaggaguucugcgauaugcugcgccuuuuugacuucaacaagcaggccaucagacggcugaaaacagaagcgcagaugagcauucaacucaucaauaaggccgugaacgcucugauuaaugaucagcuuaucaugaagaaccaucugcgcgacauuaugggcaucccuuauugcaauuacucuaaauauugguaccucaaccacaccgucacagggagaaccucccugccccgguguuggcuggugagcaauggaucuuaccucaacgaaacgcacuucagcgacgauaucgagcagcaagccgacaauaugauuacagagcugcuucagaaggaauauauggaucgccagggcaaaaccccucuggggcucguggaccuguuugucuucuccaccucuuuuuaccugaucagcauuuuccuucaccucguuaagaucccgacacauagacacauuaucggaaaacccugcccuaagccccaucggcugaaccacaugggcguguguuccugcggccuguauaaacacccuggggugcccgucaaguggaagcgcuga

SEQ ID NO: 2386 - RNA, 1473 nt, Artificial Sequence
  derived and/or modified CDS sequence (opt5) from Lassa virus__AIT17630__GPC
augggccagaucauuaccuucuuucaagaggugccccacgucaucgaagagguuaugaacauugugcugaucgcccucagccugcuugcuauucugaaggggaucuacaauguggccacaugcggacucuucggccugcuuuccuuucugcuccugugugggagaucuugcagcacgaccuauaaaggagucuacgaacugcagacacucgagcuggacauggcgucccuuaacaugaccaugccucugucuuguacaaagaauaacagccaucacuauaucauggugggcaaugaaaccgggcucgagcugacacuuaccaacacguccauuaucaaucauaaauucugcaaccugucugaugcucacaagaaaaaucucuacgaccaugcccugaugagcauuaucuccaccuuucaccugagcauuccgaacuucaaucaguaugaggccaugucuugugauuuuaacggaggcaagaucuccguucaguacaaucucagccacgcuuaugccguggacgcugccgaacauugcggcacaauugcgaacgggguccugcaaaccuucaugcggauggccuggggaggcucuuacaucgcucuugauuccgggaagggaagcugggacugugugaugacaucuuaccaguaucugaucauucagaauaccuccugggaggaucacugccaguuuagccgccccuccccuaucggcuaccucgggcugcuuucucaaagaacgcgggacauuuauaucagccgcagacugcucggaacauucaccuggacacuguccgauagcgaaggcaacgagacccccggcggguacugucugacccgguggaugcucauugaggccgaacugaaaugcuuuggaaacacagcuguugccaaguguaaugagaaacaugacgaagaguucugcgauaugcuucgccuguuugacuucaacaagcaggcgaucagacggcucaaaacggaagcccagaugucuauccagcugauuaauaaggcugugaacgcccuuaucaaugaucaacugauuaugaagaaccaccuccgcgacaucaugggcauuccuuauugcaauuacuccaaauauugguaccugaaccacaccgucacagggaagaccagccugcccagauguuggcucgugucuaauggaagcuaccugaacgagacacauuucuccgacgauaucgagcagcaggcugacaauaugaucaccgaacuucugcaaaaagaguauauugaucggcagggcaagacgccucucgggcugguggaccuguuugucuucucuaccagcuuuuaccuuaucuccauuuuccuccaccugguuaaaaucccgacacaucgccacgugauuggaaagcccugcccuaaaccccauagacugaaccacaugggcaucuguagcugcggccucuauaagcacccuggggugcccgucaaguggaaacgguga

SEQ ID NO: 2387 - RNA, 1473 nt, Artificial Sequence
  derived and/or modified CDS sequence (opt5) from Lassa virus__AIT17634__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaucuauaaagacguguacgaacugcagacccuggagcucgauauggcgucccugaacaugacaaugccucuuucuuguaccaagaauaacagccaucacuauauuaugguuggaaaugaaacaggccuggagcucacccugacaaacaccuccaucauuaaucauaaauucugcaaccuuucugacgcucacaagaaaaaucuguacgaucaugcccucaugagcaucauuuccacguuucaccugagcaucccgaacuucaaucaguaugaggccaugucuugugacuuuaacgggggaaagauuuccgugcaguacaaucugagccacaccuaugcuaucgaugccgcuaaccauugcggcacaaucgccaauggcguccuccaaaccuucaugcggauggcguggggaggaucuuacauugcccuggacuccggcaaggggagcugggauuguaucaugacaucuuaccaguaucuuauuauccagaacaccacgugggaagaccacugccaguuuucccgccccagcccuauuggauaccugggccuccugucccaaagaacacgggauaucuauaucucucgcagacuucuggggaccuucacauggacccucagcgacuccgagggaaacgaaacccccggcggcuacugucugacacgguggaugcugauugaggcugagcucaaaugcuuugggaauacggccguggcuaaguguaacgaaaaacaugaugaggaguucugcgacaugcugcgccuuuuugauuucaauaagcaggccaucagacggcugaaaaccgaagcgcagaugagcauucagcucaucaacaaggccguuaaugcucugauuaacgaccaacuuaucaugaagaaucaucugcgcgacaucauggggauuccuuauugcaacuacucuagauauugguaccucaaucacacagugaccggccggacaucccugccccgcuguuggcuggucagcaacgggucuuaccucaaugaaacccacuucagcgaugacaucgagcagcaggccgauaacaugauuacggagcugcuucaaaaagaauauauggacagacagggaaagacaccucugggccucguggaucuguuuguguucuccaccucuuuuuaccugaucagcauuuuccuucaccucgucaaaaucccgacccaucggcacguuauugggaagcccugcccuaaaccccaucgccugaaucacaugggaaucuguuccugcggccuguauaaccacccuggcgugcccgugaaguggaaaagauga

SEQ ID NO: 2388 - RNA, 1473 nt, Artificial Sequence
  derived and/or modified CDS sequence (opt5) from Lassa virus__AIT17638__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaagaccuguacgaucaugcccucaugagcauuaucuccaccuuucaccugagcauuccgaauuucaaccaguaugaggccaugucuugugacuuuaauggaggcaagaucuccgugcaguacaaccugagccacacauaugcugucgaugccgcuaaucauugcggcaccauugccaacggggugcuccaaacauucaugcggauggcguggggaggcucuuacaucgcccuggacuccgggaagggaagcugggauuguaucaugaccucuuaccaguaucuuauuauccagaauacgacaugggaagaccacugccaguuuucccgccccagcccuauuggcuaccuggggcuccugucccaaagaacccgggauaucuauauuucucgcagacuucugggaacauucaccuggacccucagcgacuccgagggcaacgaaacacccggcggguacugucugacgcgguggaugcugaucgaggcugagcucaaaugcuuuggaaacaccgccguugcuaaguguaaugaaaaacaugaugaggaguucugcgacaugcugcgccuuuuugauuucaacaagcaggccaucagacggcugaaaacagaagcgcagaugagcauucagcucaucaauaaggccgugaacgcucugauuaaugaccaacuuaucaugaagaaccaucugcgcgacauuaugggcaucccuuauugcaauuacucuaaauauugguaccucaaccacaccgucacagggaagaccucccugcccagauguuggcuggugagcaauggaucuuaccucaacgaaacgcacuucagcgaugacaucgagcagcaggccgauaauaugauuacagagcugcuucaaaaagaauauauggaccggcagggcaagaccccucuggggcucguggaucuguuugucuucuccaccucuuuuuaccugaucagcauuuuccuucaccucaucaaaauuccgacacaucgccacaucaccggaaagcccugcccuaaaccccauagacugaaccacaugggcauuuguuccugcggccuguauaagcacccugggguucccgugaaguggaaacgguga

SEQ ID NO: 2389 - RNA, 1473 nt, Artificial Sequence
  derived and/or modified CDS sequence (opt5) from Lassa virus__AIT17642__GPC
augggccagaucauuaccuucuuucaagaggugccccacgucaucgaagagguuaugaacauugugcugaucgcccucagccugcuugcuauucugaaggggguguacaaugucgccacaugcggacucuucggccugguguccuuucuucugcucugugggagaucuugcagcacgaccuauaaaggaguuuacgaacugcagacacuggagcucgacauggcgucccugaacaugaccaugccucuuucuuguacaaagaauaacagccaucacuauaucauggugggcaaugauaccgggcuggaacucacacugaccaacacguccaucauuaaucauaaauucugcaaccuuucugacgcucacaagaaaaaucuguacgaucaugcccucaugagcaucauuuccaccuuucaccugagcaucccgaacuucaaucaguaugaggccaugucuugugacuuuaacggaggcaagauuuccguccaguacaaucugagccacgcuuaugccguggaugcugccucucauugcggcacaaucgcgaacgggguucuccaaaccuucaugcggauggccuggggaggcuccuacauugcucuggacagcgggaagggaucuugggauuguaucaugacauccuaccaguaucuuaucauucagaauaccacgugggaggaccacugccaguuuagccgccccuccccuaucggcuaccuggggcuccugucucaaagaacacgggauauuuauaucagccgcagacuucugggaaccuucacauggacccucuccgacagcgaaggcaacgagacccccggcggguacugucugacacgguggaugcugauugaagccgagcucaaaugcuuuggaaacacggcuguggccaaguguaaugagaaacaugaugaagaguucugcgacaugcugcgccuuuuugauuucaacaagcaggcgaucagacggcugaaaaccgaagcccagaugucuauccagcucauuaauaaggcugucaacgcccugaucaaugaccaacuuauuaugaagaaccaucugcgcgacaucaugggcauuccuuauugcaauuacuccaaauauugguaccucaaccacacagugaccgggaagacaagccugcccagauguuggcuggugucuaauggaagcuaccucaacgagacccacuucuccgaugacaucgaacagcaggcugauaauaugaucacggagcugcuucaaaaagaguauauggaccggcagggcaagacaccucuggggcucgucgaucuguuuguuuucucuaccagcuuuuaccugauuuccaucuuccuucaccucgugaaaauuccgacccaucgccacaucauuggaaagcccugcccuaaaccccauagacugaaccacaugggcaucuguagcugcggccuguauaagcacccuggggugcccgucaaguggaaacgguga

SEQ ID NO: 2390 - RNA, 1473 nt, Artificial Sequence
  derived and/or modified CDS sequence (opt5) from Lassa virus__AIT17646__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacgcuuaugccgucgacgcugccucucauugcggcacaguggcgaacgggguucuccaaaccuucaugcggauggccuggggaggcuccuacauugcucuggauagcgggaagggaucuugggacuguaucaugacauccuaccaguaucuuaucauucagaauaccacgugggaagaucacugccaguuuagccgccccuccccuaucggcuaccuggggcuccugucucaaagaacacgggacauuuauaucagccgcagacuucugggaaccuucacauggacccucuccgauagcgagggcaacgaaacccccggcggguacugucugacacgguggaugcugauugaggccgagcucaaaugcuuuggaaacacggcuguggccaaguguaaugaaaaacaugacgaggaguucugcgauaugcugcgccuuuuugacuucaacaagcaggcgaucagacggcugaaaaccgaagcccagaugucuauccagcucauuaauaaggcugucaacgcccugaucaaugaucaacuuauuaugaagaaccaucugcgcgacaucaugggcauuccuuauugcaauuacuccaaauauugguaccucaaccacacagugaccgggaagacaagccugcccagauguuggcuggugucuaauggaagcuaccucaacgaaacccacuucuccgacgauaucgagcagcaggcugacaauaugaucacggagcugcuucaaaaagaauauauggaucggcagggcaagacaccucuggggcucgucgaccuguuuguuuucucuaccagcuuuuaccugauuuccaucuuccuucaccucgugaaaauuccgacccaucgccacgugaucggaaagcccugcccuaaaccccauagacugaaccacaugggcauuuguagcugcggccuguauaagcacccugggguccccgugaaguggaaacgguga

SEQ ID NO: 2391 - RNA, 1473 nt, Artificial Sequence
  derived and/or modified CDS sequence (opt5) from Lassa virus__AIT17650__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacauuuccaucauuaaucauaaauucugcaaccuuucugaugcucacaagaaaaaucuguacgaccaugcccucaugagcaucauuuccacguuucaccugagcaucccgaacuucaaucaguaugaggccaugucuugugauuuuaacggaggcaagauuuccgugcaguacaaucugagccacaccuaugcugucgacgccgcuaaccauugcggcacaaucgccaauggggugcuccaaaccuucaugcggauggcguggggaggcucuuacaucgcccuggauuccgggaagggaagcugggacuguauuaugacaucuuaccaguaucuuaucauucagaacaccacgugggaagaucacugccaguuuucccgccccagcccuaucggcuaccuggggcuccugucccaaagaacacgggacauuuauaucucucgcagacuucugggaaccuucacauggacccucagcgauuccgagggcaacgaaacccccggcggguacugucugacacgguggaugcugaucgaggcugagcucaaaugcuuuggaaauacggccguugcuaaguguaacgaaaaacaugacgaggaguucugcgauaugcugcgccuuuuugacuucaauaagcaggccauuagacggcugaaagcggaagcccagaugagcauccagcucauuaacaaggcugugaaugcccugaucaacgaucaacuuauuaugaagaaucaucugcgcgacaucaugggcaucccuuauugcaacuacucuaaauauugguaccucaaucacaccgucacagggagaaccucccugccccgguguuggcuggugagcaacggaucuuaccucaaugaaacacacuucagcgacgauauugagcagcaggcugacaacaugaucaccgagcugcuucaaaaggaauauauugaucgccagggcaaaacgccucuggggcucguggaccuguuugucuucuccacaucuuuuuaccugaucagcauuuuccuucaccucguuaagaucccgacccauagacacauuaucggaaaacccugcccuaagccccaucggcugaaucacaugggcaucuguuccugcggccuguauaaacacccuggggugcccgugaaguggaagcgcuga

SEQ ID NO: 2392 - RNA, 1473 nt, Artificial Sequence
  derived and/or modified CDS sequence (opt5) from Lassa virus__AIT17658__GPC
augggccagaucauuaccuucuuucaagaggugccccacgucaucgaagagguuaugaacauugugcugaucgcccucagccugcuugcuauucugaaggggguguacaaugucgccacaugcggacucuucggccugguguccuuucuucugcucugugggagaucuugcagcaucacguauaaaggaguuuacgaacugcagacccuggagcucgacauggcgaaccugaauaugacaaugccucuuuccuguaccaagaacaauucucaucacuauaucauggugggcaacgaaacagggcuggagcucacccugacaaauaccagcauuaucaaccauaaauucugcaaucuuuccgaugcucacaagaaaaaccuguacgaccaugcccucaugucuauuaucagcacguuucaccuguccauuccgaauuucaaccaguaugaggccaugagcugugauuuuaauggaggcaagaucucuguccaguacaaccugucccacaccuaugcuggcgacgccgcugaucauugcgggacaauugccaauggagugcuccaaaccuucaugcggauggcguggggcgggagcuacaucgcccuggacucuggaaagggcuccugggauuguaucaugacaagcuaccaguaucuuauuauccagaacaccacgugggaagaccacugccaguuuucucgccccuccccuaugggguaccugggacuccugagccaaagaacacgggauauuuauaucucccgcagacuucugggcaccuucacauggacccucucugacagcgagggcaacgaaacccccgggggauacugucugacacgguggaugcugauugaggcugagcucaaaugcuuuggcaauacggccguugcuaaguguaacgaaaaacaugaugaggaguucugcgacaugcugcgccuuuuugauuucaauaagcaggccaucagacggcugaaaaccgaagcgcagauguccauccagcucauuaacaaggccgugaaugcucugaucaacgaccaacuuauuaugaagaaucaucugcgcgacaucauggggauuccuuauugcaacuacagcaaauauugguaccucaaucacacaaucaccggaaagacaucucugcccagauguuggcuggucuccaacggcagcuaccucaaugaaacccacuucucugaugacaucgagcagcaggccgauaacaugauuacggagcugcuucaaaaagaauauaucgaccggcaggggaagacaccucugggacucguggaucuguuuguguucagcaccuccuuuuaccugauuucuaucuuccuucaccucgucaaaauuccgacccaucgccacaucacaggcaagcccugcccuaaaccccauagacugaaucacaugggcauuuguagcugcgggcuguauaagcacccuggaguucccgugcgguggaagcgcuga

SEQ ID NO: 2393 - RNA, 1473 nt, Artificial Sequence
  derived and/or modified CDS sequence (opt5) from Lassa virus__AIT17666__GPC
augggccagaucgugaccuucuuucaagaggucccccacguuauugaagaggugaugaacaucgugcugauugcccucagccugcuugcuauccugaaggggauuuacaaugucgccacaugcggacucuucggccugguguccuuucuucugcucugugggagaucuugcagcacgaccuauaaaggaguuuacgaacugcagacacuggagcucgacauggcgucccugaacaugaccaugccucuuucuuguacaaagaauaacagccaucacuauaucauggugggcaaugaaaccgggcuggagcucacacugaccaacacguccaucauuaaucauaaauucugcaaccuuucugaugcucacaagaaaaaucuguacgaccaugcccucaugagcaucauuuccaccuuucaccugagcaucccgaacuucaaucaguaugaggccaugucuugugauuuuaacggaggcaagauuuccguccaguacaaucugagccacacauaugcuguggacgccgcuaaccauugcggcaccaucgccaaugggguucuccaaacauucaugcggauggcguggggaggcucuuacauugcccuggauuccgggaagggaagcugggacuguaucaugaccucuuaccaguaucuuaucauucagaacacgacaugggaagaucacugccaguuuucccgccccagcccuaucggcuaccuggggcuccugucccaaagaacccgggacauuuauaucucucgcagacuucugggaacauucaccuggacccucagcgauuccgagggcaacgaaacacccggcggguacugucugacgcgguggaugcugauugaggcugagcucaaaugcuuuggaaauaccgccguggcuaaguguaacgaaaaacaugacgaggaguucugcgauaugcugcgccuuuuugacuucaauaagcaggccaucagacggcugaaaacagaagcgcagaugagcauccagcucauuaacaaggccgucaaugcucugaucaacgaucaacuuauuaugaagaaucaucugcgcgacaucaugggcauuccuuauugcaacuacucuaaauauugguaccucaaucacaccgugacagggaagaccucccugcccagauguuggcuggugagcaacggaucuuaccucaaugaaacgcacuucagcgacgauaucgagcagcaggccgacaacaugaucacagagcugcuucaaaaagaauauauggaucggcagggcaagaccccucuggggcucgucgaccuguuuguuuucuccaccucuuuuuaccugauuagcaucuuccuucaccucgugaaaauuccgacacaucgccacaucaccggaaagcccugcccuaaaccccauagacugaaucacaugggcauuuguuccugcggccuguauaagcacccuggggugcccgucaaguggaaacgguga

SEQ ID NO: 2394 - RNA, 1473 nt, Artificial Sequence
  derived and/or modified CDS sequence (opt5) from Lassa virus__AIT17670__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggaagggaagcugggacuguaucaugaccucuuaccaguaucuuauuauccagaacacgacaugggaagaucacugccaguuuucccgccccagcccuauuggcuaccuggggcuccugucccaaagaacccgggacaucuauauuucucgcagacuucugggaacauucaccuggacccucagcgauuccgagggcaacgaaacacccggcggguacugucugacgcgguggaugcugaucgaggcugagcucaaaugcuuuggaaauaccgccguugcuaaguguaacgaaaaacaugacgaggaguucugcgauaugcugcgccuuuuugacuucaauaagcaggccaucagacggcugaaagcggaagcccagaugagcauucagcucaucaacaaggcugugaaugcccugauuaacgaucaacuuaucaugaagaaucaucugcgcgacauuaugggcaucccuuauugcaacuacucuaaauauugguaccucaaucacacagucaccgggagaacaucccugccccgguguuggcuggugagcaacggaucuuaccucaaugaaacccacuucagcgacgauaucgagcagcaggcugacaacaugauuacggagcugcuucaaaaggaauauaucgaucgccagggcaaaacaccucuggggcucguggaccuguuugucuucuccaccucuuuuuaccugauuagcaucuuccuucaccucguuaagauuccgacccauagacacaucauuggaaaacccugcccuaagccccaucggcugaaucacaugggcaucuguuccugcggccuguauaaacacccuggggugcccgugaaguggaagcgcuga

SEQ ID NO: 2395 - RNA, 1473 nt, Artificial Sequence
  derived and/or modified CDS sequence (opt5) from Lassa virus__AIT17674__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacaugaccaaccugaauaugacaaugccucuuuccuguaccaagaacaauucucaucacuauaucaugguuggcaacgaaacagggcuggagcucacccugacgaauaccagcauuaucaaccauaaauucugcaaucuuuccgaugcgcacaagaaaaaccuguacaaucaugcucucaugucuauuaucagcacauuucaccuguccauuccgaacuucaaucaguaugaggccaugagcugugacuuuaacggaggcaagaucucugugcaguacaaucugucccacagcuaugccgucgaugcugccaaccauugcggcaccauugcuaacggggugcuccaaacauucaugcggauggccuggggaggcucuuacaucgcgcuggacuccgggaagggaaauugggauuguaucaugaccagcuaccaguaucuuauuauccagaacacgacaugggaagaccacugccaguuuucucgccccuccccuauuggcuaccuggggcuccugagccaaagaacccgggauaucuauauuucccgcagacuucugggaacauucaccuggacccucucugacagcgagggcaaugaaacacccggcggguacugucugacgcgguggaugcugaucgaggccgagcucaaaugcuuuggaaacaccgcuguugccaaguguaaugaaaaacaugaugaggaguucugcgacaugcugcgccuuuuugauuucaacaagcaggcuaucagacggcugaaaacagaagcccaggcgaauauucagcucaucaacaaggccgugaaugcucugauuaacgaccaacuuaucaugaagaaucaucugcgcgauauuaugggcaucccuuauugcaacuacuccaaauauugguaccucaaucacaccgucacagggaagaccagccugcccagauguuggcuggugucuaacggauccuaccucaaugaaacgcacuucagcgacgacaucgagcagcaggccgauaacaugauuacagagcugcuucaaaaagaauauauggaccggcagggcaagaccccucuggggcucguggaucuguuugucuucucuaccagcuuuuaccugaucuccauuuuccuucaccucguuaaaaucccgacacaucgccacgugauuggaaagcccugcccuaaaccccauagacugaaccacaugggcaucuguucuugcggccuguauaagcacccuggggugcccgucaaguggaaacgguga

SEQ ID NO: 2396 - RNA, 1473 nt, Artificial Sequence
  derived and/or modified CDS sequence (opt5) from Lassa virus__AIT17678__GPC
augggccagaucauuaccuucuuucaagaggugccccacgucaucgaagagguuaugaacauugugcugaucacacucagccugcuugccauucugaaggggaucuacaauaucgcuacgugcggacucuucggccugguguccuuucuucugcucugugggagaucuugcagcaccacauauaaaggagucuacgaacugcagacccuggagcucgacaugacaucccugaacaugaccaugccucuuucuuguacaaagaauaacagccaucacuauauuauggugggcaaugaaaccgggcuggagcucacgcugaccaacacauccaucauuaaucauaaauucugcaaccuuucugaugcccacaagaaaaaucuguacgaccaugcgcucaugagcaucauuuccaccuuucaccugagcaucccgaacuucaaucaguaugaggcuaugucuugugauuuuaacggaggcaagauuuccguucaguacaaucugagccacacauaugccguggacgccgcuaaccauugcggcaccaucgccaaugggguccuccaaacguucaugcggauggcuuggggaggcucuuacaucgcccuggauuccgggaagggaagcugggacuguauuaugacaucuuaccaguaucuuaucauucagaacaccacaugggaagaucacugccaguuuucccgccccagcccuaucggcuaccuggggcuccugucccaaagaacccgggacauuuauaucucucgcagacuucugggaaccuucacauggacgcucagcgauuccgagggcaacgaaacccccggcggguacugucugacacgguggaugcugaucgaggcggagcucaaaugcuuuggaaauaccgccguggcuaaguguaacgaaaaacaugacgaggaguucugcgauaugcugcgccuuuuugacuucaauaagcaggccauuagacggcugaaaacagaagcucagaugagcauccagcucauuaacaaggccguuaaugcgcugaucaacgaucaacuuauuaugaagaaucaucugcgcgacaucaugggcaucccuuauugcaacuacucuaaauauugguaccucaaucacaccgugacggggaagacaucccugcccagauguuggcuggucagcaacggaucuuaccucaaugaaacccacuucagcgacgauauugagcagcaggccgacaacaugaucaccgagcugcuucaaaaagaauauauugaucggcagggcaagacaccucuggggcucguggaccuguuuguguucuccaccucuuuuuaccugaucagcauuuuccuucaccucgucaaaaucccgacacaucgccacauuaucggaaagcccugcccuaaaccccauagacugaaucacaugggcaucuguuccugcggccuguauaagcacccugggauucccguuaaguggaaacgguga

SEQ ID NO: 2397 - RNA, 1473 nt, Artificial Sequence
  derived and/or modified CDS sequence (opt5) from Lassa virus__AIT17686__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauucccgcaaggggagcugggacuguaucaugaccucuuaccaguaucuuauuauccagaacacgacaugggaagaucacugccaguuuuccagacccagcccuauuggauaccugggccuccugucccaacggacccgcgacaucuauauuucuagacggcuucuggggacauucaccuggacccucagcgauuccgagggaaacgaaacacccggcggcuacugucugacgcgcuggaugcugaucgaggcugagcucaaaugcuuugggaauaccgccguugcuaaguguaacgaaaaacaugacgaggaguucugcgauaugcugagacuuuuugacuucaauaagcaggccauccggcgccugaaaacagaagcgcagaugagcauucagcucaucaacaaggccgugaaugcucugauuaacgaucaacuuaucaugaagaaucaccugagagacauuaugggaaucccuuauugcaacuacucuaaauauugguaccucaaucacaccgucacaggcaagaccucccugccccgguguuggcuggugagcaacgggucuuaccucaaugaaacgcauuucagcgacgauaucgagcagcaggccgacaacaugauuacagagcugcuucaaaaagaauauauggaucgccagggaaagaccccucugggccucguggaccuguuugucuucuccaccucuuuuuaccugaucagcauuuuccuucaccucaucaaaauuccgacacauagacacguuaucgggaagcccugcccuaaaccccaucggcugaaucacaugggaauuuguuccugcggccuguauaagcacccuggcgugcccgugaaguggaaacgcuga

SEQ ID NO: 2398 - RNA, 1473 nt, Artificial Sequence
  derived and/or modified CDS sequence (opt5) from Lassa virus__AIT17690__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacgcuuaugccgucgacgcugccucucauugcggcacaguggcgaacgggguucuccaaaccuucaugcggauggccuggggaggcuccuacauugcucuggauagcgggaagggaucuugggacuguaucaugacauccuaccaguaucuuaucauucagaauaccacgugggaagaucacugccaguuuagccgccccuccccuaucggcuaccuggggcuccugucucaaagaacacgggacauuuauaucagccgcagacuucugggaaccuucacauggacccucuccgauagcgagggcaacgaaacccccggcggguacugucugacacgguggaugcugauugaggccgagcucaaaugcuuuggaaacacggcuguggccaaguguaaugaaaaacaugacgaggaguucugcgauaugcugcgccuuuuugacuucaacaagcaggcgaucagacggcugaaaaccgaagcccagaugucuauccagcucauuaauaaggcugucaacgcccugaucaaugaucaacuuauuaugaagaaccaucugcgcgacaucaugggcauuccuuauugcaauuacuccaaauauugguaccucaaccacacagugaccgggagaacaagccugccccgguguuggcuggugucuaauggaagcuaccucaacgaaacccacuucuccgacgauaucgagcagcaggcugacaauaugaucacggagcugcuucaaaaggaauauauggaucgccagggcaaaacaccucuggggcucgucgaccuguuuguuuucucuaccagcuuuuaccugauuuccaucuuccuucaccucgugaagauuccgacccauagacacgugaucggaaaacccugcccuaagccccaucggcugaaccacaugggcauuuguagcugcggccuguauaaacacccugggguccccgugaaguggaagcgcuga

SEQ ID NO: 2399 - RNA, 1473 nt, Artificial Sequence
  derived and/or modified CDS sequence (opt5) from Lassa virus__AIT17694__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaucuauaaaggaguguacgaacugcagacccuggagcucgacauggcgucccugaacaugacaaugccucuuucuuguaccaagaauaacagccaucacuauauuaugguuggcaaugaaacagggcuggagcucacccugacaaacaccuccaucauuaaucauaaauucugcaaccuuucugaugcucacaagaaaaaucuguacgaccaugcccucaugagcaucauuuccacguuucaccugagcaucccgaacuucaaucaguaugaggccaugucuugugauuuuaacggaggcaagauuuccgugcaguacaaucugagccacaccuaugcugucgacgccgcuaaccauugcggcacaaucgccaauggggugcuccaaaccuucaugcggauggcguggggaggcucuuacaucgcccuggauuccgggaagggaagcugggacuguauuaugacaucuuaccaguaucuuaucauucagaacaccacgugggaagaucacugccaguuuucccgccccagcccuaucggcuaccuggggcuccugucccaaagaacacgggacauuuauaucucucgcagacuucugggaaccuucacauggacccucagcgauuccgagggcaacgaaacccccggcggguacugucugacacgguggaugcugaucgaggcugagcucaaaugcuuuggaaauacggccguugcuaaguguaacgaaaaacaugacgaggaguucugcgauaugcugcgccuuuuugacuucaauaagcaggccauuagacggcugaaaaccgaagcgcagaugagcauccagcucauuaacaaggccgugaaugcucugaucaacgaucaacuuauuaugaagaaucaucugcgcgacaucaugggcaucccuuauugcaacuacucuaaauauugguaccucaaucacacagucaccgggaagacaucccugcccagauguuggcuggugagcaacggaucuuaccucaaugaaacccacuucagcgacgauauugagcagcaggccgacaacaugaucacggagcugcuucaaaaagaauauauugaucggcagggcaagacaccucuggggcucguggaccuguuugucuucuccaccucuuuuuaccugaucagcauuuuccuucaccucguuaaaaucccgacccaucgccacguggugggaaagcccugcccuaaaccccauagacugaaucacaugggcauuuguuccugcggccuguauaagcacccugggguccccgugaaguggaaacgguga

SEQ ID NO: 2400 - RNA, 1473 nt, Artificial Sequence
  derived and/or modified CDS sequence (opt5) from Lassa virus__AIT17712__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggaagggagcuugggacuguaucaugaccagcuaccaguaucuuauuauccagaacacgacaugggaagaucacugccaguuuucucgccccuccccuauuggcuaccuggggcuccugagccaaagaacccgggacaucuauauuucccgcagacuucugggaacauucaccuggacccucucugauagcgagggcaacgaaacacccggcggguacugucugacgcgguggaugcugaucgaggccgagcucaaaugcuuuggaaauaccgcuguugccaaguguaacgaaaaacaugacgaggaguucugcgauaugcugcgccuuuuugacuucaauaagcaggcgaucaugagacugaaaacagaagcccagauguccauucagcucaucaacaaggcugugaaugcccugauuaacgaucaacuuaucaugaagaaucaucugcgggacauuaugggcaucccuuauugcaacuacagcaaauauugguaccucaaucacaccgucacagggaagaccucucugccccgcuguuggcugguguccaacggaagcuaccucaaugaaacgcacuucucugacgauaucgagcagcaggcugacaacaugauuacagagaugcugcaaaaagaauauaucgauagacagggcaagaccccucuugggcugguggaccucuuugucuucagcaccuccuuuuaccugauuucuaucuuccugcaccuuguuaaaauuccgacacaucggcacgugaucggaaagcccugcccuaaaccccaucgccucaaucacaugggcauuuguagcugcggccuguauaagcacccuggggugcccgucagauggaagcgguga

SEQ ID NO: 2401 - RNA, 1473 nt, Artificial Sequence
  derived and/or modified CDS sequence (opt5) from Lassa virus__AIT17718__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauauccggguuggcaaugaaaccgggcuggagcucacacugaccaacgcuuccauuaucaaucauaaauucugcaaccuuucugaugcccacaagaaaaaucuguacgaccaugcccucaugagcauuaucuccacguuucaccugagcauuccgaacuucaaucaguaugaggcuaugucuugugauuuuaacggaggcaagaucuccgugcaguacaaucugagccacgccuaugcuauugacgccgcgaaccauugcggcaccgucgccaauggggugcuccaaacauucaugcgcauggcuuggggaggcucuuacaucgcccuggauuccgggagaggaaacugggacuguaucaugaccagcuaccaguaucuuauuauccagaacacaaccugggaagaucacugccaguuuucucggcccuccccuauuggcuaccuggggcuccugagccaacgcacgagagacaucuauauuucccggcgccuucugggaacauucaccuggacacucucugauagcgagggcaaugaaacccccggcggguacugucugaccagauggaugcugaucgaggcugagcucaagugcuuuggaaacacagccguugcgaaauguaaugaaaagcaugacgaggaguucugcgauaugcugcggcuuuuugacuucaacaaacaggccauccgcagacugaagacggaagcucagauguccauucagcucaucaauaaagccgugaacgcucugauuaaugaucaacuuaucaugaagaaccaucugcgggacauuaugggcaucccuuauugcaauuacagcaaguauugguaccucaaccacaccgucacagggaaaaccucucugccccgcuguuggcugguguccaauggaagcuaccucaacgaaacacacuucucugacgauaucgagcagcaggccgacaauaugauuaccgagcugcuucaaaaggaauauauggauagacagggcaaaacgccucuggggcucguggaccuguuugucuucagcacauccuuuuaccugaucucuauuuuccuucaccucguuaagaucccgacccaucggcacgugauuggaaaacccugcccuaagccccaucgccugaaccacaugggcaucuguagcugcggcuuuuauaaacacccuggggugcccgucaaguggaagagauga

SEQ ID NO: 2402 - RNA, 1473 nt, Artificial Sequence
  derived and/or modified CDS sequence (opt5) from Lassa virus__AIT17724__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgaaccugaauaugaccaugccucuuuccuguacaaagaacaauucucaucacuauaucaugguuggcaacgaaaccgggcuggagcucacacugaccaauacgagcauuaucaaccauaaauucugcaaucuuuccgaugcucacaagaaaaaccuguacgaccaugcccucaugucuauuaucagcaccuuucaccuguccauuccgaauuucaaccaguaugaggccaugagcugugauuuuaauggaggcaagaucucugugcaguacaaccugucccacacauaugcugucgacgccgcuaaucauugcggcaccguggccaacgggguucuccaaacauucaugcggauggcguggggaggcagcuacauugcccuggauucugggaagggauccugggacuguaucaugaccagcuaccaguaucuuaucauucagaacacgacaugggaagaucacugccaguuuucucgccccuccccuaucggcuaccuggggcuccugagccaaagaacccgggacauuuauaucucccgcagacuucugggaacauucaccuggacccucucugauagcgagggcaaugaaacacccggcggguacugucugacgcgguggaugcugauugaggcugagcucaaaugcuuuggaaacaccgccguggcuaaguguaaugaaaaacaugacgaggaguucugcgauaugcugcgccuuuuugacuucaacaagcaggccaucagacggcugaaaacagaagcgcagauguccauccagcucauuaauaaggccgucaacgcucugaucaaugaucaacuuauuaugaagaaccaucugcgcgacaucaugggcauuccuuauugcaauuacagcaaauauugguaccucaaccacaccgugacagggaagaccucucugcccagauguuggcugguguccaauggaagcuaccucaacgaaacgcacuucucugacgauaucgagcagcaggccgacaauaugaucacagagcugcuucaaaaagaauauauggaucggcagggcaagaccccucuggggcucgucgaccuguuuguuuucagcaccuccuuuuaccugauuucuaucuuccuucaccucgugaaaauuccgacacaucgccacaucaugggaaagcccugcccuaaaccccauagacugaaccacaugggcauuuguagcugcggccuguauaagcacccuggggugcccgucaaguggaaacgguga

SEQ ID NO: 2403 - RNA, 1473 nt, Artificial Sequence
  derived and/or modified CDS sequence (opt5) from Lassa virus__AIT17728__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacaugggcucccugaacaugaccaugccucuuucuuguacaaagaauaacagccaucacuauaucaugguugggaaugaaaccggacuggagcucacacugaccaacacguccauuaucaaucauaaauucugcaaccuuucugaugcgcacaagaaaaaucuguacgaccaugcucucaugagcauuaucuccaccuuucaccugagcauuccgaacuucaaucaguaugaggccaugucuugugauuuuaacggcggcaagaucuccgugcaguacaaucugagccacacauaugccgucgacgcugccaaccauugcgggaccauugcuaauggagugcuccaaacauucaugcggauggccuggggcgggucuuacaucgcgcuggauuccggaaagggcagcugggacuguaucaugaccucuuaccaguaucuuauuauccagaacacgacaugggaagaucacugccaguuuucccgccccagcccuauuggguaccugggacuccugucccaaagaacccgggacaucuauauuucucgcagacuucugggcacauucaccuggacccucagcgauuccgagggcaacgaaacacccgggggauacugucugacgcgguggaugcugaucgaggccgagcucaaaugcuuuggcaauaccgcuguugccaaguguaacgaaaaacaugacgaggaguucugcgauaugcugcgccuuuuugacuucaauaagcaggcuaucagacggcugaaaacagaagcccagaugagcauucagcucaucaacaaggcggugaaugcccugauuaacgaucaacuuaucaugaagaaucaucugcgcgacauuauggggaucccuuauugcaacuacucuaaauauugguaccucaaucacaccgucacaggaaagaccucccugcccagauguuggcuggugagcaacggcucuuaccucaaugaaacgcacuucagcgacgauaucgagcagcaggcugacaacaugauuacagagcugcuucaaaaagaauauauggaucggcaggggaagaccccucugggacucguggaccuguuugucuucuccaccucuuuuuaccugaucagcauuuuccuucaccucguuaaaaucccgacacaucgccacgugauuggcaagcccugcccuaaaccccauagacugaaucacaugggcaucuguuccugcgggcuguauaagcacccuggagugcccgucaaguggaaacgguga

SEQ ID NO: 2404 - RNA, 1473 nt, Artificial Sequence
  derived and/or modified CDS sequence (opt5) from Lassa virus__AIT17732__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggaagggaagcugggacuguaucaugaccucuuaccaguaucuuauuauccagaacacgacaugggaagaucacugccaguuuucccgccccagcccuauuggcuaccuggggcuccugucccaaagaacccgggacaucuauauuucucgcagacuucugggaacauucaccuggacccucagcgauuccgagggcaacgaaacacccggcggguacugucugacgcgguggaugcugaucgaggcugagcucaaaugcuuuggaaauaccgccguugcuaaguguaacgaaaaacaugacgaggaguucugcgauaugcugcgccuuuuugacuucaauaagcaggccaucagacggcugaaaacagaagcgcagaugagcauucagcucaucaacaaggccgugaaugcucugauuaacgaucaacuuaucaugaagaaucaucugcgcgacauuaugggcaucccuuauugcaacuacucuaaauauugguaccucaaucacaccgucacagggaagaccucccugcccagauguuggcuggugagcaacggaucuuaccucaaugaaacgcacuucagcgacgauaucgagcagcaggccgacaacaugauuacagagcugcuucaaaaagaauauaucgaucggcagggcaagaccccucuggggcucguggaccuguuugucuucuccaccucuuuuuaccugauuagcaucuuccuucaccucguuaaaauuccgacacaucgccacaucgugggaaagcccugcccuaaaccccauagacugaaucacaugggcauuuguuccugcggccuguauaagcacccuggggugcccgucaaguggaaacgguga

SEQ ID NO: 2405 - RNA, 1473 nt, Artificial Sequence
  derived and/or modified CDS sequence (opt5) from Lassa virus__AIT17736__GPC
augggccagaucgugaccuucuuucaagaggucccccacguuauugaagaggugaugaacaucgugcugauugcccucagccugcuugcuauccugaaggggauuuacaaugucgccacaugcggacucuucggccugguguccuuucuucugcucugugggagaucuugcagcacgaccuauaaaggaguuuacgaacugcagacacuggagcucgacauggcgucccugaacaugaccaugccucuuucuuguacaaagaauaacagccaucacuauaucauggugggcaaugaaaccgggcuggagcucacacugaccaacacguccaucauuaaucauaaauucugcaaccuuucugaugcucacaagaaagaccuguacgaucaugcccucaugagcaucauuuccaccuuucaccugagcaucccgaauuucaaccaguaugaggccaugucuugugacuuuaauggaggcaagauuuccguccaguacaaccugagccacacauaugcuguggaugccgcuaaucauugcggcaccaucgccaacgggguucuccaaacauucaugcggauggcguggggaggcucuuacauugcccuggacuccgggaagggaagcugggauuguaucaugaccucuuaccaguaucuuaucauucagaauacgacaugggaagaccacugccaguuuucccgccccagcccuaucggcuaccuggggcuccugucccaaagaacccgggauauuuauaucucucgcagacuucugggaacauucaccuggacccucagcgacuccgagggcaacgaaacacccggcggguacugucugacgcgguggaugcugauugaggcugagcucaaaugcuuuggaaacaccgccguggcuaaguguaaugaaaaacaugaugaggaguucugcgacaugcugcgccuuuuugauuucaacaagcaggccaucaugagacugaaaacagaagcgcagaugagcauccagcucauuaauaaggccgucaacgcucugaucaaugaccaacuuauuaugaagaaccaucugcgggacaucaugggcauuccuuauugcaauuacucuaaauauugguaccucaaccacaccgugacagggaagaccucccugccccgcuguuggcuggugagcaauggaucuuaccucaacgaaacgagauucagcgaugacaucgagcagcaggccgauaauaugaucacagagaugcugcaaaaagaauaucuugaccggcagggcaagaccccucuggggcucgucgaucuguuuguuuucuccaccucuuuuuaccugauuagcaucuuccuucaccucgugaaaauuccgacacaccgccauaucauuggaaagcccugcccuaaaccccacagacugaaccauaugggcaucuguuccugcggccuguauaagcacccuggggugcccgucaaguggaaacgguga

SEQ ID NO: 2406 - RNA, 1473 nt, Artificial Sequence
  derived and/or modified CDS sequence (opt5) from Lassa virus__AIT17744__GPC
augggccagaucauuaccuucuuucaagaggugccccacgucaucgaagagguuaugaacauugugcugaucgcccucagccugcuugcuauucugaaggggaucuacaauguggccacaugcggacucuucggccugauguccuuucuucugcucugugggagaucuugcagcacgaccuauaaaggagucuacgaacugcagacacuggagcucgacauggcgaaccugaauaugaccaugccucuuuccuguacaaagaacaauucucaucacuauaucauggugggcaacgaaaccgggcuggagcucacacugaccaauacgagcauuaucaaccauaaauucugcaaucuuuccgaugcucacaagaaaaaccuguacgaccaugcccucaugucuauuaucagcaccuuucaccuguccauuccgaauuucaaccaguaugaggccaugagcugugauuuuaauggaggcaagaucucuguucaguacaaccugucccacgcuuaugccguggacgcugccaaucauugcggcacaauugcgaacgggguccuccaaaccuucaugcggauggccuggggaggcagcuacaucgcucuggauucugggaagggauccugggacuguaucaugacaagcuaccaguaucuuauuauccagaacaccucuugggaagaucacugccaguuuucccgccccagcccuauuggcuaccuggggcuccugucccaaagaacgcgggacaucuauauuucucgcagacuucugggaacauucaccuggacacucagcgauuccgagggcaaugaaacccccggcggguacugucugacccgguggaugcugaucgaggccgagcucaaaugcuuuggaaacacagcuguggccaaguguaaugaaaaacaugacgaggaguucugcgauaugcugcgccuuuuugacuucaacaagcaggcgaucagacggcugaaaacggaagcccagaugagcauucagcucaucaauaaggcuguuaacgcccugauuaaugaucaacuuaucaugaagaaccaucugcgcgacauuaugggcaucccuuauugcaauuacucuaaauauugguaccucaaccacaccgugacagggaagaccucccugcccagauguuggcuggucagcaauggaucuuaccucaacgaaacacacuucagcgacgauaucgagcagcaggcugacaauaugauuaccgagcugcuucaaaaagaauauaucgaucggcagggcaagacgccucuggggcucguggaccuguuuguguucuccacaucuuuuuaccugauuagcaucuuccuucaccucgucaaaauuccgacccaucgccacguuaucggaaagcccugcccuaaaccccauagacugaaccacaugggcauuuguuccugcggccuguauaagcacccuggggugcccgugaaguggaaacgguga

SEQ ID NO: 2407 - RNA, 1473 nt, Artificial Sequence
  derived and/or modified CDS sequence (opt5) from Lassa virus__AIT17752__GPC
augggccagaucauuaccuucuuucacgaggugccccaugucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcaaacacuggagcucgacauggcgucccugaacaugaccaugccucuuucuuguacaaagaauaacagccaccauuauaucaugguuggcaaugaaaccgggcuggagcucacacugaccaacacguccauuaucaaucacaaauucugcaaccuuucugaugcucauaagaaaaaucuguacgaccacgcccucaugagcauuaucuccaccuuucaccugagcauuccgaacuucaaucaguaugaggccaugucuugugauuuuaacggaggcaagaucuccgugcaguacaaucugagccauacauaugcuauugacgccgcuaaccacugcggcaccaucgccaaugggguccuccagacauucaugcggauggcguggggaggcucuuacaucgcccuggauuccgggcgcggaagcugggacuguauuaugaccucuuaccaauaucuuaucauucagaacacgacaugggaagaucauugccaguuuuccagacccagcccuaucggcuaccuggggcuccugucccagcggacccgcgacauuuauaucucuagacggcuucugggaacauucaccuggacccucagcgauuccgagggcaacgaaacacccggcggguacugucugacgcgcuggaugcugaucgaggcugagcucaagugcuuuggaaauaccgccguggcuaaauguaacgaaaagcacgacgaggaguucugcgauaugcugagacuuuuugacuucaauaaacaagccauucggcgccugaagacagaagcgcagaugagcauccagcucauuaacaaagccguuaaugcucugaucaacgaucagcuuauuaugaagaaucaccugagagacaucaugggcaucccuuauugcaacuacucuaaguauugguaccucaaucauaccgugacagggaaaaccucccugccccgguguuggcuggucagcaacggaucuuaccucaaugaaacgcacuucagcgacgauauugagcaacaggccgacaacaugaucacagagcugcuucagaaggaauauauugaucgccaaggcaaaaccccucuggggcucguggaccuguuuguguucuccaccucuuuuuaccugaucagcauuuuccuucaucucgucaagaucccgacacacagacauguuauuggaaaacccugcccuaagccccaccggcugaaucacaugggcaucuguuccugcggccuguauaaacauccuggggugcccgugaaguggaagcgcuga

SEQ ID NO: 2408 - RNA, 1473 nt, Artificial Sequence
  derived and/or modified CDS sequence (opt5) from Lassa virus__AIT17756__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcaucacguauaaaggaguguacgaacugcagacccuggagcucgacauggcgucccugaacaugacaaugccucuuucuuguaccaagaauaacagccaucacuauauuaugguuggcaaugaaacagggcuggagcucacccugacaaacaccuccaucauuaaucauaaauucugcaaccuuucugaugcucacaagaaaaaucuguacgaccaugcccucaugagcaucauuuccacguuucaccugagcaucccgaacuucaaucaguaugaggccaugucuugugauuuuaacggaggcaagauuuccgugcaguacaaucugagccacaccuaugcugucgacgccgcuaaccauugcggcacaaucgccaauggggugcuccaaaccuucaugcggauggcguggggaggcucuuacaucgcccuggauuccgggcgcggaagcugggacuguauuaugacaucuuaccaguaucuuaucauucagaacaccacgugggaagaucacugccaguuuuccagacccagcccuaucggcuaccuggggcuccugucccaacggacacgcgacauuuauaucucuagacggcuucugggaaccuucacauggacccucagcgauuccgagggcaacgaaacccccggcggguacugucugacacgcuggaugcugaucgaggcugagcucaagugcuuuggaaauacggccguugcuaaauguaacgaaaagcaugacgaggaguucugcgauaugcugagacuuuuugacuucaauaaacaggccauucggcgccugaaggcggaagcccagaugagcauccagcucauuaacaaagcugugaaugcccugaucaacgaucaacuuauuaugaagaaucaccugagagacaucaugggcaucccuuauugcaacuacucuaaguauugguaccucaaucacaccgucacagggcggaccucccugccccgcuguuggcuggugagcaacggaucuuaccucaaugaaacacauuucagcgacgauauugagcagcaggcugacaacaugaucaccgagcugcuucaaaaagaauauauugauagacagggcaagacgccucuggggcucguggaccuguuugucuucuccacaucuuuuuaccugaucagcauuuuccuucaccucguuaaaaucccgacccaucggcacauuaucggaaagcccugcccuaaaccccaucgccugaaucacaugggcaucuguuccugcggccuguauaagcacccuggggugcccgugaaauggaagagauga

SEQ ID NO: 2409 - RNA, 1473 nt, Artificial Sequence
  derived and/or modified CDS sequence (opt5) from Lassa virus__AIT17758__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucaacauggcgucccugaauaugaccaugccucuuucuuguacaaagaacaauagccaucacuauaucaugguuggcaacgaaaccgggcuggagcucacacugaccaauacguccauuaucaaccauaaauucugcaaucuuucugacgcucacaagcggaaccuguacgaucaugcccucaugagcauuaucuccaccuuucaccugagcauuccgaauuucaaccaguaugaggccaugucuugugacuuuaauggaggcaaaaucuccgugcaguacaaccugagccacacauaugcugucgaugccgcuaagcauugcggcaccauugccaauggggugcuccaaacauucaugcgcauggcguggggaggcucuuacaucgcccuggacuccgggaagggaagcugggauuguaucaugaccucuuaccaguaucuuauuauccagaacacgacaugggaagaccacugcgaguuuuccagacccagcccuauuggcuaccuggggcuccugucccagcggacccgcgauaucuauauuucuagacggcuucugggaacauucaccuggacccucagcgacuccgaaggcaacgagacacccggcggguacugucugacgcgcuggaugcugaucgaggcugaacucaaaugcuuuggaaauaccgccguugcuaaguguaacgagaaacaugaugaagaguucugcgacaugcugagacuuuuugauuucaauaagcaagccauccggcgccugaaagcggaagcccagaugagcauucagcucaucaacaaggcugugaaugcccugauuaacgaccagcuuaucaugaagaaucaccugagagauauuaugggcaucccuuauugcaacuacucuaaauauugguaccucaaucacacagucaccgggaagacaucccugccccgguguuggcuggugagcaacggaucuuaccucaaugagacccauuucagcgacgacaucgagcaacaggcugauaacaugauuacggaacugcuucagaaagaguauaucgaccgccaaggcaagacaccucuggggcucguggaucuguuugucuucuccaccucuuuuuaccugauuagcaucuuccuucaccucguuaaaauuccgacccauagacacgugaucggaaagcccugcccuaaaccccaucggcugaaucacaugggcauuuguuccugcggccuguauaagcacccuggggugcccgucaaguggaaacgcuga

SEQ ID NO: 2410 - RNA, 1473 nt, Artificial Sequence
  derived and/or modified CDS sequence (opt5) from Lassa virus__AIT17762__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucucucauaaauucugcaaucuuagcgaugcucacaagaaaaaccuguacgaccaugcccucauguccauuaucagcaccuuucaccugucuauuccgaauuucaaccaguaugaggccauguccugugauuuuaauggaggcaagaucagcgugcaguacaaccugucucacacauaugcugucgacgccgcuaaucauugcggcaccauugccaacggggugcuccaaacauucaugcggauggcguggggaggcuccuacaucgcccuggauagcgggaagggaucuugggacuguaucaugaccuccuaccaguaucuuauuauccagaauacgacaugggaagaucacugccaguuuagccgccccuccccuauuggcuaccuggggcuccugucucaaagaacccgggacaucuauauuagccgcagacuucugggaacauucaccuggacccucuccgauagcgagggcaacgaagcucccggcggguacugucugacacgguggaugcugaucgaggccgagcucaaaugcuuuggaaacacggcuguugccaaguguaaugaaaaacaugacgaggaguucugcgauaugcugcgccuuuuugacuucaacaagcaggcgaucagacggcugaaaaccgaagcccagaugucuauucagcucaucaauaaggcugugaacgcccugauuaaugaucaacuuaucaugaagaaccaucugcgcgacauuaugggcaucccuuauugcaauuacuccagauauugguaccucaaccacacagucaccgggaaaacaagccugccccgguguuggcuggugucuaauggaagcuaccucaacgaaacccacuucuccgacgauaucgagcagcaggcugacaauaugauuacggagcugcuucaaaaggaauauauggaucgccagggcaaaacaccucuggggcucguggaccuguuugucuucucuaccagcuuuuaccugaucuccauuuuccuucaccucguuaagaucccgacccauagacacgugauuggaaaacccugcccuaagccccaucggcugaaccacaugggcaucuguagcugcggccuguauaaacacccuggggugcccgucaaguggaagcgcuga

SEQ ID NO: 2411 - RNA, 1473 nt, Artificial Sequence
  derived and/or modified CDS sequence (opt5) from Lassa virus__AIT17770__GPC
augggccagaucgugaccuucuuucaagaggucccccacguuauugaagaggugaugaacaucgugcugauugcccucagccugcuugcuauccugaaggggauuuacaaugucgccacaugcggacucuucggccugguguccuuucuucugcucugugggagaucuugcagcacgaccuauaaaggaguuuacgaacugcaggcgcuggagcucgacauguccucucugaacaugacaaugccucuuagcuguaccaagaauaacucccaucacuauaucauggugggcaaugaaacagggcuggagcucacccugacaaacaccucuaucauucaucacaaauucugcaaucuuagcgaugcucauaagaaagaccuguacgaucacgcccucauguccaucauuagcacguuucaccugucuaucccgaacuucaaucaguaugaggccauguccugugacuuuaacggaggcaagauuagcguccaguacaaucugucucauaccuaugcuguggaugccgcuaaccacugcggcacaaucgccaaugggguucuccaaaccuucaugcggauggcguggggaggcuccuacauugcccuggacagcgggaagggaggcugggauuguaucaugacaucuuaccaguuucuuaucauucagaacaccacgugggaagaccauugccaguucucccgccccagcccuaucggguaucugggacuccugucccaaagaacacgggauauuuacaucucucgcagacuucugggcaccuuuacauggacccucagcgacuccgagggcaaugaaacccccgggggauauugucugacacgguggaugcugauugaggcugagcucaaaugcuucggcaacacggccguggcuaaguguaacgaaaaacacgaugaggaauuuugcgacaugcugcgccuuuucgauuucaauaagcaggccaucaaaagacugaagaccgaggcgcagaugagcauccaccucauuaacaaggccgucaaugcucugaucaacgaccagcuuauuaugaaaaaucaucugcgggacaucauggggauuccuuacugcaacuauucuaaguacugguaucucaaucacacagugaccggaaaaacaucccugccccgcuguuggcuggugagcaacggcucuuaccucaaugaaacccauuuuagcgaugacaucgagcaacaggccgauaacaugaucacggagcugcuucagaaggaauacauugacagacaagggaaaacaccucugggacucgucgaucuguucguguuuuccaccucuuucuaucugaucagcauuuuucuucaccucguuaagaucccgacccaucggcacgugauuggcaaacccugcccuaagccccaccgccugaaucauaugggcaucuguuccugcgggcuguacaagcacccuggaguccccgugagauggaaacgguga

SEQ ID NO: 2412 - RNA, 1473 nt, Artificial Sequence
  derived and/or modified CDS sequence (opt5) from Lassa virus__AIT17778__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgaaccugaauaugaccaugccucuuuccuguacaaagaacaauucucaucacuauaucaugguuggcaacgaaaccgggcuggagcucacacugaccaauacgagcauuaucaaccauaaauucugcaaucuuuccgaugcucacaagaaaaaccuguacgaccaugcccucaugucuauuaucagcaccuuucaccuguccauuccgaauuucaaccaguaugaggccaugagcugugauuuuaauggaggcaagaucucugugcaguacaaccugucccacacauaugcucgggacgccgcuaaucauugcggcaccauugccaacgggguccuccaaacauucaugcgcauggcguggggaggcagcuacaucgcccuggauucugggaagggauccugggacuguaucaugaccagcuaccaguaucuuauuauccagaacacgacaugggaagaucacugccaguuuucuagacccuccccuauuggcuaccuggggcuccugagccaacggacccgcgacaucuauauuuccagacggcuucugggaacauucaccuggacccucucugauagcgagggcaaugaaacacccggcggguacugucugacgcgcuggaugcugaucgaggcugagcucaaaugcuuuggaaacaccgccguggcuaaguguaaugaaaaacaugacgaggaguucugcgauaugcugagacuuuuugacuucaacaagcaggccauccggcgccugaaaacagaagcgcagaugaauauucagcucaucaacaaggccguuaaugcucugauuaacgaucaacuuaucaugaagaaucaccugagagacauuaugggcaucccuuauugcaacuacuccaaauauugguaccucaaucacaccgugacagggaagaccagccugccccgguguuggcuggucucuaacggauccuaccucaaugaaacgcauuucagcgacgauaucgagcagcaggccgacaacaugauuacagagcugcuucaaaaagaauauauggaucgccagggcaagaccccucuggggcucguggaccuguuuguguucucuaccagcuuuuaccugaucuccauuuuccuucaccucgucaaaaucccgacacauagacacguuauuggaaagcccugcccuaaaccccaucggcugaaucacaugggcaucuguucuugcggccuguauaagcacccuggggugcccgugaaguggaaacgcuga

SEQ ID NO: 2413 - RNA, 1473 nt, Artificial Sequence
  derived and/or modified CDS sequence (opt5) from Lassa virus__AIT17782__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggaagggaagcugggacuguaucaugaccucuuaccaguaucuuauuauccagaacacgacaugggaagaucacugccaguuuucccgccccagcccuauuggcuaccuggggcuccugucccaaagaacccgggacaucuauauuucucgcagacuucugggaacauucaccuggacccucagcgauuccgagggcaacgaaacacccggcggguacugucugacgcgguggaugcugaucgaggcugagcucaaaugcuuuggaaauaccgccguugcuaaguguaacgaaaaacaugacgaggaguucugcgauaugcugcgccuuuuugacuucaauaagcaggccaucaaaagacugaagacagaagcgcagaugagcauucagcucaucaacaaggccgugaaugcucugauuaacgaucaacuuaucaugaaaaaucaucugcgggacauuaugggcaucccuuauugcaacuacucuaaguauugguaccucaaucacaccgucacagggaaaaccucccugccccgcuguuggcuggugagcaacggaucuuaccucaaugaaacgcacuucagcgacgauaucgagcagcaggccgacaacaugauuacagagcugcuucaaaaggaauauaucgauagacagggcaaaaccccucuggggcucguggaccuguuugucuucuccaccucuuuuuaccugauuagcaucuuccuucaccucguuaagauuccgacacaucggcacguggugggaaaacccugcccuaagccccaucgccugaaucacaugggcaucuguuccugcggccuguauaagcacccugggguccccgugaaauggaagagauga

SEQ ID NO: 2414 - RNA, 1473 nt, Artificial Sequence
  derived and/or modified CDS sequence (opt5) from Lassa virus__AIT17786__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacgcuuaugccauugacgcugccgaucauugcggcacaaucgcgaacgggguccuccaaaccuucaugcggauggccuggggaggcucuuacaucgcucuggacuccgggaagggaagcugggauuguauuaugacaucuuaccaguaucuuaucauucagaauaccacgugggaagaccacugccaguuuucccgccccagcccuaucggcuaccuggggcuccugucccaaagaacacgggauauuuauaucucucgcagacuucugggaaccuucacauggacccucagcgacuccgagggcaacgaaacccccggcggguacugucugacacgguggaugcugaucgaggccgagcucaaaugcuuuggaaacacggcuguggccaaguguaaugaaaaacaugaugaggaguucugcgacaugcugcgccuuuuugauuucaacaagcaggcgauuagacggcugaaaaccgaagcccagaugagcauccagcucauuaauaaggcuguuaacgcccugaucaaugaccaacuuauuaugaagaaccaucugcgcgacaucaugggcaucccuuauugcaauuacucuaaauauugguaccucaaccacacagugaccgggaagacaucccugcccagauguuggcuggucagcaauggaucuuaccucaacgaaacccacuucagcgaugacauugagcagcaggcugauaauaugaucacggagcugcuucaaaaagaauauauggaccggcagggcaagacaccucuggggcucguggaucuguuuguguucuccaccucuuuuuaccugauuagcaucuuccuucaccucgucaaaauuccgacccaucgccacaucacaggaaagcccugcccuaaaccccauagacugaaccacaugggcauuuguuccugcggccuguauaagcacccugggguucccgugaaguggaaacgguga

SEQ ID NO: 2415 - RNA, 1473 nt, Artificial Sequence
  derived and/or modified CDS sequence (opt5) from Lassa virus__AIT17790__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggaagggaagcugggacuguaucaugaccucuuaccaguaucuuauuauccagaacacgacaugggaagaucacugccaguuuucccgccccagcccuauuggcuaccuggggcuccugucccaaagaacccgggacaucuauauuucucgcagacuucugggaacauucaccuggacccucagcgauuccgagggcaacgaaacacccggcggguacugucugacgcgguggaugcugaucgaggcugagcucaaaugcuuuggaaauaccgccguugcuaaguguaacgaaaaacaugacgaggaguucugcgauaugcugcgccuuuuugacuucaauaagcaggccaucagacggcugaaaacagaagcgcagaugagcauucagcucaucaacaaggccgugaaugcucugauuaacgaucaacuuaucaugaagaaucaucugcgcgacauuaugggcaucccuuauugcaacuacucuaaauauugguaccucaaucacaccgucacagggaagaccucccugcccagauguuggcuggugagcaacggaucuuaccucaaugaaacgcacuucagcgacgauaucgagcagcaggccgacaacaugauuacagagcugcuucaaaaagaauauauggaucggcagggcaagaccccucuggggcucguggaccuguuugucuucuccaccucuuuuuaccugaucagcauuuuccuucaccucguuaaaaucccgacacaucgccacauuaccggaaagcccugcccuaaaccccauagacugaaucacaugggcaucuguuccugcggccuguauaagcacccuggggugcccgugaaguggaaacgguga

SEQ ID NO: 2416 - RNA, 1473 nt, Artificial Sequence
  derived and/or modified CDS sequence (opt5) from Lassa virus__AIT17798__GPC
augggccagaucauuaccuucuuucaagaggugccccacgucaucgaagagguuaugaacauugugcugaucgcccucagccugcuugcuauucugaaggggaucuacaauguggccacaugcggacucuucggccuggucuccuuucuucugcucugugggagaucuugcagcacgaccuauaaaggaguguacgaacugcagacacuggagcucgacauggcgucccugaacaugaccaugccucuuucuuguacaaagaauaacagccaucacuauaucaugguuggcaaugaaaccgggcuggagcucacacugaccaacacguccauuaucaaucauaaauucugcaaccuuucugaugcucacaagaaaaaucuguacgaccaugcccucaugagcauuaucuccaccuuucaccugagcauuccgaacuucaaucaguaugaggccaugucuugugauuuuaacggaggcaagaucuccgugcaguacaaucugagccacacauaugcugucgacgccgcuaaccauugcggcaccauugccaauggggugcuccaaacauucaugcggauggcguggggaggcucuuacaucgcccuggauuccgggaagggaagcugggacuguaucaugaccucuuaccaguaucuuauuauccagaacacgacaugggaagaucacugccaguuuucccgccccagcccuauuggcuaccuggggcuccugucccaaagaacccgggacaucuauauuucucgcagacuucugggaacauucaccuggacccucagcgauuccgagggcaacgaaacacccggcggguacugucugacgcgguggaugcugaucgaggcugagcucaaaugcuuuggaaauaccgccguugcuaaguguaacgaaaaacaugacgaggaguucugcgauaugcugcgccuuuuugacuucaauaagcaggccaucaugagacugaaaacagaagcgcagaugagcauucagcucaucaacaaggccgugaaugcucugauuaacgaucaacuuaucaugaagaaucaucugcgggacauuaugggcaucccuuauugcaacuacucuaaauauugguaccucaaucacaccgucacagggaagaccucccugccccgcuguuggcuggugagcaacggaucuuaccucaaugaaacgcacuucagcgacgauaucgagcagcaggccgacaacaugauuacagagaugcugcaaaaagaauaucuugauagacagggcaagaccccucuggggcucguggaccuguuugucuucuccaccucuuuuuaccugaucagcauuuuccuucaccucguuaaaaucccgacacaucggcacauuaucggaaagcccugcccuaaaccccaucgccugaaucacaugggcauuuguuccugcggccuguauaagcacccuggggugcccgugaaguggaaaagauga

SEQ ID NO: 2417 - RNA, 1476 nt, Artificial Sequence
  derived and/or modified CDS sequence (opt5) from Lassa virus__AIT17802__GPC
augggccagaucgugaccuucuuucaagaggucccccacguuauugaagaggugaugaacaucgugcugauugcccucagcauccuggcuguccuuaaggggcuguacaaucucgccacaugcggacuggugggccuuguuacguuccugcuccugugugggagauccugcaccacaucucuguauaaaggaguguacgaacuccagacccuggagcuuaacauggaaacacugaauaugaccaugccucucagcuguacaaagaacaauucccaucacuauauuauggucggcaacgagaccgggcuggagcuuacgcugaccaauacaucuaucaucaaccauaaauuuugcaaucucagcgacgcgcacaagaaaaaccuguacaaucaugcucugauguccauuaucucuaccuuccaccucagcauuccgaacuuuaaucaguaugaagccauguccugugauuucaacggaggcaagaucagcgugcaguacaaucugucucacuccuaugccggcgacgcugccaaccauugcgggacaguugcuaacggagugcuucaaaccuuuaugcggauggccuggggcgggagcuacauugcgcuggauucuggacgcgacagaugggauuguaucaugacguccuaccaguaucucauuauccagaauacaaccugggaggaccacugccaguucagccggcccucuccuaucggcuaccuggggcuucugucccaacgcacaagagauauuuauaucagccggcgccuccugggaaccuuuaccuggacacuguccgacucugaaggcaaggauacgcccggcggguacugucucaccagauggaugcugauugaggccgagcuuaaaugcuucggaaacacagcugucgccaaguguaaugaaaaacaugacgaggaauuuugcgauaugcugcgccucuucgacuuuaacaagcaggcuauccagcggcugaaagccgaggcgcagaugagcauucaacuuaucaauaaggccgugaacgcucugaucaaugaucagcucauuaugaagaaccaccugagagacaucaugggcauuccuuauugcaauuacuccaaauauugguaccugaaccacaccacaaccgggaagacgagccuccccaaauguuggcuggugucuaauggauccuaccuuaacgaaacacauuucagcgacgauaucgagcagcaagccgacaauaugauuaccgagaugcugcagaaggaauauauggagcggcucggcaaaaccccucuggggcuggucgaucuuuucguuuuuagcacaucuuucuaccucaucuccaucuuucugcaccuggugaagauuccgacccaucgccacaucgugggaagaucuugccccaaaccucaucggcucaaccacaugggcauuuguagcugcggccuguauaagcagcccggggucccugugaaguggaaacgcuga

SEQ ID NO: 2418 - RNA, 1476 nt, Artificial Sequence
  derived and/or modified CDS sequence (opt5) from Lassa virus__AIT17806__GPC
augggccagaucgugaccuucuuucaagaggucccccacguuauugaagaggugaugaacaucgugcugauugcccucagcauccuggcuguccuuaaggggcuguacaauuucgccacaugcggacucauuggccuggugacguuucuucugcucugugggagauccugcaccacaucucuguauaaaggaguuuacgaacugcagacccucgagcugaacauggaaacacuuaauaugaccaugccucugagcuguacaaagaacaauucccaucacuauaucauggugggcaacgagaccgggcucgagcugacgcuuaccaauacaucuaucauuaaccauaaauucugcaaucugagcgacgcgcacaagaaaaaccucuacgaucaugcucugauguccaucauuucuaccuuucaccugagcaucccgaauuucaaccaguaugaagccauguccugugacuuuaauggaggcaagauuagcguccaguacaaccucucucacuccuaugccggcgaugcugccaaucauugcgggacaguggcuaacggaguucugcaaaccuucaugcggauggccuggggcgggagcuacaucgcgcuugacucuggacgcggcaagugggauuguauuaugacguccuaccaguaucugaucauccagaacacaaccugggaggaccacugccaguuuagcagacccucuccuauuggguaccucggacugcuuucccaacggacacgcgauaucuauauuagcagacggcugcucggcaccuucaccuggacacuguccgacucugaaggcaaagauacgcccgggggauacugucugacccgcuggaugcucaucgaggccgagcugaagugcuuuggcaauacagcuguggccaaauguaacgaaaagcaugacgaggaguucugcgauaugcuuagacuguuugacuucaauaaacaggcuauucagcggcucaaggccgaagcgcagaugagcauccaacugaucaacaaggccgucaaugcucuuauuaacgaucagcugaucaugaaaaaucaccuccgcgacauuauggggaucccuuauugcaacuacuccaaguauugguaccugaaucacaccacaaccggaaaaacgagccugcccaaguguuggcucgugucuaacggcuccuaccugaaugaaacacauuucagcgacgauauugagcagcaagccgacaacaugaucaccgagaugcuucagaaagaauauauggagagacaggggaagaccccucugggacucguggaucuguuugucuucucuaccagcuuuuaccugaucuccauuuuccuucaccucguuaaaaucccgacacaucggcacauugugggcaagucuugccccaagccucaucgccugaaucacaugggcaucuguagcugcgggcuguauaaacagcccggagugccugucaaguggaaaagauga

SEQ ID NO: 2419 - RNA, 1476 nt, Artificial Sequence
  derived and/or modified CDS sequence (opt5) from Lassa virus__AIT17810__GPC
augggccagaucgugaccuucuuucaagaggucccccacguuauugaagaggugaugaacaucgugcugauugcccucagcauccuggcuguccuuaaggggcuguacaaucucgccacaugcggacuggugggccuuguuacguuccugcuccugugugggagauccugcaccacaucucuguauaaaggaguguacgaacuccagacccuggagcuuaacauggaaacacugaauaugaccaugccucucagcuguacaaaggacaacucccaucacuauauucgggucggcaaugagaccgggcuggagcuuacgcugaccaacacaucuauccucaaucauaaauuuugcaaccugagcgaugcgcacaagaaaaaucuguacgaccaugcucucauguccaucauuucuaccuuccaccugagcaucccgaacuuuaaucaguaugaagccauguccugugauuucaacggaggccgcauuagcgugcaguacaaucuuucucacuccuaugccggcgacgcugccaaccauugcgggacaguugcuaauggagugcugcaaaccuuuaugagaauggccuggggcgggagcuacaucgcgcucgauucuggacggggccgcugggacuguauuaugacguccuaccaguaucugaucauucagaacacaaccugggaggaucacugccaguucagcagacccucuccuaucggguaccuuggacugcucucccaacggacacgcgacaucuauauuagcagacggcugcugggcaccuuuaccuggacacucuccgauucugaaggcaaggacacgcccgggggauacugucugacccgcuggaugcuuaucgaggccgagcugaagugcuucggcaacacagcugucgccaaauguaaugaaaagcaugaugaggaauuuugcgacaugcucagacuguucgauuuuaacaaacaggcuauucagcggcuuaaggccgaggcgcagaugagcauccaacugauuaauaaagccgugaacgcucucaucaaugaccagcugaucaugaagaaccaucugcgcgacauuauggggaucccuuauugcaauuacuccaaguauugguaccucaaccacaccacaaccggaaaaacgagccugcccagauguuggcuugugucuaauggcuccuaccugaacgaaacacacuucagcgaugacauugagcagcaagccgauaauaugaucaccgagaugcuccagaaggaauauauggagcggcaggggaaaaccccucugggacuggucgaccuuuucguuuuuagcacaucuuucuaccucauuuccaucuuucugcaccuggugaagaucccgacccaucgccacguggucggcaaacccugcccuaagccccauagacucaaccacaugggcauuuguucuugcgggcuguauaaacagccuggagugcccguuaaguggaagcgguga

SEQ ID NO: 2420 - RNA, 1476 nt, Artificial Sequence
  derived and/or modified CDS sequence (opt5) from Lassa virus__AIT17814__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauuauggucggcaacgagaccgggcucgagcugacgcuuaccaauacaucuaucaucgaccauaaauucugcaaccugagcgaugcgcaccggaagaaucucuacgaccaugcucugauguccauuaucucuaccuuucaccugagcauuccgaacuucaaucaguaugaagccauguccugugauuuuaacggaggcaaaaucagcgugcaguacaaucucucucacuccuaugccaaggacgcugccgaucauugcggcacaguugcuaacggggugcugcaaaccuucaugcgcauggccuggggaggcagcuacauugcgcuugacucugggagaggacggugggauuguaucaugacguccuaccaguaucugauuauccagaauacaaccugggaggaccacugccaguuuagccgccccucuccuaucggcuaccucgggcugcuuucccaaagaacacgggauauuuauaucagccgcagacugcucggaaccuucaccuggacacuguccgacucugaaggcaaggauacgcccggcggguacugucugacccgguggaugcucauugaggccgagcugaaaugcuuuggaaacacagcugucgccaaguguaacgaaaaacaugacgaggaguucugcgauaugcuucgccuguuugacuucaauaagcaggcuauccagagacucaaagccgaagcgcagaugagcauucaacugaucaacaaggccgugaaugcucuuaucaacgaccagcugauuaugaagaaucaccuccgggauaucaugggcauuccuuauugcaacuacuccaaauauugguaccugaaucacaccacaaccgggaagacgagccugcccaaauguuggcucgugucuaacggauccuaccugaaugaaacacauuucagcgacgauaucgagcagcaagccgacaacaugauuaccgagaugcuucagaaggaauauauggagcgccagggcaaaaccccucuggggcucgucgaucuguuuguuuucucuaccagcuuuuaccugaucuccaucuuccuucaccucgugaagauuccgacacauagacacaucgugggaaaacccugcccuaagccccaucggcugaaucacaugggcauuuguucuugcggccuguauaagcagccugggguccccgugaaauggaagcgcuga

SEQ ID NO: 2421 - RNA, 1476 nt, Artificial Sequence
  derived and/or modified CDS sequence (opt5) from Lassa virus__AIT17820__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggaguguacgaacugcagacccucgagcugaacauggaaacacuuaauaugaccaugccucugagcuguacaaagaacaauucccaucacuauauuauggucggcaacgagaccgggcucgagcugacgcuuaccaauacaucuaucaucaaccauaaauucugcaaucugagcgacgcgcacaagaaaaaccucuacgaucaugcucugauguccauuaucucuaccuuucaccugagcauuccgaauuucaaccaguaugaagccauguccugugacuuuaauggaggcaagaucagcgugcaguacaaccucucucacuccuaugccgaggaugcugccaaucauugcggcacaguugcuaacggggugcugcaaaccuucaugcggauggccuggggaggcagcuacauugcgcuugacucugggcgcggaaacugggauuguaucaugacguccuaccaguaucugauuauccagaauacaaccugggaagaccacugccaguuuagcagacccucuccuaucggcuaccucgggcugcuuucccaacggacacgcgauauuuauaucagcagacggcugcucggaaccuucaccuggacacuguccgacucugagggcaaggauacgcccggcggguacugucugacccgcuggaugcucauugaggccgaacugaaaugcuuuggaaacacagcugucgccaaguguaaugagaaacaugacgaagaguucugcgauaugcuuagacuguuugacuucaacaagcaggcuauccagcggcucaaagccgaagcgcagaugagcauucaacugaucaauaaggccgugaacgcucuuaucaaugaucagcugauuaugaagaaccaccuccgcgacaucaugggcauuccuuauugcaauuacuccaaauauugguaccugaaccacaccacaaccgggaagacgagccugcccaaauguuggcucgugucuaauggauccuaccugaacgagacacauuucagcgacgauaucgagcagcaagccgacaauaugauuaccgaaaugcuucagaaggaguauauggaaagacagggcaaaaccccucuggggcucgucgaucuguuuguuuucucuaccagcuuuuaccugaucuccaucuuccuucaccucgugaagauuccgacacaucggcacaucgugggaaaaucuugccccaagccucaucgccugaaccacaugggcauuuguagcugcggccuguauaagcagcccggggucccugugaaauggaagagauga

SEQ ID NO: 2422 - RNA, 1476 nt, Artificial Sequence
  derived and/or modified CDS sequence (opt5) from Lassa virus__AIT17824__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucuguguauaaaggagucuacgaacugcagacccuggagcucaacauggaaacacugaauaugaccaugccucuuagcuguacaaagaacaauucccaucacuauauuauggugggcaacgagaccgggcuggagcucacgcugaccaauacaucuaucaucaaccauaaauucugcaaucuuagcgacgcgcacaagaaaaaccuguacgaucaugcucucauguccauuaucucuaccuuucaccugagcauuccgaauuucaaccaguaugaagccauguccugugacuuuaauggaggcaagaucagcguucaguacaaccugucucacuccuaugccggcgaugcugccaaucauugcgggacaguggcuaacggaguccuccaaaccuucaugcggauggccuggggcgggagcuacauugcgcuggacucuggacacggcaagugggauuguaucaugacguccuaccaguaucuuauuauccagaacacaaccugggaggaccauugccaguuuagccgccccucuccuaucggguaccugggacuccugucccaaagaacacgggauauuuauaucagccgcagacuucugggcaccuucaccuggacacucuccgacucugaaggcaaagauacgcccgggggauacugucugacccgguggaugcugauugaggccgagcucaagugcuuuggcaauacagcuguggccaaauguaacgaaaagcacgacgaggaguucugcgauaugcugcgccuuuuugacuucaauaaacaggcuauccagagacugaaggccgaagcgcagaugagcauucaacucaucaacaaggccgugaaugcucugaucaacgaucagcuuauuaugaaaaaucaucugcgggacaucauggggauuccuuauugcaacuacuccaaguauugguaccucaaucacaccacaaccggaaaaacgagccugcccaaguguuggcuggucucuaacggcuccuaccucaaugaaacacacuucagcgacgauaucgagcagcaagccgacaacaugauuaccgagaugcugcagaaagaauauauggagcgccaggggaagaccccucuuggacugguugaucucuuuguguucucuaccagcuuuuaccugaucuccaucuuccugcaucuugugaaaauuccgacacacagacauaucgucggcaagucuugccccaagccucaccggcucaaucacaugggcauuuguagcugcgggcuguauaaacagcccggagugccuguucgcuggaagagauga

SEQ ID NO: 2423 - RNA, 1476 nt, Artificial Sequence
  derived and/or modified CDS sequence (opt5) from Lassa virus__AIT17828__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccacaucucuguauaaaggagacuacgaacugcagacccucgagcugaacauggaaacacuuaauaugaccaugccucugagcuguacaaagaacaauucccaucacuauauuauggugggcaacgagaccgggcucgagcugacgcuuaccaauacaucuaucaucaaccauaaauucugcaaucugagcgaugcgcacaagaaaaaccucuacgaccaugcucugauguccauuaucucuaccuuucaccugagcauuccgaauuucaaccaguaugaagccauguccugugauuuuaauggaggcaagaucagcguccaguacaaccucucucacuccuaugccggcgacgcugccaaucauugcgggacaguggcuaacggaguucugcaaaccuucaugcggauggccuggggcgggagcuacauugcgcuugauucuggacgcggcaacugggacuguaucaugacguccuaccaguaucugauuauccagaauacaaccugggaggaucacugccaguuuagcagacccucuccuaucggguaccucggacugcuuucccaacggacacgcgacauuuauaucagcagacggcugcucggcaccuucaccuggacacuguccgauucugaaggcaaggacacgcccgggggauacugucugacccgcuggaugcucauugaggccgagcugaaaugcuuuggcaacacagcuguggccaaguguaaugaaaaacaugaugaggaguucugcgacaugcuuagacuguuugauuucaacaagcaggcuauccagcggcucaaagccgaagcgcagaugagcauucaacugaucaauaaggccgucaacgcucuuaucaaugaccagcugauuaugaagaaccaccuccgcgacaucauggggauuccuuauugcaauuacuccaaauauugguaccugaaccacaccacaaccggaaagacgagccugcccaaauguuggcucgugucuaauggcuccuaccugaacgaaacacauuucagcgaugacaucgagcagcaagccgauaauaugauuaccgagaugcuucagaaggaauauauggagagacaggggaaaaccccucugggacucguggaccuguuugucuucucuaccagcuuuuaccugaucuccaucuuccuucaccucguuaagauuccgacacaucggcacaucgugggcaaaucuugccccaagccucaucgccugaaccacaugggcauuuguagcugcgggcuguauaagcagcccggagugccugucaaauggaagagauga

SEQ ID NO: 2424 - RNA, 1473 nt, Artificial Sequence
  derived and/or modified CDS sequence (opt5) from Lassa virus__AIT17836__GPC
augggccagaucauuaccuucuuucaagaggugccccacgucaucgaagagguuaugaacauugugcugaucgcccucagccugcuugcuauucugaaggggcucuacaauaucgccacaugcggaaucauuggccugguggcguuccuuuuucugugugggaaauccugcucucucacgcugaagggaggcuaugaacugcagacccucgagcugaacauggaaacacuuaauaugaccaugccucugagcuguaccaaaaacuccucucaucacuacaucagagucgggaaugagacaggacucgagcugacacuuaccaacacgagcauuaucaaucauaaguucugcaaccuguccgacgcucacaaaaagaaucucuaugaucaugcccugaugucuauuaucagcaccuuucaccuguccauuccgaacuucaaucaguacgaagccaugagcugugacuuuaacggcggcaagaucucugugcaguauaaucucucccacagcuacgcuggggaugccgcugagcauugcggaacaguugccaacggcgugcugcaaaccuucaugcggauggcguggggagggcgcuauaucgcccuugacucuggcaaagggaauugggauuguauuaugacauccuaccaguaccugaucauucagaacaccacgugggaagaccacugccaguuuagcagacccucuccuaucggauaucucggccugcuuucccaacggacacgcgauauuuacaucagcagacggcugcucggcaccuucacauggacccuguccgacucugaggggaacgagacccccggaggcuauugucugacacgcuggaugcucaucgaagcugagcugaagugcuuugggaauacggccgucgcuaaauguaacgaaaagcaugaugaggaguucugcgacaugcuuagacuguuugauuucaauaaacaggccauucggcgccucaaggcggaagcccagaugagcauccagcugauuaacaaggcugugaaugcccuuaucaacgaccaacugauuaugaaaaaucaccucagagauaucaugggaaucccuuacugcaacuauuccaaguacugguaucugaaucacaccagcucuggccggacaucccugcccaaauguuggcucauuagcaacgggucuuaccugaaugagacccaguucagcgacgacaucgaacagcaagcugauaacaugauuacagagaugcuucagaaggaauacaucgagcgccagggaaaaaccccucugggccucguugacauuuuuaucuucuccacgucuuuuuaucugauuagcaucuuccugcaucuuaucaagauuccgacacacagacauaucgugggcaaacccugcccuaagccccaccggcucaaucauaugggggucuguuccugcggacuguacaagcacccuggcgugcccaccaaauggaagcgcuga

SEQ ID NO: 2425 - RNA, 1476 nt, Artificial Sequence
  derived and/or modified CDS sequence (opt5) from Lassa virus__AIT17840__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccauuucucuguauaaaggaguguacgaacugcagacacucgagcugaacauggaaacccuuaauaugacaaugccucugagcuguaccaagaacaauucccaucacuauaucauggucggcaacgagacagggcucgagcugacccuuacgaauaccucuaucauuaaccauaaauucugcaaucugagcgacgcgcacaagaaaaaccucuacgaucaugcucugauguccaucauuucuacauuucaccugagcaucccgaauuucaaccaguaugaagccauguccugugacuuuaauggaggcaagauuagcgugcaguacaaccucucucacuccuaugccggcgaugcugccaaucauugcgggaccguugcuaacggagugcugcaaacauucaugcggauggccuggggcgggagcuacaucgcgcuugacucuggacgcgauagaugggacuguauuaugaccuccuaccaguaucugaucauccagaacacgacaugggaggaucacugccaguuuagccggcccucuccuauuggcuaccucgggcugcuuucccaacgcaccagagacaucuauauuagccggcgccugcucggaacauucaccuggacccuguccgauucugaaggcaaggacacacccggcggguacugucugacgagauggaugcucaucgaggccgagcugaaaugcuuuggaaauaccgcugucgccaaguguaacgaaaaacaugaugaggaguucugcgacaugcuucggcuguuugauuucaauaagcaggcuauucagcgccucaaagccgaagcgcagaugagcauccaacugaucaacaaggccgugaaugcucuuauuaacgaccagcugaucaugaagaaucaccucagagacauuaugggcaucccuuauugcaacuacuccaaauauugguaccugaaucacacaaccacagggaagaccagccugcccaaauguuggcucgugucuaacggauccuaccugaaugaaacgcauuucagcgaugacauugagcagcaagccgauaacaugaucacagagaugcuucagaaggaauauauggagcggcagggcaaaaccccucuggggcucgucgaccuguuuguuuucucuaccagcuuuuaccugaucuccauuuuccuucaccucgugaagaucccgacacaucgccacauugugggaaaacccugcccuaagccccauagacugaaucacaugggcaucuguucuugcggccuguauaagcagccugggguccccgugaaauggaagcgguga

SEQ ID NO: 2426 - RNA, 1476 nt, Artificial Sequence
  derived and/or modified CDS sequence (opt5) from Lassa virus__AIT17844__GPC
augggccagaucgugaccuucuuucaagaggucccccacguuauugaagaggugaugaacaucgugcugauugcccucagcauccuggcuguccuuaaggggcuguacaauuucgccacaugcggacucgugggccugguuacguuucuucugcucugugggagauccugcaccauuucucuguauaaaggaguguacgaacugcagacacucgagcugaacauggaaacccuuaauaugacaaugccucugagcuguaccaagaacaauucccaucacuauaucauggucggcaacgagacagggcucgagcugacccuuacgaauaccucuaucauuaaccauaaauucugcaaucugagcgacgcgcacaagaaaaaccucuacgaucaugcucugauguccaucauuucuacauuucaccugagcaucccgaauuucaaccaguaugaagccauguccugugacuuuaauggaggcaagauuagcgugcaguacaaccucucucacuccuaugccggcgaugcugccaaucauugcgggaccguugcuaacggagugcugcaaacauucaugcggauggccuggggcgggagcuacaucgcgcuugacucuggacgcgauagaugggacuguauuaugaccuccuaccaguaucugaucauccagaacacgacaugggaggaucacugccaguuuagccggcccucuccuauuggcuaccucgggcugcuuucccaacgcaccagagacaucuauauuagccggcgccugcucggaacauucaccuggacccuguccgauucugaaggcaaggacacacccggcggguacugucugacgagauggaugcucaucgaggccgagcugaaaugcuuuggaaauaccgcugucgccaaguguaacgaaaaacaugaugaggaguucugcgacaugcuucggcuguuugauuucaauaagcaggcuauucagcgccucaaagccgaagcgcagaugagcauccaacugaucaacagagccgugaaugcucuuauuaacgaccagcugaucaugaagaaucaccuccgggacauuaugggcaucccuuauugcaacuacuccaaguauugguaccugaaucacacaaccacagggaaaaccagccugcccaaguguuggcucgugucuaacggauccuaccugaaugaaacgcauuucagcgaugacauugagcagcaagccgauaacaugaucacagagaugcuucagaaagaauauauggagcgccagggcaagaccccucuggggcucgucgaccuguuuguuuucucuaccagcuuuuaccugaucuccauuuuccuucaccucgugaaaaucccgacacauagacacauugugggaaagcccugcccuaaaccccaucggcugaaucacaugggcaucuguucuugcggccuguauaagcagccugggguccccgugaaguggaaacgcuga

SEQ ID NO: 2427 - RNA, 1473 nt, Artificial Sequence
  derived and/or modified CDS sequence (opt5) from Lassa virus__AMR44577__GPC
augggccagaucauuaccuucuuucaagaggugccccacgucaucgaagagguuaugaacauugugcugaucgcccucagccugcuugcuauucugaaggggguguacaaugucgccacaugcggaaucaucggccucgugacguuccuguuucuuugugggagauccugcucucugauuuauaaaggaagcuacgaacuccagacccuggagcugaacauggaaacacucaauaugaccaugccucuguccuguacaaagaacucuagccaucacuauauccggguuggcaaugagaccgggcuugagcugacacucaccaacacguccauuaucaaucauaaauucugcaaccugucugacgcgcacaagcgcaaucuuuacgaucaugcucugaugagcauucucuccaccuuucaccugagcaucccgaacuucaaucaguaugaagccaugucuugugacuuuaacggaggcaaaauuuccgugcaguacaaucugagccacgccuaugcugucgaugccgcugagcauugcggcacaguggccaacgggguucuccaaaccuucaugagaauggcguggggaggcucuuacaucgcccuggacuccgggcggggaaauugggauuguaucaugacaagcuaccaguaucuuauuauccagaacaccacgugggaagaccacugccaguuuucucgccccuccccuauuggcuaccuggggcuccugagccaaagaacacgggauaucuauauuucccgcagacuucugggaaccuucacauggacccucucugacagcgagggcaacgagacccccggcggguacugucugacacgguggaugcugaucgaagcugagcucaagugcuuuggaaauacggccguggcuaaguguaacgaaaaacaugaugaggaguucugcgacaugcugcgccuuuuugauuucaauaagcaggccauccagagacugaaauccgaagcgcagaugagcauucaacucaucaacaaggccgucaaugcucugauuaacgaccagcuuaucaugaaaaaucaucugcgggauaugaugggcauuccuuauugcaacuacucuaaguauugguaccucaaucacaccuccagcgggcgcacaucucugcccaaguguuggcuggugagcaacggauccuaccucaaugagacccacuucucugacgacaucgaacagcaagccgauaacaugaucacagagaugcugcagaaagaauauauugacagacagggcaagaccccucuugggcugguggaucucuuugucuucagcacguccuuuuaccugaucagcauuuuccugcaccuuaucaaaauuccgacacaucggcacaucguuggaaagcccugcccuaaaccccaucgccucaaucacaugggcauuuguucuugcggccuguauaagcagccuggggugcccaccagauggaaacgguga

SEQ ID NO: 2428 - RNA, 1476 nt, Artificial Sequence
  derived and/or modified CDS sequence (opt5) from Lassa virus__ANH09722__GPC
augggccagaucgugaccuucuuucaagaggucccccacguuauugaagaggugaugaacaucgugcugauugcccucagcauccuggcuguccuuaaggggcuguacaauguggccacaugcggacucauuggccugguuacguuccuucugcucugugggagauccugcaccacaacccuguauaaaggaguguacgaacugcaggcgcucgagcugaacauggaaacacuuaauaugaccaugccucugucuuguacaaagaacaauagccaucacuauauccgggucggcaacgagaccgggcucgagcugacgcuuaccaauacaucccugaucaaccauaaauuuugcaaucucucugacgcucacaagaaaaaccuguacgaucaugcccugaugagcauuaucuccaccuuccaccucucuauuccgaauuuuaaccaguaugaagccaugagcugugacuucaaugauggaaagaucuccgugcaguacaaccugagccacacauaugcuggcgacaccgccaaucauugcggcacgguugcuaacggggugcuucaaacauuuaugcgcauggccuggggaggcucuuacauugcgcuggauuccgggagaggaggcugggacuguaucaugaccagcuaccaguaucucauuauccagaacacaaccugggaggaucacugccaguucucucggcccuccccuaucggguaccugggacuucugagccaacgcaccagagacauuuauaucucucggcgccuccugggcacauuuacguggacccuguccgauagcgaaggcaaggacacacccgggggauacugucucaccagauggaugcugauugaggccgagcuuaaaugcuucggcaauacagcugucgccaaguguaacgaaaaacaugaugaggaauuuugcgacaugcugcgccucuucgauuuuaauaagcaggcuauccagcggcugaaagccgaggcgcagauguccauucaacuuaucaacaaggccgugaaugcucugaucaacgaccagcucauuaugaagaaucaccugagagacaucauggggauuccuuauugcaacuacucuaaauauugguaccugaaucacaccgugacgggaaagacaagccuccccaaauguuggcuggucuccaacggcagcuaccuuaaugaaacccauuucucugaugacaucgagcagcaagccgauaacaugauuaccgagaugcugcagaaggaauauauggagcggcaggggaaaacaccucucggacugguugaccuguucguguuuuccaccagcuucuaccuuaucucuaucuuucuccaccuggugaagauuccgacacaucgccacgucgugggcaaacccugcccuaagccccauagacugaaucacaugggcaucuguagcugcggguucuauaagcagccuggaguucccgugcgguggaaacgcuga

SEQ ID NO: 2429 - RNA, 1476 nt, Artificial Sequence
  derived and/or modified CDS sequence (opt5) from Lassa virus__ANH09724__GPC
augggccagaucgugaccuucuuucaagaggucccccacguuauugaagaggugaugaacaucgugcugauugcccucagcauccuggcuguccuuaaggggcuguacaauguggccacaugcggacucauuggccugguuacguuccuucugcucugugggagauccugcaccacaacccuguauaaaggaguguacgaacugcaggcgcucgagcugaacauggaaacacuuaauaugaccaugccucugucuuguacaaagaacgacagccaucacuauaucauggucggcaaugagaccgggcucgagcugacgcuuaccaacacauccaucauuucucauaaauuuugcaaucugagcgaugcucacaagcagaaccucuacgaccaugcccugauguccaucauuucuaccuuccaccugagcaucccgaauuuuaaccaguaugaagccauguccugugauuucaauggaggcaaaauuagcgugcaauacaaccucucucacacauaugcuggcgacgccgcuaaucauugcgggaccguugccaacggagugcugcagacguuuaugcggauggcguggggcggguccuacaucgcccuugauagcggacgcggcgggugggacuguauuaugacaucuuaccaguaucugaucauccagaauaccacaugggaggaucacugccaauucuccagacccagcccuauuggauaccucggccugcuuucucagcggacccgcgacaucuauauuuccagacggcugcucggcaccuuuacauggacgcugagcgauuccgaagggaaggacacccccggaggcuacugucugacacgcuggaugcucaucgaggcugagcugaagugcuucgggaacaccgccgucgcuaaauguaacgaaaagcaugaugaggaauuuugcgacaugcuuagacuguucgauuuuaauaaacaggccauucagcggcucaaggcggaggcccaaaugucuauccagcugaucaacaaagcugugaaugcccuuauuaacgaccagcugaucaugaagaaucaccuccgcgacauuaugggaaucccuuauugcaacuacagcaaguauugguaccugaaucacacagugaccggcaaaacgucccugcccaaguguuggcucgucagcaacgggucuuaccugaaugaaacacauuucuccgaugacauugagcaacaggcugauaacaugaucaccgagaugcuucagaaagaauauauggagagacagggaaagaccccucugggccucguugaccuguucguguuuagcacaucuuucuaccugaucagcauuuuucuucaccucgugaaaaucccgacccaucggcacgucgugggcaagcccugcccuaaaccccaucgccugaaucacauggggauuuguuccugcggauucuauggccaaccugggguucccgugagauggaagcgguga

SEQ ID NO: 2430 - RNA, 1476 nt, Artificial Sequence
  derived and/or modified CDS sequence (opt5) from Lassa virus__ANH09728__GPC
augggccagaucgugaccuucuuucaagaggucccccacguuauugaagaggugaugaacaucgugcugauugcccucagcguccuggcugugcuuaaggggcuguacaauguugccacaugcggacucaucggccuggugacguuccuucugcucugugggagauccugcaccacaacccuguauaaaggagucuacgaacugcaggcgcucgagcugaacaugggcacacuuaauaugaccaugccucugucuuguacaaagaacaauagccaucacuauauuaugguggggaacgaaaccggacucgagcugacgcuuaccaauacauccaucaucaaccauaaauuuugcaaucugucugacgcucacaagaaagaucucuacgaccaugcccugaugagcauuaucuccaccuuccaccugucuguuccgaacuuuaaucaguaugaggccaugagcugugauuucaacggcggcaagauuuccgugcaguacaaucucagccacgcuuaugccggggacacagcuaaccauugcggaaccgucgccaauggcgugcugcaaacguuuaugcggauggcguggggagggucuuacaucgcccuugauuccggccgcgggggaugggacuguauuaugacaagcuaccaguaucugaucauucagaacaccacaugggaagaucacugccaguucucuagacccuccccuaucggcuaccucggccugcuuagccaacggacccgcgacaucuauauuucuagacggcugcucgggaccuuuacauggacgcuguccgauagcgagggagaauacacccccggcggguauugucugacacgcuggaugcucaucgaggcugagcugaagugcuucggaaacaccgccguggcuaaauguaaugaaaagcaugacgaggaauuuugcgauaugcuuagacuguucgacuuuaacaaacaggccauucagcggcucaaggcggaggcccagauguccauccaacugauuaauaaagcugucaacgcccuuaucaaugaucagcugaucaugaagaaccaccuccgcgacauuaugggcaucccuuacugcaauuauucuaaguacugguaccugaaccacacaguuaccgggaaaacgagccugcccaaguguuggcucguguccaauggaagcuaucugaacgaaacacauuucucugacgauauugagcagcaagcugacaauaugaucaccgagaugcuucagaaagaauacauggagagacagggcaagaccccucugggccucguggaucuguucgucuuuuccaccagcuucuaucugauuucuaucuuucuucaccucgugaaaaucccgacacaucggcacguuguggggaagcccugcccuaaaccccaucgccugaaccacaugggaauuuguagcugcggcuucuacaagcagccugggguccccgugagauggaagcgguga

SEQ ID NO: 2431 - RNA, 1476 nt, Artificial Sequence
  derived and/or modified CDS sequence (opt5) from Lassa virus__ANH09730__GPC
augggccagaucgugaccuucuuucaagaggucccccacguuauugaagaggugaugaacaucgugcugauugcccucagcguccuggcugugcuuaaggggcuguacaauguugccacaugcggacucaucggccuggugacguuccuucugcucugugggagauccugcaccacaacccuguauaaaggagucuacgaacugcaggcgcucgagcugaacauggaaacacuuaauaugaccaugccucugucuuguacaaagaacaauagccaucacuauauuauggugggcaacgagaccgggcucgagcugacgcuuaccaauacauccaucaucaaccauaaauuuugcaaucugucugacgcucacaagaaaaaccucuacgaucaugcccugaugagcauuaucuccaccuuccaccugucuauuccgaauuuuaaccaguaugaagccaugagcugugacuucaaucagggaaagaucuccguucaauacaaccucagccacgcuuaugccggcgaugcugccaaucauugcggcacaguggcgaacgggguccugcagaccuuuaugcggauggccuggggaggcucuuacauugcucuugacuccgggcgcggaggcugggauuguaucaugacgagcuaccaguaucugauuauccagaacacaaccugggagaaucacugccaauucucuagacccuccccuaucggguaccucggacugcuuagccagcggacacgcgacauuuauaucucuagacggcugcucggcaccuuuaccuggacacuguccgauagcgaaggcaaggggacgcccggaggcuacugucugacccgcuggaugcucauugaggccgagcugaaaugcuucgggaacacagcuguggccaaguguaaugaaaaacaugacgaggaauuuugcgauaugcuuagacuguucgacuuuaacaagcaggcgauccagcgguucaaagccgaggcucaaauguccauucagcucaucaauaaggccgugaacgcucugaucaaugaucagcuuauuaugaagaaccaucugcgcgacaucaugggcauuccuuauugcaauuacucuaaauauugguaccucaaccacaccgucacaggaaagaccagccugcccaaauguuggcugguuuccaaugggagcuaccucaacgaaacgcacuucucugaugacaucgagcaacaggccgacaauaugauuacagagaugcugcagaaggaauauauggagagacagggacggaccccucuuggccugguggaucucuuuguguucuccaccagcuuuuaccugaucucuaucuuccugcaccuugucaaaauuccgacacaucgccacgugguuggcaagcccugcccuaaaccccauagacucaaccacauggggaucuguagcugcggauuuuauaagcaaccuggcgugcccguccgguggaagcgcuga

SEQ ID NO: 2432 - RNA, 1476 nt, Artificial Sequence
  derived and/or modified CDS sequence (opt5) from Lassa virus__ANH09732__GPC
augggccagaucgugaccuucuuucaagaggucccccacguuauugaagaggugaugaacaucgugcugauugcccucagcauccuggcuguccuuaaggggguguacaauguugccacaugcggacugauuggccucgugacguuccugcuucuguccgggagaucuuguaccacaaccaucuauaaaggagucuacgaacuccaggcgcuggagcugaacauggaaacacucaauaugaccaugccucugagcugcacaaagaacaauucccaucacuauaucauggugggcaacgagaccgggcuugagcugacgcucaccaauacaucuauuaucaaccauaaauuuuguaaucugagcgacgcucacaagaaaaaccuuuacgaucaugcccugauguccauuaucucuaccuuccaccucagcauuccgaauuuuaaccaguaugaagccauguccugcgacuucaauggaggcaagaucagcguucaguacaaccugucucacacauaugcuggcgaugccgcuaaucauugugggaccguggccaacggaguccugcaaacguuuaugcggauggcguggggcggguccuacauugcccucgacagcggacacggcgggugggauugcaucaugacaucuuaccaguaucugaucauucagaacaccacaugggagaaucauugucaguucucccgccccagcccuaucggauaccuuggccugcucucucaaagaacccgggacauuuauaucucccgcagacugcuuggcaccuuuacauggacgcugagcgauuccgaagggaaggacacccccggaggcuacugccucacacgguggaugcugauugaggcugagcugaaauguuucgggaacaccgccguggcuaagugcaaugaaaaacacgaugaggaauuuugugacaugcuccgccuguucgauuuuaacaagcaggccauccagagacuuaaagcggaggcccagaugucuauccaacugauuaauaaggcugugaacgcccucaucaaugaccagcugauuaugaagaaccaccuucgggauaucaugggcauuccuuauugcaauuacagcaaauauugguaccugaaccauacagucaccggaaagacgucccuccccaaaugcuggcugguuagcaaugggucuuaccugaacgaaacacacuucuccgacgacaucgagcagcaagcugauaauaugaucaccgagaugcuccagaaggaauauauggagcgccagggaaaaaccccucugggccuuguggaccuguucguguuuagcacaucuuucuaccucauuagcaucuuucugcaucuggucaagauuccgacccacagacauaucgugggcaaacccuguccuaagccccaccggcuuaaccacauggggauuugcuccuguggauucuauaagcagccuggcguucccgugcgcuggaaaagauga

SEQ ID NO: 2433 - RNA, 1473 nt, Artificial Sequence
  derived and/or modified CDS sequence (opt5) from Lassa virus__ANH09738__GPC
augggccagaucgugaccuucuuucaagaggucccccacguuauugaagagaucaugaacauugugcugaucacacucagccugcuugccauucugaaggggcucuacaauuucgcuacgugcggacugaucggccuuaucaccuuucuguuccucugugggagauccugcucuaugauuuauaaaggaagcuaccagcuggaaacacuggagcucaacauggaaacccugaauaugacaaugccucuuuccuguaccaagaacaauucucaucacuauauccgggugggcaacgagacagggcuggagcucacccugacgaauaccagcauuaucaaccauaaauuuugcaaucuuuccgacgcccacaagcgcaaccuguacgaucauucucucaugagcauuaucuccacauuccaccugagcauuccgaauuuuaaccaguaugaagcgaugucuugugacuucaauggaggcaaaaucuccauccaguacaaccugagccacaccuaugcuggcgaugccgccaagcauugcgggacagucgcuaauggagugcuccaaaccuuuaugagaauggccuggggcgggucuuacauugcucuggacuccggacggggcaacugggauuguaucaugacgagcuaccaguaucuuauuauccagaacacaaccugggaggaccacugccaguucucucgccccuccccuauuggguaccugggacuccugagccaaagaacacgggauaucuauaucucccgcagacuucugggcaccuuuaccuggacacucucugacagcgaaggcaaggagacgcccgggggauacugucugacccgguggaugcugauugaggccgaacucaaaugcuucggcaauacagcgguugccaaguguaacgagaaacaugaugaagaguuuugcgacaugcugcgccuuuucgauuucaauaagcaggcuauccagagacugaaaaccgaagcccagauguccauucaacucaucaacaaggcugugaaugcccugauuaacgaccagcuuaucaugaagaaucaucugcgggauaucauggggauuccuuauugcaacuacagcaaauauugguaccucaaucacacaucuaccggacgcacgucccugcccaaguguuggcuggucagcaacggcucuuaccucaaugagacacacuuuagcgacgacaucgagcagcaagcggauaacaugauuaccgaaaugcugcagaaagaguauaucgacagacaggggaagaccccucuuggacugguggauguuuucauguuuuccacaucuuucuaccucauuagcaucuuucugcaccuggugaaaauuccgacccaucggcacaucgucggcaaguccugccccaaaccucaucgccuuaaucacaugggcaucuguagcugcgggcucuauaagcagcccggagugccugugagauggaagcgguga

SEQ ID NO: 2434 - RNA, 1473 nt, Artificial Sequence
  derived and/or modified CDS sequence (opt5) from Lassa virus__ANH09740__GPC
augggccagaucgugaccuucuuucaagaggucccccacguuauugaagaggugaugaacaucgugcugauugcccucagccugcuugcuauccugaaggggcucuacaauuucgccacaugcggagucauuggccugaucacguuucuucugcucugugggagauccugcucugcgaccuauaaaggacaguacgaacugcagacacuggagcucaacauggaaagccugaauaugaccaugccucuuuccuguacaaagaacaauucucaucacuauauccgggcuggcaacaauaccgggcuggagcucacacugaccaacacgagcauuaucucccauaaauucugcaaucuuucugacgcccacaagaaaaaccuguacgaucauacccucaugagcauuaucacaaccuuucaccuguccauuccgaauuucaaccaguaugaggccaugagcugugacuuuaauggaggcaagaucucuauucaauacaaccugucccacagcuaugcuggcgaugccgcucagcauugcgggacaguggccaauggaguucuccagaccuucaugcgcauggcguggggcgggucuuaccuggcccuugacuccggaagacggggcugggauuguaucaucagcucuuaccaguaucugauuauccaaaacacgacaugggacgaucacugccaguuuucccgccccagcccuauuggguaccucggauucgugucccagaagaccagagacaucuauauuucucggcgccugcuuggcacauuuaccuggacccugagcgauuccgaaggccaugacaugcccgggggauacugucucacaagauggaugcugaucgaggcugaucugaaaugcuucggcaacacggccgucgcuaaguguaaugaaaaacacgacgaggaguuuugcgauauguggcgccucuucgacuucaacaagcaggccauccaacggcugaaagcggaagcccagaugaauauucagcuuaucaacaaggcugugaaugcccugauuaacgaccaacucaugaugaagaaucaccugagagauaucauggggauuccuuauugcaacuacagcaaauuuugguaucuuaauaacaccacaaccggacggacaucucugccccgcuguuggcucaucuccaauggcagcuaccugaacgagacccauuucucugacgauaucgaacagcaggcugacaauaugauuacggagaugcugcagaaggaauacauggauagacaagggaaaacaccucucggacugguugaccuuuuuguguucagcaccuccuuuuaucugaucaccauuuuccuccaccuggucaagaucccgacacaucggcacauugugggcaaacccugcccuaagccccaucgccugaaccacaugggcaucuguucuugcgggcuuuacaaacagccuggagugcccgucagauggaagcgguga

SEQ ID NO: 2435 - RNA, 1473 nt, Artificial Sequence
  derived and/or modified CDS sequence (opt5) from Lassa virus__CAA36645__GPC
augggccagaucgugaccuucuuucaagaggucccccacguuauugaagaggugaugaacaucgugcugauugcccucagcauccuggcuauucuuaaggggcuguacaaugucgccacaugcggacucaucggccuggugacguuccuucugcucuccgggagaucuuguagccugaucuauaaaggaaccuacgaacugcagacacucgagcugaacauggaaacccuuaauaugacaaugccucuguccugcaccaagaacaauucucaucacuauauucggguuggcaacgagacagggcucgagcugacccuuacgaauaccagcauccugaaccauaaauuuuguaaucucuccgacgcgcacaagcgcaaccuguacgaucauucucugaugagcauuaucuccacauuccaccucagcauuccgaauuuuaaccaguaugaagcuaugucuugcgacuucaauggaggcaaaaucaccgugcaguacaaccugucccacagcuuugccgucgaugccgcuggccauugugggacacuugccaauggagugcugcaaaccuucaugagaauggcuuggggcgggucuuauauugcccucgacuccggacggggcaacugggauugcaucaugacgagcuaccaguaccugaucauucagaacacaaccugggacgaucacugucaguuuucucgccccuccccuaucggguaucuuggacugcucagccaaagaacacgggacauuuacaucucccgcagacugcugggcaccuucaccuggacacucucugauagcgagggcaaugaaacgcccgggggauauugccugacccgguggaugcuuauugaggcggagcugaaguguuuuggcaacacagccguugcuaagugcaaugaaaaacaugacgaggaguucugugauaugcuccgccuguuugacuucaacaagcaggccaucagacggcuuaaaaccgaagcucagauguccauccagcugauuaauaaggccgugaacgcgcucaucaaugaucaacugauuaugaaaaaccaucugcgcgacaucauggggauuccuuacugcaauuauagcagauacugguaucucaaccacacaucuaccggaaagacgucccugccccggugcuggcuuaucagcaauggcucuuaccugaacgaaacaaaguucagcgacgauaucgagcagcaggccgacaauaugauuaccgagaugcuccaaaaagaauacaucgaucgccaggggaagaccccucugggacuggucgaccuuuuuguguucuccacaucuuuuuaucucauuagcaucuuccugcaccuggugaaaauuccgacccacagacauaucgucggcaagcccuguccuaaaccccaccggcucaaccauaugggcauuugcuccugugggcuguacaagcagccuggaguucccgugagauggaaacgcuga

SEQ ID NO: 2436 - RNA, 1476 nt, Artificial Sequence; identical to SEQ ID NO: 2256
  derived and/or modified CDS sequence (opt5) from Lassa virus__NP_694870__GPC

SEQ ID NO: 2437 - RNA, 1713 nt, Artificial Sequence
  derived and/or modified CDS sequence (opt5) from Lassa virus__AAA46284__NP
augagcgccuccaaggaggugagaucuugccuguggacccagagccuccggcgcgaacuguccggcuacuguucuaacaucaaacuucaagucguuaaggacgcucaggcccugcuccacgggcuggauuucagcgagguguccaaugugcagagacuuaugcggaaacagaagcgcgacgauggagaccugaaaagacuccgggaucugaaccaagcggucaauaaccugguggaacucaagucuacacagcagaaaagcguucugcgcgugggcacgcuuuccagcgacgaucugcucauucuggcugccgaccuugagaaacugaagucuaaagucaccagaacagaacggccccucuccagcgggguguauaugggaaaucugucuucccagcaacuggaucagcgcagagcccuccugaacaugaucggcaugaccgggguuagcggaggcggcaagggggcuucuaauggaauugugcgggucugggacgugaaaaacgccgagcuucugaauaaccaguuuggcacaaugccuucccucacccuggcuugccuuacaaagcaggggcaaguggaucugaaugacgccguccaggcgcucaccgaucugggacugaucuacacggccaaguauccgaacagcuccgaccucgaccgccugucucagagccaucccauucuuaauaugaucgauaccaaaaaguccagccugaacaucucuggcuacaauuucucccucggggcugccguuaaagcuggagccuguaugcuggacggcggcaacaugcuugagacaauuaaggugagcccucaaaccauggaugggauccugaaaucuauucucaaggugaaaaagagccugggaauguuugucuccgacacacccggcgaaagaaacccuuaugagaauauccuguacaagauuugccucucuggggauggauggagcuauaucgcgucccggaccagcauugugggccgcgccugggaaaacacgguuguggaccuggagcaggauaauaaaccccagaagaucgggaacggaggcucuaauaaaucccuucagagcgcuggcuucgccgcugggcugaucuacucucaacucaugacacugaaggacuuuaaauguuucaaccugauuccuaaugccaagaccuggauggauaucgagggaagaccggaagaccccgucgagauugcccuuuaccagccuuccagcggcugcuaugugcacuuuuuccgggaacccacagaucucaagcaguuuaaacaggacgcuaaguacucccaugggagagacguuaccgaucuguucgcggcccaaccuggacugaccucugcugugaucgaggcccucccccgcaacauggucauuacaugucagggcagcgaagacauccggaaacugcuugagucccaggggagacgcgauaucaagcugauugacaucacgcucucuaaagccgauagccggaaguuugagaaugcugugugggaccaguucaaggaucugugccacaugcauaccggcgucgugguugaaaagaagaaaagaggaggcaaggaggaaauuacaccgcacugugcccugauggacugcaucauguuugaugcggcuguguccgggggacuugacgccaaaguccuccgcgugguucugccucgggauaugguguucagaaccagcacacccaaggucgugcuguga

SEQ ID NO: 2438 - RNA, 1710 nt, Artificial Sequence
  derived and/or modified CDS sequence (opt5) from Lassa virus__AAF86704__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgaggugaauaacgugcagcgccuuaugagaaagcagaaacgggacgauggagaccugaagcgccucagagaucugaaucaagcggucaacaaucugguggaacucaaguccacacagcagaaaucuauucugcggguuggcacgcuuaccagcgacgaucugcucacacuggcugccgaccuugagaagcugaaauccaaggugauccgcaccgaaagaccccucagcucuggggucuauaugggaaaccuguccacacagcaacuggagcagcggcgcgcccuccugaauaugauuggcauggugggaggagcucagggcacccagccuggcagagaugggguugugcgggucugggacgugaaaaacccggaucuucugaauaaccaauucggaacaaugcccagccucacccuggccugucuuacgaagcagggccagguggaccugaaugaugcuguccucgcccugaccgaccuggggcucaucuacacagcgaaguauccuaacucuuccgaccuggaucgccuuagccaaucucaucccauucugaauaugguugacaccaaaaaguccagccucaacaucuccggauacaauuuuucucugggcgccgcugugaaagccggggcuugcaugcuugauggaggcaacaugcuggagacaaucaaggugaccccucagacgauggacggcauucucaaaagcauccugaaggucaaaagaucccuggggauguucgugagcgauacacccggagaacggaacccuuaugagaauauucucuacaagaucugucugucuggcgacggguggccguauauugccucccgcaccagcaucguugggagagcgugggaaaacacaaccguggaucuugagucugacggcaagccccagaaagucgggaccgccggaagcaauaagucccugcagucugcuggcuuuccuacaggccucacguacagccaacugaugacccugaaagauuccaugaugcagcuugaccccagcgccaagacauggauugauaucgaggggcggccugaagaccccguggagaucgcucucuaccagccgaugucuggaugcuauauucacuucuuuagagaaccuaccgaccugaaacaguucaagcaagaugccaaguacucccauggcaucgacguugccgaucuguuucccgcucagccugggcucacaagcgcggugauugaggcccugccccgcaacaugguccuuaccugucagggaucugacgauaucaaaaagcugcucgacucccagggccggagagauauuaaacugaucgacaucagccuguccaagguggauucucgcaaauucgaaaaugcugucugggaccaaugcaaggaucuuugucacaugcauacgggggugguuguggagaagaaaaagcggggcggaaaagaggaaauuacaccccacugcgcccucauggacuguaucauguuugaugccgcugucagcggcgggcugaacauuccugugcugagagccguucucccgcgcgacaugguguuccggaccuccucucccaaggucgugcuguga

SEQ ID NO: 2439 - RNA, 1710 nt, Artificial Sequence
  derived and/or modified CDS sequence (opt5) from Lassa virus__AAO59513__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaaggaacggcgcgacgauucugaccugaaaagacuccgggaucugaaccaggcggucaauaaccugguggagcucaagagcacacaacagaaguccguucugcgcgugggaacgcuuaccagcgacgaucugcucguccuggcugccgaccuugaaaaacugagaucuaaggugacacggaccgagcgcccccucuccgccggcguuuauauggggaaucugagcucucagcagcuggaucaaagacgggcucuccuguccaugauuggaaugaacggcagcaaucagggggcccgcgcuggaagagacggcgugguccgggugugggaugugaaaaacgccgagcuucugaauaaccaguucggcacaaugccuucucucacccuggcgugucuuacaaagcaggggcaagucgaccugaaugaugccguucaggcucucaccgaccugggacugaucuacacggccaaauauccgaacaccuccgaccucgaucgccugacacagagccaucccauucuuaauaugaucgacaccaagaaguccucucugaacgugagcggcuacaauuuuucccucggggcugccgugaaagcgggagccugcaugcuggauggcgggaacaugcuugaaacaauuaaggucagcccucaaaccauggacggaauccugaaaucuauccucaaggugaaaaaggcucugggcauguucauuuccgauacgcccggcgagagaaacccuuaugaaaauauccuguacaaaauuugucucagcggggacggauggcccuauaucgccucucggacaagcauuaccggcagagcuugggagaacacaguuguggaucuggaguccgacgaaaagccucagaaggccgggucuaauaacagcaauaaaucccuucagagcgccggauuuaccgcuggccugaccuacucucagcucaugacacugaaggaugcgaugcugcaacuugacccgaacgccaaaacguggauggauaucgaggggcgccccgaagacccugucgagauugcucucuaccagcccuccagcggaugcuauauccacuucuuucgggaaccuaccgaccugaagcaguucaaacaggaugccaaguacucucauggcaucgacauuacagaucuguuugccgcucaacccggccucaccuccgccgugaucgacgcgcugccgagaaauaugguuauuacaugucaggggagcgaugacauccgcaaacuucuggagucccagggacggaaggauauuaagcucaucgacaucgcucugaacaaagccgauucuagaaaguaugagaaugccgugugggaccaguacaaagaucugugccacaugcauaccggcgucguggucgaaaagaagaaacgcgggggaaaggaggaaauuacgccucacugugcucuuauggacugcaucauguucgaugccgcugugagcggcgggcucaaaacacugguucugcgggccgugcuccccagagacauggucuuucgcaccuccaccccucgggugguucuguga

SEQ ID NO: 2440 - RNA, 1710 nt, Artificial Sequence
  derived and/or modified CDS sequence (opt5) from Lassa virus__AAT48999__NP
augagcguguccaaggagaucaaaucuuuccuguggacccagagccucagacgggaacuguccggcuacugcucuaacauuaagcugcaagucguuaaagacgcccaggcucugcuccacgggcuggauuuuagcgagguguccaaugugcagcgccuuaugagaaagcagcggcgcgacgauaacgaccugaaaagacuccgggaucugaaucaagccgucaacaaucugguggaacucaagucuacacagcaaaagagcguucugcgcgugggaacgcuuaccuccgacgaucugcucauccuggcggcugaccuugagaaacuuaagagcaaagucacaagaaccgaacggccccucucugccggcguguauauggggaaccuguccagccagcagcuggaucagcgcagagcccuccugaauaugauuggaaugucuggcgggaaccagggagcucagacaggccgggacggcguugugcgcaucugggaugucaagaaugccgagcuucugaacaaucaauucgggaccaugccuucccucacacuggcuugucuuaccaaacagggacagguggaccugaacgaugugguccaagcccucacggaccugggccugauuuacaccgcgaaguauccgaauacaagcgaccucgauagacugacccagucucaucccauccuuaacaugaucgacacaaagaaauccagccugaauauuuccggguacaacuuuucucucggagccgcuguuaaggccggcgcuugcaugcuggaugggggaaacaugcuugagaccaucaaagugagcccucagacgauggacggcauucugaaguccauccucaaagugaagaaagcccugggcauguucauuagcgauacacccggggaacggaauccuuaugagaacauccuguacaagauuugucucucuggagacggcuggcccuauaucgcgucccgcaccagcaucacagggagagccugggaaaauaccgucguggaucuggagucuggagagaagccucagaaaauuggcagcaacaauuccaacaagugccuucaaucugcuggguuuaccgccggacugagcuacucccagcucaugacacugaaagacgcuaugcugcagcuugauccgaaugccaagacguggauggacaucgaaggccggcccgaggauccuguugaaauugcccucuaccagcccagcucuggcuguuauauccacuucuuuagagagccuaccgaccugaaacaauucaagcaggacgcuaaguacucccaugggauugaugugacagaccuguuugcggcccagcccggacucaccagcgcugucaucgaagcccugccgcgcaacauggugaugacaugccagggcucugaugacauccggaaacuucuggagucccaagggagaaaggauauuaaacucaucgacauugcccugagcaagaccgauucccgcaaauaugagaaugcuguuugggaccaguacaaggaucugugucacaugcauacgggaguggucguggaaaagaaaaagaaaggcgggaaggaggaaaucacaccucacugcgcccuuauggacuguauuauguucgaugcggcugucucuggcggacucaacaccagcgugcugcgggccguucugcccagagacaugguguuucgcaccuccacaccuaaagucgugcucuga

SEQ ID NO: 2441 - RNA, 1710 nt, Artificial Sequence
  derived and/or modified CDS sequence (opt5) from Lassa virus__AAT49007__NP
augagcguguccaaggagaucaaaucuuuccuguggacccagagccucagacgggaacuguccggcuacugcucuaacauuaagcugcaagucguuaaagacgcccaggcucugcuccacgggcuggauuuuagcgagguguccaaugugcagcgccuuaugagaaagcagcggcgcgacgauaacgaccugaaaagacuccgggaucugaaucaagccgucaacaaucugguggaacucaagucuacacagcaaaagagcguucugcgcgugggaacgcuuaccuccgacgaucugcucauccuggcggcugaccuugagaaacuuaagagcaaagucacaagaaccgaacggccccucucugccggcauuuauauggggaaccuguccagccagcagcuggaucagcgcagagcccuccugaauaugaucggaaugucuggcgggaaccagggagcucagacaggccgggacggcgugguucgcauuugggaugugaagaaugccgagcuucugaacaaucaauucgggaccaugccuucccucacacuggcuugucuuaccaaacagggacaggucgaccugaacgauguggugcaagcccucacggaccugggccugaucuacaccgcgaaguauccgaauacaagcgaccucgauagacugacccagucucaucccauccuuaacaugauugacacaaagaaauccagccugaauaucuccggguacaacuuuucucucggagccgcugucaaggccggcgcuugcaugcuggaugggggaaacaugcuugagaccauuaaaguuagcccucagacgauggacggcauccugaaguccauucucaaagugaagaaagcccugggcauguucaucagcgauacacccggggaacggaauccuuaugagaacauucuguacaagaucugucucucuggagacggcuggcccuauaucgcgucccgcaccagcauuacagggagagccugggaaaauaccguggucgaucuggagucuggagagaagccucagaaaaucggcagcaacaauuccaacaagucucuucaaagcgcuggguuuaccgccggacugacauacucccagcucaugacgcugaaagacgcuaugcugcagcuugauccgaaugccaagaccuggauggacauugaaggccggcccgaggauccuguggaaaucgcccucuaccagcccagcucuggcugcuauauucacuucuuuagagagccuacagaccugaaacaauucaagcaggacgcuaaguacucccaugggaucgauguuaccgaccuguuugcggcccagcccggacucacaagcgcugugaucgaagcccugccgcgcaacauggucaugaccugucagggcucugaugacauucggaaacuucuggagucccaagggagaaaggauaucaaacucauugacaucgcccugagcaagacggauucccgcaaauaugagaaugcugugugggaccaguacaaggaucugugccacaugcauacaggaguuguggucgaaaagaaaaagaaaggcgggaaggaggaaauuaccccucacugugcccuuauggacugcaucauguucgaugcggcugccucuggcggacucaacacccuggugcugcgggccguccuccccagagacaugguguuucgcacaagcaccccuaaaguugugcuguga

SEQ ID NO: 2442 - RNA, 1710 nt, Artificial Sequence
  derived and/or modified CDS sequence (opt5) from Lassa virus__AAT49009__NP
augagcgccuccaaggaggugaaaucuuuccuguggacccagagccucagacgggaacuguccggcuacugcucuaacaucaagcugcaagucguuaaagacgcucaggcccugcuccacgggcuggauuuuagcgagguguccaaugugcagcgccuuaugagaaagcagcggcgcgacgauggagaccugaaaagacuccgggaucugaaccaagcggucaauaaccugguggaacucaagucuacacagcagaaguccguucugcgcgugggcacgcuuaauuccgacgaucugcucguccuggcugccgaccuugagaaacuuaagagcaaagugauuagaaccgaacggccccucucuuccgggaucuauaugggaaaccugagcucucagcaacuggaucagcgcagagcccuccugaauaugauuggcaugacagggggaaaccggggcggcgggaccuccagcgacggaaucguucgcgugugggaugucaagaaugcugagcuucugaacaaucaguucggcacaaugccuucucucacccuggccugucuuacaaaacaggggcaaguggaccugaacgaugcugugcaggcccucaccgaccugggacugauuuacacggcgaaguauccgaauagcagcgaccucgauagacuggcccagucccaucccauccuuaacaugaucgacaccaagaaaucuagccugaauauuuccggcuacaacuuuagccucggggcugccgucaaggcuggagccugcaugcuggauggcggcaacaugcuugagacaaucaaaguuucuccucaaaccauugacgggauccugaagacaauucucaaagugaagaaaucccugggaauguucaucagcgaugugcccggcgaacggaauccuuaugagaacauucuguacaagaucugucucucuggggacggauggcccuauaucgcgagccgcaccuccauugucggcagagccugggaaaauacggugguugaucuggagucugacaacaagccucagaaaacagggaauggaggcagcaacaagucccuucagagcgcuggcuuugccgcugggcugaccuacucucagcucaugacacugaaagauuccaugcugcaacuugacccgaauagcaagaccuggauggauaucgagggacggcccgaagacccuguggagauugcccucuaccagcccaacucuggcugcuauauccacuucuuuagagaaccuaccgaccugaaacaguucaagcaggaugccaaguacucccaugggauugacgucacagaucuguuugcugcgcaacccggacucacgagcgccgugaucgaggcucugccgcgcaauaugguuaucaccugucagggcuccgaagacauucggaaacuucuggagucucaggggagacgcgauaucaagcucauugacaucagccugaacaaagccgauucccggaaguucgagaaugccgugugggaccaguuuaaagaucugugccacaugcauacaggcgucguggucgaaaagaagaaaagaggaggcaaggaggaaauuaccccucacugugcucuuauggacugcaucauguucgaugccgcggugucugggggacucgacgcuaaaguucugcgcgccgugcugccccgggauauggucuuuagaacaagcaccccuaaggugguucucuga

SEQ ID NO: 2443 - RNA, 1710 nt, Artificial Sequence
  derived and/or modified CDS sequence (opt5) from Lassa virus__ADI39452__NP
augagcguguccaaggaggucaaaucuuuccuguggacccagagccucagacgggaacuguccggcuacugcucuaacaucaaacuucaaguugugaaggacgcccaggcucugcuccacgggcuggauuuuagcgagguguccaauguccagcgccuuaugagaaagcagcggcgcgacgauaacgaccugaaaagacuccgggaucugaaucaagccgugaacaaucugguugaacucaagucuacacagcaaaagagcgugcugcgcgucggaacgcuuaccuccgacgaucugcucauucuggcggcugaccuugagaaacugaagacaaaagugaccagaacagaacggccccucagcgccggcguuuauauggggaaccugucuucccagcagcuggagcagcgcagagcccuccugaauaugaucggaaugaacggcgggaaucagggagugcaggcuggccgggauggcgucgugcgcgugugggacgucaagaacgccgagcuucugaauaaccaauucgggaccaugccuagccucacacuggcuugucuuaccaaacagggacagguugaucugaaugacgccgugcaagcgcucacggaucugggccugauuuacaccgccaaguauccgaacacaucugaccucgacagacuggcucagucccaucccauccuuaauaugauugauaccaagaaaagcucucugaacaucuccggguacaacuuuagccucggagccgcugugaaggccggcgcgugcaugcuggacgggggaaauaugcuugaaacaaucaaagucuccccucagaccauggauggcauucugaagucuauccucaaagugaagcggacgcugggcauguucguuagcgacacacccggggagcgcaacccuuaugaaaauauucuguacaaaaucugucucuccggagauggcuggcccuauauugccagcagaaccucuaucacagggcgggcuugggagaacaccauuguggaccuggaguccgauggaaagccucagaaggucggcaauaacgggagcaauaaaucucuucaaagcgccggauuuaccgcuggccugacauacucccagcucaugacgcugaaggacgccaugcugcagcuugauccgaacgccaaaaccuggauggacaucgaaggcagacccgaggauccuguggaaguugcucucuaccagcccucuagcgggugcuauauccacuucuuucgcgagccuacagaccugaagcaauucaaacaggacgcgaaguacucccauggaauugaugugaccgaccuguuugccgcucagcccggccucacaagcgccgucaucgaagcccugccgcggaauauggugauuaccugucaggggucugaggaugucagaaaacuucuggagucccaaggacgcaaggacaucaagcucauugauaucgcucugagcaaagccgacucucggaaguaugaaaacgcggugugggaucaguacaaagaccugugccacaugcauacgggcguuguggucgagaagaagaaaagagggggcaaggaagagaugacaccucacugugcucuuauggauugcaucauguucgacgccgccguguccggaggccucagcacccagguucugcgcgcugugcugccccgggauauggucuuuagaaccuccacaccuaaaguggugcucuga

SEQ ID NO: 2444 - RNA, 1710 nt, Artificial Sequence
  derived and/or modified CDS sequence (opt5) from Lassa virus__ADU56611__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauggagaccugaagcgccucagagaucugaaccaagcggucaauaaccugguggaacucaagucuacccagcagaaaagcguucugcgggugggcacgcuuaccuccgacgaucugcucacacuggcugccgaccuugagaagcugaaaagcaaggucauucgcaccgaaagaccccucucuuccgggguguauaugggaaaucugagcacacagcaacuggagcagcggaaagcccuccugucuaugaucggcaugguugggggagcucagggcacccagccuggccgcgaugggguggucagagugugggacgugaagaacccggaucuucugaauaaccaauucggaacaaugcccucccucacccuggccugucuuacgaagcagggccaggucgaccugaaugaugcuguucucgcccugaccgaccuggggcucauuuacacagcgaaauauccuaacagcucugaccuggaucggcuuucccaaagccaucccauccugaauaugguggacaccaagaaauccucucucaacauuagcggauacaauuuuucccugggcgccgcugugaaggccggggcuugcaugcuugauggaggcaacaugcuggagacaaucaaagucaccccucagacgauggacggcauccucaagagcauucugaaagugaagcgcucucuggggauguucguuuccgauacacccggagaaagaaauccuuaugagaacauccucuacaagauuugucugagcggcgacggguggccguauaucgccucucggaccagcauugugggacgcgcgugggaaaacacaaccgucgaucuugaguccgacggcaaaccccagaagguggggaccgccggaucuaauaaaagccugcaguccgcuggcuuuccuacaggccucacguacagccaacugaugacccugaaggauucuaugaugcagcuugaccccuccgccaaaacauggaucgauauugaggggagaccugaagaccccguugagaucgcucucuaccagccgaugagcggaugcuauauccacuucuuucgggaaccuaccgaccugaagcaguucaagcaagaugccaaauacucucauggcauugacgugacagaucuguuuuccgcccagcccgggcucaccagcgcugucaucgaggcgcugccuagaaacauggugcuuacgugucagggauccgacgauauuaagaaacugcucgacucucagggccgccgggauaucaagcugauugacaucagccugaauaaagccgauuccagacgcuucgaaaacgcugucugggaccaaugcaaggaucuuugucacaugcauacaggggugguuguggagaagaaaaagcggggcggaaaagaggaaaucacaccccacugcgcccucauggacuguauuauguuugaugccgcugucucuggcgggcugaauauccccauucugagagccgugcucccucgcgacaugguuuuccggaccagcuccccgaaggugguccuguga

SEQ ID NO: 2445 - RNA, 1710 nt, Artificial Sequence
  derived and/or modified CDS sequence (opt5) from Lassa virus__ADU56615__NP
augagcgccuccaaggaggugaaaucuuuccuguggacccagagccucagacgggaacuguccggcuacugcucuaacaucaagcugcaagucguuaaagacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccguucugcggauuggaacgcuuagcucugacgaucugcucauccuggcugccgaccuugagaagcugaaauccaaggugguccgcaccgaaagaccccucagcucuggcauuuauauggggaaucuguccagccagcaacuggaucagcggaaagcccuccugaacaugaucggaaugacaggcgggaauggaggccgcaacgcuaccucugacggcauugugagaguuugggaugugaagaaugccgagcuucugaacaaucaguucgggacaaugccuucccucacccuggcuugucuuacaaagcagggacaagucgaccugaacgaugccgugcaggcgcucaccgaccugggccugaucuacacggccaaauauccgaauagcuccgaccucgaucggcuggcucagucucaucccauccuuaacaugauugacaccaagaaaagcucccugaauaucagcggguacaacuuuucucucggagccgcugugaaggccggcgcgugcaugcuggaugggggaaacaugcuugagacaauuaaagucuccccucaaaccauggacggcauccuuaagagcauucucaaaguuaagcgcucucugggcauguucaucagcgauacacccggggaaagaaauccuuaugagaacauucuguacaagaucugucucuccggagacggcuggcccuauaucgccucucggaccagcauuguggggcgcgcuugggaaaauacgguggucgaucuggagacagacaacaaaccucagaagaccggaaauggcggguccaacaaaagccuucagucugccggauuugcugccggccugacauacucccagcucaugacccugaaggauagcaugcugcaacuugacccgaaugccaaaaccuggauggauaucgagggcagacccgaagacccuguggagauugcucucuaccagcccguuucugggugcuauauccacuucuuucgggaaccuacagaccugaagcaguucaagcaggaugcgaaauacucccauggaauugacgugacggaucuguuugccgcucaacccggccucaccagcgccgucaucgaggcccugccgagaaacauggugaucacaugucagggguccgaagacauucgcaaacuucuggagucucagggacggagagauaucaagcucauugacaucagccuguccaagguugauucucgcaaauucgagaaugcugugugggaccaguuuaaggaucugugccacaugcauaccggcauugucguggaaaagaaaaagagagggggcaaagaggaaaucacaccucacugugcccuuauggacugcaucauguucgaugcggcugucagcggaggcguggacgccaagguucuccgggccgugcugccccgcgauauggucuuucggaccuccacgccuaaagugguucuguga

SEQ ID NO: 2446 - RNA, 1710 nt, Artificial Sequence
  derived and/or modified CDS sequence (opt5) from Lassa virus__ADU56619__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauggagaccugaagcgccucagagaucugaaccaagcggucaauaaccugguggaacucaagucuacacagcagaaaagcguucugcgggugggcacgcuuuccagcgacgaucugcucguccuggcugccgaccuugagaagcugaaaucuaaggugguucgcaccgaaagaccccucuccagcgggauuuauaugggaaaucugucuucccagcaacuggaucagcggaaagcccuccugaacaugaucggcaugacagggggaaauggcggccgcaacaccacaagcgacgggauugugagagucugggaugugaagaaugcugagcuucugaacaaucaguucggaaccaugccuucucucacacuggccugucuuaccaagcagggccaaguggaccugaacgaugcuguccaggcccucacggaccuggggcugaucuacaccgcgaaauaucccaauuccagcgaccucgaucggcuggcccagucccauccgauucuuaacaugaucgacacaaagaaaucuagccugaauaucuccggauacaacuuuagccucggcgcugccguuaaggcuggggccugcaugcuggauggaggcaacaugcuugagaccauuaaagugucuccucaaacaauggacggcauccugaaguccauucucaaagugaagcgcagccuggggauguucaucucugauacccccggagaaagaaauccuuaugagaacauucuguacaagaucugucucagcggcgacggguggcccuauauugcgucccggacgucuaucgucggacgcgccugggaaaauacagugguugaucuggagagcgacaacaaaccucagaagaccggcaaugggggauccaacaaaagccuucagucugcuggcuuugccgcuggccugacauacucccagcucaugacccugaaggauagcaugcugcaacuugacccgaaugccaaaaccuggauggauaucgaggggagacccgaagacccuguggagauugcccucuaccagcccucuuccggaugcuauauccacuucuuucgggaaccuacagaccugaagcaguucaagcaggaugcuaaauacagccauggcauugacgucacggaucuguuugcggcccaacccgggcucaccuccgcugugaucgaggcccugccgagaaacaugguuauuacaugucagggaucugaagacauccgcaaacuucuggagagccagggccggagagauaucaagcucauugacaucucccugucuaagguggauagccgcaaauucgagaaugccgucugggaccaguuuaaggaucugugccacaugcauaccgggauuguggucgaaaagaaaaagcggggcggaaaagaggaaaucacaccucacugugcucuuauggacugcauuauguucgaugccgcgguguccggcgggguugacgcuaaggugcucagagccguccugccccgcgauaugguguuucggaccagcacgccuaaaguugugcuguga

SEQ ID NO: 2447 - RNA, 1710 nt, Artificial Sequence
  derived and/or modified CDS sequence (opt5) from Lassa virus__ADU56623__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaaccuuauuggaauggugggcggggcucagggaacccagccuggcagagauggcguugugcgggucugggacgugaaaaauccggaucugcucaacaaucaauucgggacaaugcccucccugacccuugccugucugacgaagcagggacagguggaccucaacgaugcuguccuggcccugaccgaccucggccugaucuacacagcgaaguauccuaauagcucugaccuugaucgccugucccaaagccaucccauucucaacaugguugacaccaaaaaguccucucugaauaucagcggguuuaacuucucccuuggagccgcugugaaagccggcgcuugcaugcuggaugggggaaauaugcucgagacaaucaaggugaccccucagacgauggacggcauucugaaaagcauccugaaggucaaaaagucucucggcauguuuguguccgauacacccggggaaagaaacccuuacgagaacauucuguauaagaucugucuuagcggagacggcuggccguacauugccucucggaccagcaucguugggcgcgcgugggaaaauacaaccguggaucuggaguccgacggaaaaccccacaaggucggcaccgccgggucuaacaaaagccuccaguccgcuggauucccuacaggccugacguauagccagcugaugacccuuaaggauucuaugaugcaacucgaccccuccgccaaaacauggauugauaucgagggcagaccugaagaccccguggagaucgcucuguaccagccgaugagcgggugcuacauucacuuuuuccgggaaccuaccgaccugaagcaguuuaagcaggaugccaaauauucucauggaaucgacguugccgaucucuuccccgcucaaccuggccugacauccgcggugauugaggcccuucccagaaauaugguccugaccugucaggggagcgacgauaucaagcgccuccuggacucccagggacggagagauauuaaacugaucgacaucgcucuuucuaaggccgauagccgccgguuugaaaacgccgugugggaccagugcaaagaucucugucauaugcacacgggcgucgugguugagaagaagaaaagagggggcaaggaggaaauuacaccccacugcgcucugauggacuguaucauguacgaugccgcgguguccggaggccugaauauuccuguccuccgcgcugugcugccgcgggacaugguuuucagaaccucuagccccaaagugguccuuuga

SEQ ID NO: 2448 - RNA, 1710 nt, Artificial Sequence
  derived and/or modified CDS sequence (opt5) from Lassa virus__ADU56627__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugaacacacagcaacuggagcagcggcgcgcccuccugaauaugauuggaauggcuggcggggcccagggaacccagccuggcagagauggcgugguucgggugugggacgucaaaaacccggaucuucugaauaaccaauucgggacaaugcccucucucacccuggcuugucuuacgaagcagggacagguggaccugaaugaugccgugcucgcgcugaccgaccugggccucaucuacacagccaaguauccuaacuccagcgaccuggaucgccuuucucaaucccaucccauucugaauauggucgacaccaaaaagagcucccucaacaucucuggguacaauuuuagccugggagcugccguuaaagcuggcgccugcaugcuugaugggggaaacaugcuggagacaaucaaggugaccccucagacgauggacggcauucucaaauccauccugaaggugaaaaagagccugggcauguucgucucugauacacccggggaaagaaacccuuaugagaauauucucuacaagaucugucuguccggagacggcuggccguauauugcgagccggaccucuaucguggggcgcgccugggaaaacacaaccguugaucuugagagcgacggaaaaccccagaaggugggcaccgcuggguccaauaaaucucugcagagcgccggauuuccuacaggccucacguacucccaacugaugacccugaaggauagcaugaugcagcuugaccccucugcuaaaacauggauugauaucgagggcagaccugaagaccccgucgagaucgcccucuaccagccgauguccgggugcuauauucacuucuuucgggaaccuaccgaccugaagcaguucaagcaagaugccaaauacagccauggaaucgacguggcugaucuguuucccgcgcagccuggccucacaucugccguuauugaggcucugcccagaaacauggugcuuaccugucagggguccgacgauaucaagcgccugcucgacagccagggacggagagauauuaaacugaucgacaucgcccuguccaaggccgauucucgccgguucgaaaaugcugucugggaccaaugcaaagaucuuugucacaugcauacgggcguggucguggagaagaagaaaagagggggcaaggaggaaauuacaccccacugcgcccucauggacuguaucauguaugaugcggcuguuagcggaggccugaacauuccugugcugcgcgccguccucccgcgggacaugguguuuagaaccuccucucccaaaguugugcuguga

SEQ ID NO: 2449 - RNA, 1710 nt, Artificial Sequence
  derived and/or modified CDS sequence (opt5) from Lassa virus__ADU56631__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacccagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaacaugauuggaauggugggcggggcucagggaacccagccuggcagagauggcguugugcgggucugggacgugaaaaauccggaucuucugaacaaucaauucgggacaaugcccucccucacccuggccugucuuacgaagcagggacagguggaccugaacgaugcuguccucgcccugaccgaccugggccucaucuacacagcgaaguauccuaauagcucugaccuggaucgccuuucccaaagccaucccauucugaacaugguugacaccaaaaaguccucucucaauaucagcggguacaacuuuucccugggagccgcugugaaagccggcgcuugcaugcuugaugggggaaauaugcuggagacaaucaaggugaccccucagacgauggacggcauucucaaaagcauccugaaggucaaaaagucucugggcauguucguguccgauacacccggggaaagaaacccuuaugagaacauucucuacaagaucugucugagcggagacggcuggccguauauugccucucggaccagcaucguugggcgcgcgugggaaaauacaaccguggaucuugaguccgacggaaaaccccagaaggucggcaccgccgggucuaacaaaagccugcaguccgcuggauuuccuacaggccucacguacagccaacugaugacccugaaggauucuaugaugcagcuugaccccuccgccaaaacauggauugauaucgagggcagaccugaagaccccguggagaucgcucucuaccagccgaugagcgggugcuauauucacuucuuucgggaaccuaccgaccugaagcaguucaagcaagaugccaaauacucucauggaaucgacguuacagaucuguuucccgcccagccuggccucaccuccgcugugauugaggcgcugcccagaaauaugguccuuacgugucaggggagcgacgauaucaagcgccugcucgacucccagggacggagagauauuaaacugaucgacaucgcccugucuaaggcugauagccgccgguucgaaaacgccgugugggaccaaugcaaagaucuuugucacaugcauacaggcgucgugguugagaagaagaaaagagggggcaaggaggaaauuacaccccacugcgcccucauggacuguaucauguaugaugcugccguguccggaggccugaauauuccuguccugcgcgcggugcucccgcgggacaugguuuuuagaaccucuagccccaaagugguccuguga

SEQ ID NO: 2450 - RNA, 1710 nt, Artificial Sequence
  derived and/or modified CDS sequence (opt5) from Lassa virus__AFY05580__NP
augagcgccuccaaggagaucaaaucuuuccuguggacccagagccucagacgggaacuguccggcuacugcucuaacauuaaacuucaaguggucaaggacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacugagaagcaagguuauccggacagagcgcccccucucugccggcguguauauggggaaccuguccagccagcagcuggaucagagacgggcucuccugaauaugauuggaaugucuggcgggaaccagggagcccgcgcuggcagagacggcgucgugcggguuugggaugugaaaaaugccgagcuucuguccaaccaguucgggaccaucccuagccucacacuggcgugucuuaccaagcagggacaagucgaccugaaugaugccgugcaggcucucacagaccugggccugaucuacaccgccaaauauccgaacacgucugaccucgaucgccugacccagucccaucccauucuuaauaugaucgacacaaagaaaagcucccugaacauuucuggguacaauuuuagccucggagcugccgugaaggcgggcgccugcaugcuggaugggggaaacaugcuugaaaccaucaaggucuccccucaaacaauggacggcauucugaaaagcauccucaagguuaaaaaggcucugggcauguucauuucugauacccccggggagagaaacccuuaugaaaauauccuguacaaaaucugucucuccggagacggcuggcccuauauugccagccggacgucuaucacagggagagcuugggagaacaccgugguggaucuggagagcggaggcaagccucagaaggccgacuccaauaacucuagcaaaucccuucagagcgccggguuuacagcuggacugaccuacucucagcucaugacccugaaggaugcgaugcugcaacuugacccgaaugccaaaacauggauggauauugaaggccgccccgaggacccugucgaaaucgcucucuaccagcccuccagcggcugcuauauucacuucuuucgggagccuacggaccugaagcaguucaaacaggaugccaaguacucucaugggaucgacgugaccgaucuguuugccacacaacccggacucaccuccgcuguuaucgacgcccugccgagaaacauggugauuacaugucagggcagcgaugacauccgcaaacuucuggaaucccaggggcggaaggauauuaagcucaucgacauugaucugucuaaaaccgacagcagaaaguaugagaaugcggucugggaucaguacaaagaccugugccacaugcauacgggagugguuguggagaagaagaaacgcggcgggaaggaagagaucacaccucacugugcucuuauggauugcaucauguucgacgccgccgucuccggcggacucaacaccucugugcugcgggcuguccugcccagagacaugguguuucgcaccagcacaccucggguugugcucuga

SEQ ID NO: 2451 - RNA, 1710 nt, Artificial Sequence
  derived and/or modified CDS sequence (opt5) from Lassa virus__AFY05581__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuaucagaacagagcggccccucucugccggcguguauauggggaaccuguccagccagcagcuggaucagcgcagagcucuccugaauaugauuggaaugucuggcgggaaccagggagcccgggcuggccgcgacggcgucgugagaguuugggaugugaagaaugccgagcuucuguccaaccaguucgggaccaucccuagccucacacuggcgugucuuaccaaacagggacaagucgaccugaaugaugccgugcaggcucucacagaccugggccugaucuacaccgccaaguauccgaacacgucugaccucgaucggcugacccagucccaucccauucuuaauaugaucgacacaaagaaaagcucccugaacauuucuggguacaauuuuagccucggagcugccgugaaggcgggcgccugcaugcuggaugggggaaacaugcuugaaaccaucaaagucuccccucaaacaauggacggcauucucaagagcauccugaaaguuaagaaagcucugggcauguucauuucugauacccccggggagcgcaacccuuaugaaaauauccuguacaagaucugucucuccggagacggcuggcccuauauugccagcagaacgucuaucacagggcgggcuugggagaacaccgugguggaucuggagagcggaggcaagccucagaaagccgacuccaauaacucuagcaagucccuucagagcgccggguuuacagcuggacugaccuacucucagcucaugacccugaaagaugcgaugcugcaacuugacccgaaugccaagacauggauggauauugaaggcagacccgaggacccugucgaaaucgcucucuaccagcccuccagcggcugcuauauucacuucuuucgcgagccuacggaccugaaacaguucaagcaggaugccaaguacucucaugggaucgacgugaccgaucuguuugccacacaacccggacucaccuccgcuguuaucgacgcccugccgcggaacauggugauuacaugucagggcagcgaugacaucagaaaacuucuggaaucccaggggcgcaaggauauuaaacucaucgacauugaucugucuaagaccgacagccggaaauaugagaaugcggucugggaucaguacaaggaccugugccacaugcauacgggagugguuguggagaagaaaaagagaggcgggaaagaagagaucacaccucacugugcucuuauggauugcaucauguucgacgccgccgucuccggcggacucaacaccucugugcugaaggcuguccugccccgcgacaugguguuucggaccagcacaccuagaguugugcucuga

SEQ ID NO: 2452 - RNA, 1710 nt, Artificial Sequence
  derived and/or modified CDS sequence (opt5) from Lassa virus__AFY05587__NP
augagcgccuccaaggagaucaaaucuuuccuguggacccagagccucagacgggaacuguccggcuacugcucuaacauuaaacuucaaguggucaaggacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacugagaagcaagguuauccggacagagcgcccccucucugccggcguguauauggggaaccuguccagccagcagcuggaucagagacgggcucuccugaauaugauuggaaugucuggcgggaaccagggagcccgcgcuggcagagacggcgucgugcggguuugggaugugaaaaaugccgagcuucuguccaaccaguucgggaccaugccuagccucacacuggcgugucuuaccaagcagggacaagucgaccugaaugaugccgugcaggcucucacagaccugggccugaucuacaccgccaaauauccgaacacgucugaccucgaucgccugacccagucccaucccauccuuaauaugauugacacaaagaaaagcucccugaacaucucuggguacaauuuuagccucggagcugccgugaaggcgggcgccugcaugcuggaugggggaaacaugcuugaaaccauuaaggucuccccucaaacaauggacggcauccugaaaagcauucucaagguuaaaaaggcucugggcauguucaucucugauacccccggggagagaaacccuuaugaaaauauucuguacaaaaucugucucuccggagacggcuggcccuauaucgccagccggacgucuauuacagggagagcuugggagaacaccgugguggaucuggagagcgacggaaagccucagaaggccgauuccaauaacucuagcaaaucccuucagagcgccggcuuuacagcugggcugaccuacucucagcucaugacccugaaggacgcgaugcugcaacuugauccgaaugccaaaacauggauggacaucgaaggacgccccgaggacccugucgaaauugcucucuaccagcccuccagcggcugcuauauccacuucuuucgggagccuacggaucugaagcaguucaaacaggacgccaaguacucucauggcauugaugugaccgaccuguuugccacacaacccgggcucaccuccgcuguuaucgaugcccugccgagaaacauggugaucacaugucagggaagcgacgauauucgcaaacuucuggaaucccagggccggaaggacaucaagcucauugauaucgaccugucuaaaaccgauagcagaaaguaugagaaugcggucugggaccaguacaaagaucugugccacaugcauacgggggugguuguggagaagaagaaacgcggaggcaaggaagagauuacaccucacugugcucuuauggacugcaucauguucgacgccgccgucuccgggggccucaacaccucugugcugcgggcuguccugcccagagauaugguguuucgcaccagcacaccucggguugugcucuga

SEQ ID NO: 2453 - RNA, 1710 nt, Artificial Sequence
  derived and/or modified CDS sequence (opt5) from Lassa virus__AFY05591__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuaucagaacagagcggccccucucugccggcguguauauggggaaccuguccagccagcagcuggaucagcgcagagcucuccugaauaugauuggaaugucuggcgggaaccagggagcccgggcuggccgcgacggcgucgugagaguuugggaugugaagaaugucgagcuucuguccaaccaguucgggaccaugccuagccucacacuggccugucuuaccaaacagggacaaguggaccugaaugaugcggugcaggcccucacagaccugggccugaucuacaccgcuaaguauccgaacacgucugaccucgaucggcuggcccagucccaucccauccuuaauaugauugacaccaagaaaagcucccugaacaucucuggguacaauuuuagccucggagcugccgucaaggcgggcgccugcaugcuggaugggggaaacaugcuugaaacaauuaaaguuuccccucaaaccauggacggcauccucaagagcauucugaaagugaagaaagcucugggcauguucaucucugauacacccggggagcgcaacccuuaugaaaauauucuguacaagaucugucucuccggagacggcuggcccuauaucgccagcagaaccucuauuacggggcgggcuugggagaacacaguggucgaucuggagagcgacggaaagccucagaaagccgauuccaauaacucuagcaagucccuucagagcgccggcuuuaccgcugggcugacauacucucagcucaugacccugaaagacgcgaugcugcaacuugauccgaaugccaagaccuggauggacaucgaaggaagacccgaggacccuguggaaauugcucucuaccagcccuccagcggcugcuauauccacuucuuucgcgagccuacagaucugaaacaguucaagcaggacgccaaguacucucauggcauugauguuacggaccuguuugccacccaacccgggcucacauccgcugugaucgaugcccugccgcggaacauggucaucaccugucagggaagcgacgauauuagaaaacuucuggaaucccagggccgcaaggacaucaaacucauugauaucgaccugucuaagacagauagccggaaauaugagaaugcggugugggaccaguacaaggaucugugccacaugcauaccgggguuguggucgagaagaaaaagagaggaggcaaagaagagauuacgccucacugugcucuuauggacugcaucauguucgacgccgccguguccgggggccucaacacaucuguccugcgcgcugugcugccccgggauaugguuuuuagaaccagcaccccucgcgugguccucuga

SEQ ID NO: 2454 - RNA, 1710 nt, Artificial Sequence
  derived and/or modified CDS sequence (opt5) from Lassa virus__AFY05597__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuaucagaacagagcggccccucucugccggcguguauauggggaaccuguccagccagcagcuggaucagcgcagagcucuccugaauaugauuggaaugucuggcgggaaccagggagcccgggcuggccgcgacggcgucgugagaguuugggaugugaagaaugccgagcuucuguccaaccaguucgggaccaugccuagccucacacuggcgugucuuaccaaacagggacaagucgaccugaaugaugccgugcaggcucucacagaccugggccugaucuacaccgccaaguauccgaacacgucugaccucgaucggcugacccagucccaucccauccuuaauaugauugacacaaagaaaagcucccugaacaucucuggguacaauuuuagccucggagcugccgugaaggcgggcgccugcaugcuggaugggggaaacaugcuugaaaccauuaaagucuccccucaaacaauggacggcauccucaagagcauucugaaaguuaagaaagcucugggcauguucaucucugauacccccggggagcgcaacccuuaugaaaauauucuguacaagaucugucucuccggagacggcuggcccuauaucgccagcagaacgucuauuacagggcgggcuugggagaacaccgugguggaucuggagagcgacggaaagccucagaaagccgauuccaauaacucuagcaagucccuucagagcgccggcuuuacagcugggcugaccuacucucagcucaugacccugaaagacgcgaugcugcaacuugauccgaaugccaagacauggauggacaucgaaggaagacccgaggacccugucgaaauugcucucuaccagcccuccagcggcugcuauauccacuucuuucgcgagccuacggaucugaaacaguucaagcaggacgccaaguacucucauggcauugaugugaccgaccuguuugccacacaacccgggcucaccuccgcuguuaucgaugcccugccgcggaacauggugaucacaugucagggaagcgacgauauuagaaaacuucuggaaucccagggccgcaaggacaucaaacucauugauaucgaccugucuaagaccgauagccggaaauaugagaaugcggucugggaccaguacaaggaucugugccacaugcauacgggggugguuguggagaagaaaaagagaggaggcaaagaagagauuacaccucacugugcucuuauggacugcaucauguucgacgccgccgucuccgggggccucaacaccucugugcugcgcgcuguccugccccgggauaugguguuuagaaccagcacaccucgcguugugcucuga

SEQ ID NO: 2455 - RNA, 1710 nt, Artificial Sequence
  derived and/or modified CDS sequence (opt5) from Lassa virus__AFY05610__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuaucagaacagagcggccccucucugccggcguguauauggggaaccuguccagccagcagcuggaucagcgcagagcucuccugaauaugauuggaaugucuggcgggaaccagggagcccgggcuggccgcgacggcgucgugagaguuugggaugugaagaaugccgagcuucuguccaaccaguucgggaccaugccuagccucacacuggcgugucuuaccaaacagggacaagucgaccugaaugaugccgugcaggcucucacagaccugggccugaucuacaccgccaaguauccgaacacgucugaccucgaucggcugacccagucccaucccauccuuaauaugauugacacaaagaaaagcucccugaacaucucuggguacaauuuuagccucggagcugccgugaaggcgggcgccugcaugcuggaugggggaaacaugcuugaaaccauuaaagucuccccucaaacaauggacggcauccucaagagcauucugaaaguuaagaaagcucugggcauguucaucucugauacccccggggagcgcaacccuuaugaaaauauucuguacaagaucugucucuccggagacggcuggcccuauaucgccagcagaacgucuauuacagggcgggcuugggagaacaccgugguggaucuggagagcgacggaaagccucagaaagccgauuccaauaacucuagcaagucccuucagagcgccggcuuuacagcugggcugaccuacucucagcucaugacccugaaagacgcgaugcugcaacuugauccgaauacaaagacguggauggacaucgaaggaagacccgaggacccugucgaaauugcccucuaccagcccuccagcggcugcuauauccacuucuuucgcgagccuaccgaucugaaacaguucaagcaggacgcuaaguacucucauggcauugaugugacagaccuguuugccacccaacccgggcucacauccgccguuaucgaugcucugccgcggaacauggugaucaccugucagggaagcgacgauauuagaaaacuucuggaaucccagggccgcaaggacaucaaacucauugauaucgaccugucuaagacggauagccggaaauaugagaaugccgucugggaccaguacaaggaucugugccacaugcauacaggggugguuguggagaagaaaaagagaggaggcaaagaagagauuaccccucacugugcgcuuauggacugcaucauguucgacgcugccgucuccgggggccucaacaccucugugcugcgcgccguccugccccgggauaugguguuuagaacaagcaccccucgcguugugcucuga

SEQ ID NO: 2456 - RNA, 1710 nt, Artificial Sequence
  derived and/or modified CDS sequence (opt5) from Lassa virus__AFY05616__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuaucagaacagagcggccccucucugccggcguguauauggggaaccuguccagccagcagcuggaucagcgcagagcucuccugaauaugauuggaaugucuggcgggaaccagggagcccgggcuggccgcgacggcgucgugagaguuugggaugugaagaaugccgagcuucuguccaaccaguucgggaccaugccuagccucacacuggcgugucuuaccaaacagggacaagucgaccugaaugaugccgugcaggcucucacagaccugggccugaucuacaccgccaaguauccgaacacgucugaccucgaucggcuggcucagucccaucccauccuuaauaugauugacaccaagaaaagcucccugaacaucucuggguacaauuuuagccucggagccgcggugaaggccggcgcuugcaugcuggaugggggaaacaugcuugaaacaauuaaagucuccccucaaaccauggacggcauccucaagagcauucugaaaguuaagaaagcccugggcauguucaucucugauacacccggggagcgcaacccuuaugaaaauauucuguacaagaucugucucuccggagacggcuggcccuauaucgcuagcagaaccucuauuacggggcgggccugggagaacacagugguggaucuggagagcgacggaaagccucagaaagccgauuccaauaacucuagcaagucccuucagagcgcuggcuuuaccgcggggcugacauacucucagcucaugacccugaaagacgccaugcugcaacuugauccgaaugcuaagaccuggauggacaucgaaggaagacccgaggacccugucgaaauugcccucuaccagcccuccagcggcugcuauauccacuucuuucgcgagccuacagaucugaaacaguucaagcaggacgccaaguacucucauggcauugaugugacggaccuguuugcuacccaacccgggcucacauccgccguuaucgaugcgcugccgcggaacauggugaucaccugucagggaagcgacgauauuagaaaacuucuggaaucccagggccgcaaggacaucaaacucauugauaucgaccugucuaagacagauagccggaaauaugagaaugcugucugggaccaguacaaggaucugugccacaugcauaccggggugguuguggagaagaaaaagagaggaggcaaagaagagauuacgccucacugugcccuuauggacugcaucauguucgacgccgcugucuccgggggccucaacacaucugugcugcgcgccguccugccccgggauaugguguuuagaaccagcaccccucgcguugugcucuga

SEQ ID NO: 2457 - RNA, 1716 nt, Artificial Sequence
  derived and/or modified CDS sequence (opt5) from Lassa virus__AFY05618__NP
augagcgccuccaaggagaucaaaucuuuccuguggacccagagccucagacgggaacuguccggcuacugcucuaacauuaaacuucaaguggucaaggacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacugagaagcaagguuauccggacagagcgcccccucucugccggcguguauauggggaaccuguccagccagcagcuggaucagagacgggcucuccugaauaugauuggaaugucuggcgggaaccagggagcccgcgcuggcagagacggcgucgugcggguuugggaugugaaaaaugccgagcuucuguccaaccaguucgggaccaugccuagccucacacuggcgugucuuaccaagcagggacaagucgaccugaaugaugccgugcaggcucucacagaccugggccugaucuacaccgccaaauauccgaacacgucugaccucgaucgccugacccagucccaucccauccuuaauaugauugacacaaagaaaagcucccugaacaucucuggguacaauuuuagccucggagcugccgugaaggcgggcgccugcaugcuggaugggggaaacaugcuugaaaccauuaaggucuccccucaaacaauggacggcauccugaaaagcauucucaagguuaaaaaggcucugggcauguucaucucugauacccccggggagagaaacccuuaugaaaauauucuguacaaaaucugucucuccggagacggcuggcccuauaucgccagccggacgucuauuacagggagagcuugggagaacaccgugguggaucuggagagcgacggaaagccucagaaggccgauuccaauaacucuagcaaaucccuucagagcgccggcuuuacagcugggcugaccuacucucagcucaugacccugaaggacgcgaugcugcaacuugauccgaaugccaaaacauggauggacaucgaaggacgccccgaggacccugucgaaauugcucucuaccagcccuccagcggcugcuauauccacuucuuucgggagccuacggaucugaagcagaaacaguucaagcaagacgccaaguacucucauggcauugaugugaccgaccuguuugccacacagcccgggcucaccuccgcuguuaucgaugcccugccgagaaacauggugaucacaugucagggaagcgacgauauucgcaaacuucuggaaucccagggccggaaggacaucaaacucauugauaucgaccugucuaagaccgauagcagaaaauaugagaaugcggucugggaccaauacaaggaucugugccacaugcauacgggggugguuguggagaagaaaaagcgcggaggcaaagaagagauuacaccucacugugcucuuauggacugcaucauguucgacgccgccgucuccgggggccucaacaccucugugcugcgggcuguccugcccagagauaugguguuucgcaccagcacaccucggguugugcucuga

SEQ ID NO: 2458 - RNA, 1710 nt, Artificial Sequence
  derived and/or modified CDS sequence (opt5) from Lassa virus__AHC95552__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagcggcgcgacgauggagaccugaaaagacuccgggaucugaaccaagcggucaauaaccugguggaacucaagucuacccagcagaagaauguucugcgcgugggcacgcuuaacagcgacgaucugcucacccuggcugccgaccuugagaaacugaaguccaaagucacaagaaccgaacggccccucagcucugggguguauaugggaaaucuguccagccagcaacuggaucagcgcagagcccuccugaacaugauuggcaugacagggggaaaucagggcacccaggcuggccgggacgggguugugcgcgucugggaugugaagaacgccgagcuucugaauaaccaauucggaacaaugccuucucucacccuggcuugucuuacgaaacagggccaggccgaccugaaugaugugguccaagcgcucaccgaccuggggcugaucuacacagccaaguauccgaacgcuuccgaccucgauagacugacccagagccaucccauucuuaauaugaucgacacaaagaaaucuucccugaacauuagcggauacaacuuuucccucggcgccgcuguuaaggccggggcgugcaugcuggauggaggcaauaugcuugagaccaucaaagugucuccucagagcauggacggcauccugaaguccauucucaaagugaagcgggcccuggggauguucgucagcgauacgcccggagaacgcaacccuuaugagaauauccuguacaaaauuugucucucuggcgacggguggcccuauaucgcuuccagaacaagcauugugggacgggccugggaaaacaccguuguggaucuggaggcugacggcaauccuaagaaacuuaacucuaaugggagcaacaagucccugcagucugccggauuuccggccggccucacauacagccaacugaugacccugaaggaugcuaugcuucagcucgaccccaaugcgaaaaccuggauggauaucgagggcagaccugaagaccccgucgagguggcccuguaccagccuaacuccgggugcuauauucacuucuuucgcgaacccacagaccugaagcaguucaaacaagaugcuaaguacagccauggaaucgacguuacggaucucuuugccgcccagccgggccugaccucugcugugaucgaggcccuuccucggaauauggucauuacaugucagggguccgaagacaucagaaagcugcucgagagccagggacgcaaagauauuaagcugaucgacauugcgcugucuaaaaccgauucccggaaguucgagaacgcugugugggaccaauauaaagaucuuugccacaugcauacaggcgucgugguugaaaagaagaaaagagggggcaaggaggaaaucacgccccacugugcccucauggacugcaucauguuugaugccgcugugagcggaggccugaauacccugguccuccgcgccgugcugccucgggacaugguuuucagaacauccacaccccgcgugguccuuuga

SEQ ID NO: 2459 - RNA, 1710 nt, Artificial Sequence
  derived and/or modified CDS sequence (opt5) from Lassa virus__AHC95554__NP
augagcgccuccaaggaggugagaucuuuccuguggacccagagccuccggcgcgaacuguccggcuacugcucuaacaucaaacuucaagucguuaaggacgcucaggcccugcuccacgggcuggauuuuagcgagguguccaaugugcagagacuuaugcggaaacagcgcagagacgauggagaccugaagcggcuccgcgaucugaaccaagcggucaauaaccugguggaacucaaaucuacacagcaaaagagcguucugagagugggcacgcuuaauuccgacgaucugcucacccuggcugccgaccuugagaagcugaaaagcaaggucacacggaccgaacgcccccucucuuccgggguguauaugggaaaccugagcucucagcagcuggaucagagacgggcccuccugaauaugauuggcaugacagggggaaaccagggcgcucaggccggccgcgacgggguugugagagucugggaugugaaaaaugcugagcuucugaacaaucaauucggaaccaugccuucccucacacuggccugucuuaccaagcagggccagguggaccugaacgaugucguucaagcgcucacggaccuggggcugaucuacaccgccaaauauccgaauacaagcgaccucgaucggcugacccagucucaucccauucuuaacaugaucgacacaaagaaguccagccugaauauuuccggauacaacuuuucucucggcgcugccgugaaagcuggggccugcaugcuggauggaggcaacaugcuugagaccaucaagaucagcccucaguccguggacggcauucugaaaagcauccucaaggucaaacgcucucuggggauguucguguccgauacgcccggagaaagaaauccuuaugagaacauucuguacaagaucugucucagcggcgacggguggcccuauauugcgucucggacaagcaucguuggcagagccugggaaaauaccguggucgaucuggaggcugacggaaaaccucagaagccgaacuccgggucuagcaauaagucccuucaaagcgccggauuucccgcuggccugacauacucucagcucaugacccugaaagaugccaugcugcagcuugacccuaacgccaagaccuggauggauauugagggccgccccgaagacccuguggagguugcucucuaccagcccuccagcgggugcuauauccacuucuuucgggaaccgacagaccugaaacaauucaagcaggaugcgaaauacucucauggaaucgacgugacggaucuguuugccgcucagccuggccucaccuccgccgucauugaggcccugcccagaaauauggugaucacaugucaggggagcgaagacauuaagaaacuucuggagucccaaggacgcaaggauaucaagcucauugacaucgcucugucuaaaaucgauagccggaaguucgagaacgccgucugggaccaguauaaagaucugugccacaugcauaccggcgugguuguggaaaagaagaaaagagggggcaaggaggaaauuacaccucacugugcgcuuauggacugcaucauguuugaugcugccgucuccggaggccucaaugccucugugcugcgcgcuguucugccccgggacaugguguucagaaccagcacgcccaaagucgugcucuga

SEQ ID NO: 2460 - RNA, 1710 nt, Artificial Sequence
  derived and/or modified CDS sequence (opt5) from Lassa virus__AHC95556__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagcggcgcgacgauggagaccugaaaagacuccgggaucugaaccaagcggucaauaaccugguggaacucaagucuacacagcagaagaauguucugcgcgugggcacgcuuaacagcgacgaucugcucacccuggcugccgaccuugagaaacugaaguccaaagucacaagaaccgaacggccccucagcucugggguguauaugggaaaucuguccagccagcaacuggaucagcgcagagcccuccugaacaugauuggcaugacagggggaaaucagggcacccagacaggccgggacgggguugugcgcgucugggaugugaagaacgcugagcuucugaauaaccaauucggaaccaugccuucucucacgcuggccugucuuaccaaacagggccaggcugaccugaaugaugugguccaagcccucacagaccuggggcugaucuacaccgcgaaguauccgaacgccuccgaccucgauagacugacacagagccaucccauucuuaauaugaucgacaccaagaaaucuucccugaacauuagcggauacaacuuuucccucggcgcugccguuaaggcuggggccugcaugcuggauggaggcaauaugcuugagacgaucaaagugucuccucagagcauggacggcauccugaaguccauucucaaagugaagcgggcgcuggggauguucgucagcgauacacccggagaacgcaacccuuaugagaauauccuguacaaaauuugucucucuggcgacggguggcccuauaucgccuccagaaccagcauugugggacgggcuugggaaaacacaguuguggaucuggaggccgacggcaauccuaagaaacuuaacucuaaugggagcaacaagucccugcagucugcuggauuuccggccggccucaccuacagccaacugaugacccugaaggaugccaugcuucagcucgaccccaaugcuaaaacauggauggauaucgagggcagaccugaagaccccgucgagguggcgcuguaccagccuaacuccgggugcuauauucacuucuuucgcgaacccacggaccugaagcaguucaaacaagaugccaaguacagccauggaaucgacguuaccgaucucuuugcugcccagccgggccugacaucugccgugaucgaggcccuuccucggaauauggucauuaccugucagggguccgaagacaucagaaagcugcucgagagccagggacgcaaagauauuaagcugaucgacauugcucugucuaaaacagauucccggaaguucgagaacgcggugugggaccaacacaaagaucuuugccauaugcacaccggcgucgugguugaaaagaagaaaagagggggcaaggaggaaaucacgccccacugugcucucauggacugcaucauguuugaugccgccgugagcggaggccugaauacacugguccuccgcgcugugcugccucgggacaugguuuucagaaccuccacccccaaagugguccuuuga

SEQ ID NO: 2461 - RNA, 1710 nt, Artificial Sequence
  derived and/or modified CDS sequence (opt5) from Lassa virus__AHC95558__NP
augagcgccuccaaggaggugagaucuuuccuguggacccagagccuccggcgcgaacuguccggcuacugcucuaacaucaaacuucaagucguuaaggacgcucaggcccugcuccacgggcuggauuuuagcgagguguccaaugugcagagacuuaugcggaaacagcgcagagacgauucugaccugaagcggcuccgcgaucugaaccaagcggucaauaaccugguggaacucaaaagcacacagcagaaguccguucugagagugggaacgcuuagcucugacgaucugcucacccuggcugccgaccuugagaagcugaaauccaaggucauucggacagaacgcccccucagcucuggcguguauauggggaaucuguccagccagcaacuggaucagagacgggcccuccugaacaugaucggaaugaccggcgggaaucagggagcucaggccggccgcgacggcguugugagagucugggaugugcggaacgcugagcuucugaauaaccaauucgggacaaugccuucucucacccuggccugucuuacaaaacagggacagguggaccugaaugaugucguucaagcgcucaccgaccugggccugauuuacacggccaaguauccgaacaccuccgaccucgaucgccugacacagaaucaucccauccuuaacaugauugacaccaaaaagagcucccugaauaucucuggguacaacuuuagccucggagcugccgugaaggcuggcgccugcaugcuggaugggggaaacaugcuugagacaaucaaaguguccccucagagcauugacggcauccugaagucuauucucaaagucaagagaacccugggcauguucguguccgauacgcccggggaacggaauccuuaugagaacauccuguacaaaauuugucucagcggagacggcuggcccuauaucgcgucuagaacaagcauuguugggcgcgccugggaaaauaccguggucgaucuggagacagaccggaagucccagggaccuaacucuggcaauagcaacaaaucccuucaaagcgcuggguuuucugccggacugaccuacucccagcucaugacccugaaggaugcuaugcugcagcuugacccgaaugccaagacauggauggauaucgagggcagacccgaagacccuguggagguugcccucuaccagcccaucagcggcugcuauauucacuucuuucgcgaaccuacggaccugaaacaauucaagcaggaugcuaaauacucucaugggaucgacauuaccgaucuguuugcggcccagcccggacucacauccgcugugaucgaggcccugccgcggaacauggucauuaccugucagggcagcgaagacaucaagaaacuucuggagucccaagggagaaaggauaucaagcucauugacaucgcccugucuaaaauugauagccgcaaguucgagaaugcugugugggaccaguauaaagaucugugccacaugcauacaggagucgugguugaaaagaaaaagcggggcgggaaggaggaaaucaccccucacugugcccuuauggacugcauuauguuugaugcggcuguguccggcggacucaacgccucuguccugagagccgugcugccccgcgacaugguuuuccggacgagcacaccuaaagugguccucuga

SEQ ID NO: 2462 - RNA, 1710 nt, Artificial Sequence
  derived and/or modified CDS sequence (opt5) from Lassa virus__AHC95560__NP
augagcgccuccaaggaggugaaaucuuuccuguggacccagagccucagacgggaacuguccggcuacugcucuaacaucaagcugcaagucguuaaagacgcucaggcccugcuccacgggcuggauuuuagcgagguguccaaugugcagcgccuuaugagaaagcagcggcgcgacgauggagaccugaaaagacuccgggaucugaaccaagcggucaauaaccugguggaacucaagucuacacagcagaagaauguucugcgcgugggcacgcuuaacagcgacgaucugcucacccuggcugccgaccuugagaaacugaaguccaaagucacaagaaccgaacggccccucagcucugggguguauaugggaaaucuguccagccagcaacuggaucagcgcagagcccuccugaacaugauuggcaugucugggggaaaucagggcacacagguuggccgggacggggugguccgcgugugggaugugaagaacgcugagcuucugaauaaccaauucggaaccaugccuucccucacacuggccugucuuaccaaacagggccaggcugaccugaaugaugucguucaagcccucacggaccuggggcugaucuacaccgcgaaguauccgaacgccagcgaccucgauagacugacacagucucaucccauucuuaauaugaucgacaccaagaaauccagccugaacauuuccggauacaacuuuucucucggcgcugccgugaaggcuggggccugcaugcuggauggaggcaauaugcuugagacaaucaaagugagcccucaguccauggacggcauccuuaagagcauucucaaagucaagcgggcgcuggggauguucgugucugauacccccggagaacgcaacccuuaugagaauauccuguacaaaauuugucucuccggcgacggguggcccuauaucgccagcagaacgucuauuguuggacgggcuugggaaaacacaguggucgaucuggaggccgacggcaauccuaagaaacuuaacagcaauggguccaacaagucucugcagagcgcuggauuuccggccggccucaccuacucccaacugaugacacugaaggaugccaugcuucagcucgaccccaaugcuaaaaccuggauggauaucgagggcagaccugaagaccccguggagguugcgcuguaccagccuaacagcgggugcuauauucacuucuuucgcgaacccaccgaccugaagcaguucaaacaagaugccaaguacucucauggaaucgacgugacagaucucuuugcugcccagccgggccugacguccgccgucaucgaggcccuuccucggaauauggugauuaccugucaggggagcgaagacaucagaaagcugcucgagucucagggacgcaaagauauuaagcugaucgacauugcucuguccaaaacagauagccggaaguucgagaacgcggucugggaccaacacaaagaucuuugccauaugcacaccggcgugguuguggaaaagaagaaaagagggggcaaggaggaaaucacaccccacugugcucucauggacugcaucauguuugaugccgccgucuccggaggccugaauacccuggugcuccgcgcuguucugccucgggacaugguguucagaacgucuacacccaaagucgugcuuuga

SEQ ID NO: 2463 - RNA, 1710 nt, Artificial Sequence
  derived and/or modified CDS sequence (opt5) from Lassa virus__AIT17127__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuaucagaacagagcggccccucucugccggcguguauauggggaaccuguccagccagcagcuggaucagcgcagagcucuccugucuaugauuggaauguccggcgggaaucagggaguccgggccggcaaggacggcgugguucgcgugugggaugucaaaaacgcugagcuucugaauaaccaguucgggaccaugccuagccucacacuggccugucuuaccaagcagggacaaguggaccugaaugaugcggugcaggcccucacagaccugggccugaucuacaccgcuaaguauccgaacacgucugaccucgauagacugacccagucccaucccauccuuaauaugauugacaccaaaaagagcucccugaacaucucuggguacaauuuuagccucggagccgcugucaaagccggcgcgugcaugcuggaugggggaaacaugcuugaaacaauuaagguuuccccucaaacaauggacggcauccugaaaagcauucucaaggugaaaaaggcccugggcauguucaucucugauacccccggggagcggaacccuuaugaaaauauucuguacaagaucugucucuccggagacggcuggcccuauaucgcuagccgcacgucuauuacagggagagccugggagaacaccguggucgaucuggagagcgacggaaaaccucagaaggcuggcuccaauaacucuaauaaaagccuucaguccgccggguuuacagccggacugaccuacagccagcucaugacccugaaggaugcuaugcugcaacuugacccgaacacaaaaacguggauggauaucgaaggccggcccgaggacccuguggaaauugcgcucuaccagcccucuuccggcugcuauauccacuucuuuagagagccuaccgaccugaagcaguucaagcaggaugccaaauacagccaugggauugacguuacagaucuguuugcugcccaacccggacucaccucugccgugaucgacgcucugccgcgcaauauggucaucacaugucagggcuccgaugacauucggaaacuucuggaaagccaggggagaaaggauaucaagcucauugacaucgcccugaacaaaaccgauucccgcaaguaugagaaugcggugugggaccaguacaaggaucugugccacaugcauacgggaguuguggucgagaaaaagaaacggggcgggaaggaagagauuacaccucacugugcucuuauggacugcaucauguucgaugccgccgugucuggcggacucaacaccagcguccugagagcugugcugccccgcgacaugguuuuucggaccuccacaccuagagugguccucuga

SEQ ID NO: 2464 - RNA, 1710 nt, Artificial Sequence
  derived and/or modified CDS sequence (opt5) from Lassa virus__AIT17131__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuuccagcgacgaucugcucguucuggcugccgaccuugaaaaacugaagucuaaagugaccagaacagagcggccccucuccgccggcgucuauauggggaaccugagcucucagcagcuggaucagcgcagagcucuccugaauaugauuggaauguccggcgggaaccagggagcccgggcuggccgcgacggcgugguuagagugugggaugucaagaaugccgagcuucugaacaaucaguucgggaccaugccuagccucacacuggcgugucuuaccaaacagggacaaguggaccugaacgaugugguccaggcccucacagaccugggccugaucuacaccgcuaaguauccgaauacgucugaccucgaucggcugacccagucccaucccauucuuaacaugguugacacaaagaaaagcucccugaauaucucuggguacaacuuuagccucggagccgcugugaaggccggcgcgugcaugcuggaugggggaaacaugcuugaaaccaucaaaguguccccucaaacaauugacggcauccuuaagagcauucucaaagucaagaaagcccugggcauguucaucucugauacccccggggagcgcaauccuuaugaaaacauucuguacaagaucugucucuccggagacggcuggcccuauauugcuagcagaacgucuaucacagggcgggccugggagaauaccgugguugaucuggagagcgacggaaagccucagaaagcuggcuccaacaauucuaacaagagccuucaguccgccggguuuacagccggacugaccuacagccagcucaugacccugaaagaugcuaugcugcaacuugacccgaaugcgaagaucuggauggauauugaaggcagacccgaggacccuguggaaaucgcccucuaccagcccucuuccggcugcuauauucacuucuuucgcgagccuacagaccugaaacaguucaagcaggaugcuaaguacagccaugggaucgacgucacggaucuguuugccgcccaacccggacucaccucugcugugauugacgcccugccgcggaacaugguuaucacaugucagggcgcggaugacaucagaaaacuucuggaaucccaggggcgcaaggauauuaaacucaucgacauugcucugaauaaggccgauagccggaaauaugagaacgccgugugggaccaguacaaggaucugugccacaugcauaccggagucguggucgagaagaaaaagagaggcgggaaagaagagaucacaccucacugugcucuuauggacugcauuauguucgaugccgcuguguccggcggacucaauaccucuguucugcgcgccgugcugccccgggacauggucuuuagaacgagcacaccucgcgugguucucuga

SEQ ID NO: 2465 - RNA, 1710 nt, Artificial Sequence
  derived and/or modified CDS sequence (opt5) from Lassa virus__AIT17139__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcgugcugcgcguuggaacgcuuaccuccgacgaucugcucauccuggcugccgaccuugaaaaacuuaagagcaaagugacaagaaccgagcggccccucucugccggcgucuauauggggaaccuguccagccagcagcuggaucagcgcagagcucuccugaauaugauuggaaugucuggcgggaaccagggagcccgggcuggccgcgacggcgugguuagagugugggaugucaagaaugccgagcuucugaacaaucaguucgggacaaugccuucccucacccuggcgugucuuacaaaacagggacaaguggaccugaacgaugccgugcaggcucucaccgaccugggccugaucuacacggccaaguauccgaauaccagcgaccucgaucggcugacacagucucaucccauucuuaacaugaucgacaccaagaaauccagccugaauaucuccggguacaacuuuucucucggagcugccgucaaggcgggcgccugcaugcuggaugggggaaacaugcuugaaacaauuaaaguuagcccucaaaccauggacuccauccucaagagcauucugaaagugaagaaagcucugggcauguucaucucugauacgcccggcgagcgcaauccuuaugaaaacauucuguacaagaucugucucuccggggacggauggcccuauauugccagcagaacaucuaucaccggccgggcuugggagaauacaguggucgaucuggagagcgacgggaagccucagaaagccggauccaacaauucuaacaagagccuucaguccgccggcuuugcugcggggcugaccuacagccagcucaugacccugaaagaugccaugcugcaacuugacccgaaugcuaagacauggauggauaucgaaggaagacccgaggacccuguggaaauugcccucuaccagcccucuuccggcugcuauauccacuucuuucgcgagccuacggaccugaaacaguucaagcaggaugccaaguacagccauggcauugacguuaccgaucuguuugcugcccaacccgggcucacaucugcggugaucgacgcucugccgcggaacauggucauuaccugucagggauccgaugacaucagaaaacuucuggaaagccagggccgcaaggauaucaaacucauugacaucgcccuguccaagacagauucucggaaauaugagaaugccgugugggaccaguacaaggaucugugccacaugcauaccgggauuguuguggagaagaaaaagagaggaggcaaagaagagaucacgccucacugugcucuuauggacugcauuauguucgaugccgcugucagcgggggccucaacacauccgugcugcgcgccguccugccccgggacaugguguuuagaaccaccacaccucgcguugugcucuga

SEQ ID NO: 2466 - RNA, 1710 nt, Artificial Sequence
  derived and/or modified CDS sequence (opt5) from Lassa virus__AIT17143__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugaauaugaucggaaugucuggcuccaaccagggggcccgggcuggacgcgacggcgucgugagaguuugggaugugaagaaugccgagcuucugaacaaucaguucggcacaaugccuagccucacccuggcgugucuuacaaaacaggggcaagucgaccugaacgaugccgugcaggcucucaccgaccugggacugauuuacacggccaaguauccgaauaccucugaccucgaucggcugacacagucccaucccauccuuaacaugaucgacaccaagaaaagcucccugaauauuucuggcuacaacuuuagccucggggcugccgugaaggcgggagccugcaugcuggauggcgggaacaugcuugaaacaaucaaagucuccccucaaaccauggacggcauucucaagagcauccugaaaguuaagaaagcucugggaauguucauuucugauacgcccggcgagcgcaauccuuaugaaaacauccuguacaagauuugucucuccggggacggauggcccuauaucgccagcagaacaucuaucaccggccgggcuugggagaauacagugguggaucuggagagcgacgggaagccucagaaagccggaaacaauggcuccaacaagucucuucagagcgccggguuuaccgcuggacugaccuacucccagcucaugacacugaaagaugcgaugcugcaacuugacccgaaugccaagacguggauggauauugaaggcagacccgaggacccugucgaaaucgcucucuaccagcccagcucuggcugcuauauucacuucuuucgcgagccuaccgaccugaaacaguucaagcaggaugccaaguacucccaugggaucgacgugacagaucuguuugccgcucaacccggacucaccagcgccguuauugacgcgcugccgcggaaccuugugaucacaugucagggcucugaugacaucagaaaacugcucgaaucccaggggcgcaaggauauuaaacugaucgacauugcucugagcaagaccgauucccggaaauaugagaaugccgucugggaccaguacaaggaucuuugccacaugcauacgggaaucgugguugagaagaaaaagagaggcgggaaagaagagauuacaccucacugugcccucauggacugcaucauguucgaugcugccgugucuggcggacugaacaccagcguccugcgcgcugugcucccccgggacauggucuuuagaaccuccacaccucgcgugguucuguga

SEQ ID NO: 2467 - RNA, 1710 nt, Artificial Sequence
  derived and/or modified CDS sequence (opt5) from Lassa virus__AIT17147__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcgugcugcgcguuggaacgcuuaccuccgacgaucugcucauccuggcugccgaccuugaaaaacuuaagagcaaagugacaagaaccgagcggccccucucugccggcgucuauauggggaaccuguccagccagcagcuggagcagcgcagagcucuccugaauaugauuggaaugucuggcuccaaccagggggcccaggcuggacgggauggcgugguucgcgugugggacgucaagaaugccgaacuucugaacaaucaguucggcacaaugccuagccucacccuggcgugucuuacaaaacaaggacagguggaucugaacgacgccgugcaggcucucaccgaucuggggcugaucuacacggucaaguauccgaauaccucugaccucgacagacugacacaaucccaucccauucuuaacaugaucgauaccaagaaaagcucccugaauaucucuggcuacaacuuuagccucggggccgcuguuaaggccggagcgugcaugcuggacggcgggaacaugcuugagacaauuaaaguguccccucagaccauggauggaauccucaagagcauucugaaagugaagaaagcccugggcauguucaucucugacacgcccggcgaacggaauccuuaugagaacauucuguacaagaucugucucuccggggauggauggcccuauauugcuagccgcacaucuaucaccggcagagccugggagaauacagucguggaccuggaaagcgaugggaagccucagaaagcugacuccaacucuagcaauaagucccuucagagcgccggauuuaccgccggccugaccuacucucaacucaugacacugaaagaugcuaugcugcagcuugacccgaacgcgaagacguggauggauaucgaggggcggcccgaagacccuguugagguggcccucuaccagcccuccagcggaugcuauauucacuucuuuagagaaccuaccgaccugaaacaguucaagcaagaugcuaaguacucucauggcaucgacgucacagaucuguuugccgcccagcccggccucaccuccgcugugauugacgcccugccgcgcaauaugguuaucacaugucaggggagcgaugacauucggaaacuucuggagucccagggaagaaaggauaucaaacucaucgacauugcgcugucuaagaccgauagccgcaaauaugagaacgcugugugggaccaauacaaggaucugugccacaugcauacgggcgucguggucgaaaagaaaaagagagggggaaaagaggaaaucacaccucacugugcccuuauggacugcauuauguucgaugccgcuguguccggcgggcucaauaccucuguucugcgggccgugcugccccgcgacauggucuuucggaccagcacaccuagagugguucucuga

SEQ ID NO: 2468 - RNA, 1710 nt, Artificial Sequence
  derived and/or modified CDS sequence (opt5) from Lassa virus__AIT17151__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugucuaugaucggaauguccggcgggaaucagggagcccgggcuggccgcgacggcgucgugagaguuugggaugugaagaacgccgagcuucugaauaaccaguucgggacaaugccuagccucacccuggcgugucuuacaaaacagggacaagucgaccugaaugauguggugcaggcccucaccgaccugggccugauuuacacggcuaaguauccgaacaccucugaccucgaucggcugacacagucccaucccauccuuaauaugaucgacaccaagaaaagcucccugaacauuucuggguacaauuuuagccucggagccgcugucaaggccggcgcgugcaugcuggaugggggaaacaugcuugaaacaaucaaaguuuccccucaaaccauggacggcauucuuaagagcauccucaaagugaagaaagcccugggcauguucauuucugauacgcccggggagcgcaacccuuaugaaaauauccuguacaagauuugucucuccggagacggcuggcccuauaucgcuagcagaacaucuaucaccgggcgggccugggagaacacaguggucgaucuggagagcgacggaaagcugcagaaagcuggcuccaauaacucuaauaagagccugcaguccgccggguuuaccgccggacucaccuacagccagcugaugacacugaaagaugcuaugcuucaacucgacccuaacgcgaagacguggauggauauugaaggcagaccggaggaccccguggaaaucgcccuguaccagccuucuuccggcugcuauauucacuucuuucgcgagcccaccgaccugaaacaguucaagcaggaugcuaaguacagccaugggaucgacguuacagaucucuuugccgcccaaccuggacugaccucugcugugauugacgcccuuccccggaauauggucaucacaugucagggcuccgaugacaucagaaaacugcucgaaagccaggggcgcaaggauauuaaacugaucgacauugcgcugaacaagaccgauucccggaaauaugagaaugcugugugggaccaguacaaggaucuuugccacaugcauacgggaguuguggucgagaagaaaaagaaaggcgggaaggaagagaucacaccgcacugugcccucauggacugcauuauguucgaugccgcugugucuggcggacugaacaccagcguccugagagccgugcucccucgcgacaugguuuuucggaccuccacacccagagugguccuguga

SEQ ID NO: 2469 - RNA, 1710 nt, Artificial Sequence
  derived and/or modified CDS sequence (opt5) from Lassa virus__AIT17155__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcgugcugcgcguuggaacgcuuaccuccgacgaacugcucgugcuggcugccgaucuugagaaacuuaagagcaaagucaucagaacagagcggccccucucugccggcguguauauggggaaccuguccagccagcagcuggaccagcgcagagcucuccugucuaugauuggaauguccggcgggaaucagggagcccggaccggccgcgauggcguugugagagucugggacgugaagaacgcugaacuucugaauaaccaguucgggacaaugccuagccucacccuggccugucuuacaaaacagggacaaguggaucugaaugacgcgguccaggcccucaccgaucugggccugaucuacacggcuaaguauccgaacaccucugaccucgaccggcugacacagucccaucccauucuuaauaugaucgauaccaagaaaagcucccugaacaucucuggguacaauuuuagccucggagccgcuguuaaggccggcgcgugcaugcuggacgggggaaacaugcuugagacaauuaaaguguccccucaaaccauggauggcauccucaagagcauucugaaagugaagaaagcccugggcauguucaucucugacacgcccggggaacgcaacccuuaugagaauauucuguacaagaucugucucuccggagauggcuggcccuauauugcuagcagaacaucuaucaccgggcgggccugggagaacacagucguggaccuggaaagcgauggaaagccucagaaagcuggcuccaauaacucuaauaagagccuucaguccgccggguuuaccgccggacugaccuacagccagcucaugacacugaaagacgcuaugcugcaacuugauccgaacgcgaagacguggauggacaucgagggcagacccgaagauccuguugagauugcccucuaccagcccucuuccggcugcuauauccacuucuuucgcgaaccuaccgaccugaaacaguucaagcaggacgcuaaguacagccaugggauugaugugacagaccuguuugccgcccaacccggacucaccucugcugucaucgaugcccugccgcggaauauggugauuacaugucagggcuccgacgauaucagaaaacuucuggagagccaggggcgcaaggacaucaaacucauugauaucgcgcuguccaagauugacucucggaaauaugagaacgcuguuugggaucaguacaaggaccugugccacaugcauaccggaguggucguggaaaagaaaaagagaggcgggaaagaggaaaucacgccucacugugcccuuauggauugcauuauguucgacgccgcugucagcggcggacucaauucccuggugcugcgcgccguucucccccgggauaugguguuuagaacaucuaccccucgcgucgugcuguga

SEQ ID NO: 2470 - RNA, 1710 nt, Artificial Sequence
  derived and/or modified CDS sequence (opt5) from Lassa virus__AIT17161__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugaauaugaucggaaugucuggcuccaaccagggggcccggacaggacgcgacggcgucgugagaguuugggaugugaagaaugcugagcuucugaacaaucaguucggcaccaugccuagccucacacuggccugucuuaccaaacaggggcaagucgaccugaacgaugcggugcaggcccucacggaccugggacugauuuacaccgcuaaguauccgaauacaucugaccucgaucggcugacccagucccaucccauccuuaacaugaucgacacaaagaaaagcucccugaauauuucuggcuacaacuuuagccucggggccgcugugaaggccggagcgugcaugcuggauggcgggaacaugcuugaaaccaucaaagucuccccucaaacgauggacggcauucucaagagcauccugaaaguuaagaaagcccugggaauguucauuucugauacacccggcgagcgcaauccuuaugaaaacauccuguacaagauuugucucuccggggacggauggcccuauaucgcuagcagaaccucuaucacaggccgggccugggagaauaccgugguggaucuggagagcgacgggaagccucagaaagcuggauccaacucuagcaauaagucccuucagagcgccggccugaccgccgggcucacauacucucagcugaugacgcugaaagaugcuaugcuucaacucgacccgaacgcgaagaccuggauggauauugaaggaagacccgaggacccugucgaaaucgcccuguaccagcccuccagcggcugcuauauucacuuuuuccgcgagccuacagaccugaaacaguuuaagcaggaugcuaaguacucucauggcaucgacgugaccgaucucuucgccgcccaacccgggcugacauccgcuguuauugacgcccuuccgcggaaucuggugaucaccugucagggaagcgaugacaucagaaaacuccuggaaucccagggccgcaaggauauuaaacugaucgacauugcgcuuucuaagacggauagccggaaauaugagaacgcugucugggaccaguacaaggaucucugccacaugcauacagggaucgugguugagaagaaaaagagaggaggcaaagaagagauuaccccucacugugcccugauggacugcaucauguuugaugccgcuguguccgggggccugaaugccucuguccuccgcgcugugcugccccgggacauggucuucagaaccagcacaccucgcgugguucuuuga

SEQ ID NO: 2471 - RNA, 1710 nt, Artificial Sequence
  derived and/or modified CDS sequence (opt5) from Lassa virus__AIT17165__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuaauaacgugcagcgccuuaugagaaaggaacggcgcgacgauaaugaccugaaaagacuccgggaucugaaccaggcggugaauaaccuggucgagcucaaguccacacaacagaagucuauccugcgcgugggaacgcuuaccagcgacgaucugcucauucuggcugccgaccuugaaaaacugaaguccaaaguuacaagaaccgagcggccccucagcgccggcguguauauggggaaucugucuucccagcagcuggaucaacgcagagcucuccugaacaugaucggaaugagcaauggcaaccaggggacacgggccggacgcgacggcgucgugagaguuugggaugugaagaaugcugagcuucugaacaaucaguucggcaccaugccuucucucacacuggccugucuuaccaaacaggggcaagucgaccugaacgauguggugcaggcgcucacggaccugggacugauuuacaccgccaaguauccgaauacauccgaccucgaucggcugacccagagccaucccauccuuaacaugaucgacacaaagaaaucuucccugaacauuagcggcuacaauuuuucccucggggcugccgucaaggcuggagccugcaugcuggauggcgggaacaugcuugaaaccaucaaaguuucuccucaaacgauggacggcauucuuaagagcauccucaaagugaagaaagcgcugggaauguucauuuccgauacacccggcgagcgcaauccuuaugaaaacauccuguacaagauuugucucagcggggacggauggcccuauaucgccucuagaaccuccaucacaggccgggcuugggagaauaccguggucgaucuggagagcgacgggaagccucagaaagccgauucuagcaacuccaauaagucucuucagagcgcuggauuuaccgccggccugacauacucccagcucaugacgcugaaagacgccaugcugcaacuugauccgaacgcuaagaccuggauggacauugaagggagacccgaggacccuguggaaguugcgcucuaccagcccagcucuggaugcuauauccacuucuuucgcgagccuacagaucugaaacaguucaagcaggacgccaaguacucccauggcauugaugugaccgaccuguuugcugcccaacccggccucacaagcgccgucaucgaugcucugccgcggaauauggugauuaccugucaggggucugacgauaucagaaaacuucuggaaucccagggacgcaaggacaucaaacucauugauaucgcccugagcaaggcggacucccggaaauaugagaacgcuguuugggaucagcacaaggaccugugccauaugcacacgggcguggucguggagaagaaaaagagagggggaaaagaagagauuacaccucacugugcccuuauggauugcaucauguacgacgccgcugucucuggcgggcucaauaccagcgugcugcgcgccguucugccccgggacaugguguucagaaccuccacaccucgcgucgugcucuga

SEQ ID NO: 2472 - RNA, 1710 nt, Artificial Sequence
  derived and/or modified CDS sequence (opt5) from Lassa virus__AIT17169__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuaucagaacagagcggccccucucugccggcguguauauggggaaccuguccagccagcagcuggaucagcgcagagcucuccugucuaugauuggaauguccagcggcaaucagcgggcccaggcugggcgcgacggagucgugagaguuugggaugugaagaacgucgagcuucugaauaaccaguucggcaccaugccuucucucacacuggccugucuuaccaaacaaggccagguggaccugaaugaugcggugcaggcccucacagaccuggggcugaucuacaccgcuaaguauccgaacacguccgaccucgaucggcugacccaaagccaucccauccuuaauaugauugacacaaagaaauccucucugaacaucagcggauacaauuuuucccucggcgccgcugucaaggccggggcgugcaugcuggauggaggcaacaugcuugaaaccauuaaaguuagcccucagacaauggacgggauccugaagucuauucucaaagugaagaaagcccugggaauguucaucuccgauacccccggcgagcgcaacccuuaugaaaauauucuguacaagaucugucucagcggcgacggguggcccuauaucgcuucuagaacgagcauuacaggacgggccugggagaacaccguggucgaucuggaguccgacggcaagccucagaaagcugggucuaauaacagcaauaagucccuucagagcgugggauuuacagccggccugaccuacucucaacucaugacccugaaagaugccaugcugcagcuugacccgaacgcuaagacauggauggauaucgaagggagacccgaggacccuguugaaauugcgcucuaccagcccuccagcggaugcuauauccacuucuuucgcgagccuacggaccugaaacaguucaagcaagaugccaaguacucucauggcauugacgugaccgaucuguuugcugcccagcccggccucacauccgccgucaucgacgcucugccgcggaauauggugaucaccugucaggggagcgaugacauuagaaaacuucuggaaucccagggacgcaaggauaucaaacucauugacaucgcccugucuaagacagauagccggaaauaugagaacgcgguuugggaccaauacaaggaucugugccacaugcauaccggcguggucguggagaagaaaaagagagggggaaaagaagagauuacgccucacugugcucuuauggacugcaucauguucgaugccgccgucuccggcgggcucaauacaucugugcugcgcgcuguucugccccgggacaugguguuuagaaccagcaccccucgcgucgugcucuga

SEQ ID NO: 2473 - RNA, 1710 nt, Artificial Sequence
  derived and/or modified CDS sequence (opt5) from Lassa virus__AIT17173__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugaauaugaucggaaugucuggcuccaaccagggggcccgggcuggacgcgacggcgucgugagaguuugggaugugaagaaugccgagcuucugaacaaucaguucggcacaaugccuagccucacccuggcgugucuuacaaaacaggggcaagucgaccugaacgaugccgugcaggcucucaccgaccugggacugauuuacacggccaaguauccgaauaccucugaccucgaucggcugacacagucccaucccauccuuaacaugaucgacaccaagaaaagcucccugaauauuucuggcuacaacuuuagccucggggcugccgugaaggcgggagccugcaugcuggauggcgggaacaugcuugaaacaaucaaagucuccccucaaaccauggacggcauucucaagagcauccugaaaguuaagaaagcucugggaauguucauuucugaugcccccggcgagcgcaauccuuaugaaaacauccuguacaagauuugucucuccggggacggauggcccuauaucgcuagcagaacgucuaucacaggccgggccugggagaauaccgugguggaucuggagagcgacgggaagccucagaaagccggauccaacggcucuaauaagagccuucaguccgcuggguuuacagcgggacugaccuacagccagcucaugacccugaaagaugccaugcugcaacuugacccgaacgcuaagacauggauggauauugaaggcagacccgaggacccugucgaaaucgcccucuaccagcccucuuccggcugcuauauucacuucuuucgcgagccuacggaccugaaacaguucaagcaggaugccaaguacagccaugggaucgacgugaccgaucuguuugcugcccaacccggacucacaucugcgguuauugacgcucugccgcggaauauggugaucaccugucagggcuccgaugacaucagaaaacuuuucgaaagccaggggcgcaaggauauuaaacugaucgacauugcccucuccaagacagauucucggaaauaugagaacgccgucugggaccaguacaaggaucugugccacaugcauaccggaaucgugguugagaagaaaaagagaggcgggaaagaagagauuacgccucacugugcucugauggacugcaucauguuugaugccgcugugagcggcggacuuaauacauccguccuccgcgccgugcugccccgggacauggucuucagaaccucuaccccucgcgugguucuguga

SEQ ID NO: 2474 - RNA, 1710 nt, Artificial Sequence
  derived and/or modified CDS sequence (opt5) from Lassa virus__AIT17177__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaagcagcggcgcgacgauaacgaccugaaaagacuccgggaucugaaucaagcggugaacaaucuggucgaacucaagucuacacagcaaaagagcgugcugcgcguuggaacgcuuaccuccgacgaucugcucgugcuggcugccgaccuugagaaacuuaagagcaaagucaucagaacagaacggccccucucugccggcauuuauauggggaaccuguccagccagcagcuggaucagcgcagagcucuccugaauaugaucggaaugucuggcgggaaccagggagcccgggcuggccgcgacggcgugguuagagugugggaugucaagaaugccgaccuucugaacaaucaguucgggaccaugccuucccucacacuggcgugucuuaccaaacaaggacagguggaucugaacgacgugguccaggcccucacagaccugggccugauuuacaccgcuaaguauccgaauacgagcgaucucgaccggcugacccaaucucaucccauccuuaagaugaucgaugccaacaaauccagccugaauauuuccggguacaacuuuucucucggagcugccguuaaggcgggcgccugcaugcuggacgggggaaacaugcuugagacaaucaaagugagcccucagaccauggauggcauucugaaguccauccucaaagugaagaaaagccugggcauguucauuucugacacacccggggagcgcaauccuuaugaaaacauccuguacaagauuugucucuccggagauggcuggcccuauaucgcuagcagaaccucuaucauugggcgggccugggagaauacggucguggaccuggaaagcgauggaaagccucagaaaacaggcuccaacaauucuagcaagucccuucagagcgcuggguuugccgccggacugaccuacucucaacucaugacacugaaagacgcuaugcugcagcuugauccgaacgcgaagaccuggauggacaucgagggcagacccgaggacccuguugaaauugcccucuaccagcccuccagcggcugcuauauccacuucuuucgcgagccuaccgaucugaaacaguucaagcaagacgcuaaguacucucaugggauugaugugacagaccuguuugccgcccagcccggacucacguccgcugucaucgaagcccugccgcggaauauggugaucaccugucagggcagcgaugacauuagaaaacuucuggagucccaggggcgcaaggauaucaaacucauugacaucgcgcugucuaagacagauagccggaaauaugaaaacgcuguuugggaccaauacaaggaucugugccacaugcauaccggaauuguggucgagaagaaaaagagaggcgggaaagaggaaaucacaccucacugugcccuuauggacugcaucauguucgaugccgcuguguccggcggacucaauacccugguccugcgcgccgugcucccccgggacaugguuuuuagaacgucuacaccuaaggugguccuguga

SEQ ID NO: 2475 - RNA, 1710 nt, Artificial Sequence
  derived and/or modified CDS sequence (opt5) from Lassa virus__AIT17181__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagcggcgcgacgauaacgaccugaaaagacuccgggaucugaaucaagcggucaacaaucugguggaacucaagucuacacagcaaaagagcguucugcgcgugggaacgcuuaccuccgacgaucugcucguccuggcugccgaccuugagaaacuuaagagcaaagugauuagaacagaacggccccucucugccggcguuuauauggggaaccuguccagccagcagcuggaucagcgcagagcucuccugaauaugaucggaaugucuggcgggauucagggaacccggacaggccgcgacggcguggucagagugugggaugugaagaacgccgaccuucugaauaaccaguucgggaccaugccuucccucacacuggcuugucuuaccaaacaaggacaggucgaucugaaugacguugugcaggcccucacggaccugggccugaucuacaccgcgaaguauccgaacgccagcgaucucgaccggcugacacaaucucaucccauucuuaauaugaucgauaccaagaaauccagccugaacaucuccggguacaauuuuucucucggagcugccgugaaggcuggcgccugcaugcuggacgggggaaacaugcuugagacaauuaaagucagcccucagaccauggauggcauccugaaguccauucucaaagugaagaaaacgcugggcauguucaucagcgacacacccggggagcgcaacccuuaugaaaauauucuguacaagaucugucucucuggagauggcuggcccuauauugcguccagaaccagcaucacagggcgggccugggagaacaccguuguggaccuggaaucugauggaaagccucagaaagcuggcagcaauaacuccaauaagucucuucagagcgccggguuugcugccggacugaccuacucccaacucaugacacugaaagacgccaugcugcagcuugauccgaacgcuaagacguggauggacaucgagggcagacccgaggacccugucgaaauugcgcucuaccagcccagcucuggcugcuauauccacuucuuucgcgagccuaccgaucugaaacaguucaagcaagacgccaaguacucccaugggauugaugugacagaccuguuugcugcccagcccggacucaccagcgccguuaucgaagcucugccgcggaauauggugauuacaugucagggcucugaugacaucaaaaagcugcuggagucccaggggagaaaagauaucaagcucauugacaucgcccugagcaaaaccgauucccgcaaguaugaaaacgcggucugggaccaauacaaggaucugugccacaugcauacgggaguggucguggagaaaaagaaacggggcgggaaggaggaaauuacaccucacugugcucuuauggacugcaucauguucgaugccgccguuucuggcggacucaauacccuggugcugagagcuguccucccccgcgacaugguguuucggaccagcacaccuagaguugugcuguga

SEQ ID NO: 2476 - RNA, 1710 nt, Artificial Sequence
  derived and/or modified CDS sequence (opt5) from Lassa virus__AIT17185__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaagcagcggcgcgacgauggagaccugaaaagacuccgggaucugaaccaagcggugaauaaccuggucgaacucaagucuacacagcaaaagagcgugcugcgcguuggcacgcuuaccuccgacgaucugcucauccuggcugccgaccuugagaaacuuaagagcaaagugacaagaaccgaacggccccucucugccggggucuauaugggaaaucuguccagccagcagcuggaucagcgcagagcucuccugaacaugauuggcaugucugggggaaaucggggcgcccgcacaggcaaggacggggugguuagaaucugggaugugaaaaacgcugaccuucugaauaaccaguucggaaccaugccuucccucacacuggccugucuuaccaagcagggccaagucgaucugaaugacguggugcaggcgcucacggaccuggggcugauuuacaccgccaaguauccgaacacaagcgaucucgaccggcugacccagucucaucccauccuuaauaugaucgauacaaacaaauccagccugaauauuuccggauacaacuuuucucucggcgcugccgucaaggcuggggccugcaugcuggacggaggcaacaugcuugagaccaucaaaguuagcccucaaacgauggauggcauucugaaguccauccucaaagugaagaaaagccuggggauguucauuucugacacacccggagagcgcaauccuuaugaaaacauccuguacaagauuugucucuccggcgauggguggcccuauaucgcgagcagaaccucuaucacaggacgggccugggagaauaccguggucgaccuggaaagcgaugagaagccucagaaagcuggcuccaacaauucuaacaagagccuucaguccaccggguuuacagccggacugacguacagccagcucaugacccugaaagacgcuaugcugcaacuugauccgaaugccaagacauggauggacauugagggcagacccgaagacccuguggagaucgcccucuaccagcccucuuccggcugcuauauucacuucuuucgcgaaccuaccgaucugaaacaguucaagcaggacgcuaaguacagccaugggaucgauguuacagaccuguuugcggcccaacccggacucaccucugcugugauugauacgcugccgcggaacauggucaucacaugucagggcuccgacgauaucagaaaacuucuggagagccaggggcgcaaggacauuaaacucaucgauauugcccuguccaagaccgacucucggaaauaugaaaaugccgugugggaucaguacaaggaccugugccacaugcauaccggaguuguggucgagaagaaaaagagaggcgggaaagaggaaaucacaccucacugugcucuuauggauugcauuauguucgacgccgcggugagcggcggacucaacgcuuccguccugcgcgccgugcugccccgggacaugguuuuuagaaccucuacaccucgcgugguccucuga

SEQ ID NO: 2477 - RNA, 1710 nt, Artificial Sequence
  derived and/or modified CDS sequence (opt5) from Lassa virus__AIT17189__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcgugcugcgcguuggaacgcuuaccuccgacgaucugcucauccuggcugccgaccuugaaaaacuuaagagcaaagugacaagaaccgagcggccccucucugccggcgucuauauggggaaccuguccagccagcagcuggaucagcgcagagcucuccugucuaugauuggaauguccggcgggaaucagggagcccggacaggccgcgacggcgugguuagagugugggaugucaagaacgcugagcuucugaauaaccaguucgggaccaugccuagccucacacuggccugucuuaccaaacagggacaaguggaccugaaugaugugguccaggcgcucacggaccugggccugaucuacaccgccaaguauccgaacacaucugaccucgaucggcugacccagucccaucccauucuuaauaugaucgacacaaagaaaagcucccugaacaucucuggguacaauuuuagccucggagcugccguuaaggcuggcgccugcaugcuggaugggggaaacaugcuugaaaccauuaaaguguccccucaaacgaucgacggcauucucaagagcauccugaaagugaagaaagcgcugggcauguucauuucugauacacccggggagcgcaacccuuaugaaaauauccuguacaagauuugucucuccggagacggcuggcccuauaucgccagcagaaccucuaucacagggcgggcuugggagaacaccgucguggaucuggagagcgacggaaagccucagaaagccggcuccaauaacucuaauaagagccuucaguccgcuggguuuaccgccggacugacauacagccagcucaugacgcugaaagaugccaugcugcaacuugacccgaacgcuaagaccuggauggauauugaaggcagacccgaggacccuguugaaaucgcgcucuaccagcccucuuccggcugcuauauucacuucuuucgcgagccuacagaccugaaacaguucaagcaggaugccaaguacagccaugggaucgacgugaccgaucuguuugcugcccaacccggacucacaucugccgucauugacgcucugccgcggaauauggugaucaccugucagggcuccgaugacaucagaaaacuucuggaaagccaggggcgcaaggauauuaaacucaucgacauugcccuguccaagacggauucucggaaauaugagaacgcgguuugggaccaguacaaggaucugugccacaugcauacaggaguggucguggagaagaaaaagagaggcgggaaagaagagaucaccccucacugugcucuuauggacugcauuauguucgaugccgccgucagcggcggacucaauucccuggugcugcgcgcuguucucccccgggacaugguguuuagaaccucuacaccucgcgucgugcuguga

SEQ ID NO: 2478 - RNA, 1710 nt, Artificial Sequence
  derived and/or modified CDS sequence (opt5) from Lassa virus__AIT17193__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcgugcugcgcguuggaacgcuuaccuccgacgaucugcucauccuggcugccgaccuugaaaaacuuaagagcaaagugacaagaaccgagcggccccucucugccggcgucuauauggggaaccuguccagccagcagcuggaucagcgcagagcucuccugucuaugauuggaauguccggcgggaaucagggagcccggacaggccgcgacggcgugguuagagugugggaugucaagaacgcugagcuucugaauaaccaguucgggaccaugccuagccucacacuggccugucuuaccaaacagggacaaguggaccugaaugaugcggugcaggcccucacggaccugggccugaucuacaccgcuaaguauccgaacacaucugaccucgaucggcugacccagucccaucccauucuuaauaugaucgacacaaagaaaagcucccugaacaucucuggguacaauuuuagccucggagccgcugucaaggccggcgcgugcaugcuggaugggggaaacaugcuugaaaccauuaaaguuuccccucaaacgauggacggcauccucaagagcauucugaaagugaagaaagcccugggcauguucaucucugauacacccggggagcgcaacccuuaugaaaauauucuguacaagaucugucucuccggagacggcuggcccuauauugcuagcagaaccucuaucacagggcgggccugggagaacaccguggucgaucuggagagcgacggaaagccucagaaagcuggcaauaacaauuccaacaagucucuucagagcgccggguuuaccgccggacugacauacucccagcucaugacgcugaaagaugcuaugcugcaacuugacccgaaugcgaagaccuggauggauaucgaaggcagacccgaggacccuguggaaauugcccucuaccagcccagcucuggcugcuauauccacuucuuucgcgagccuacagaccugaaacaguucaagcaggaugcuaaguacucccaugggauugacguuaccgaucuguuugccgcccaacccggacucacaagcgcugugaucgacgcccugccgcggaacauggucauuaccugucagggcucugaugacaucagaaaacuucuggaaucccaggggcgcaaggauaucaaacucauugacaucgcgcugagcaagacggauucccggaaauaugagaaugcugugugggaccaguacaaggaucugugccacaugcauacaggaguuguggucgagaagaaaaagagaggcgggaaagaagagauuaccccucacugugcccuuauggacugcaucauguucgaugccgcugugucuggcggacucaacagccugguccugcgcgccgugcucccccgggacaugguuuuuagaaccuccacaccucgcgugguccuguga

SEQ ID NO: 2479 - RNA, 1710 nt, Artificial Sequence
  derived and/or modified CDS sequence (opt5) from Lassa virus__AIT17197__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuaucagaacagagcggccccucucugccggcguguauauggggaaccugucccugcagcagcucgaucagcgcagagcucugcuuaauaugauuggaaugagcggcucuaaccaggggguccgggccggacgcgacggcgugguuagagugugggaugucaagaaugcugagcugcucaacaaucaguucggcaccaugccuucccugacacuugccugucugaccaaacaggggcaaguggaccucaacgaugcggugcaggcccugacagaccugggacucaucuacaccgcuaaguauccgaauacgagcgaccuggaucggcuuacccagucucaucccauccugaacaugauugacacaaagaaauccagccucaauaucuccggcuacaacuuuucucugggggccgcugucaaggccggagcgugcaugcuugauggcgggaacaugcuggaaaccauuaaaguuagcccucaaacaauggacggaauccucaaguccauucugaaagugaagaaagcccugggcauguucaucagcgauacccccggcgagcgcaauccuuaugaaaacauucucuacaagaucugucugucuggggacggauggcccuauaucgcuuccagaacgagcauuacaggccgggccugggagaauaccguggucgaucuugagucugacgggaagccucagaaagcuggaagcaacggcuccaauaagucucugcagagcgccggguuuacagccggacucaccuacucccagcugaugacccugaaagaugcuaugcuucaacucgacccgaacgcgaagacauggauggauaucgaaggcagacccgaggacccuguggaaauugcccuguaccagcccagcucuggcugcuauauccacuucuuucgcgagccuacggaccugaaacaguucaagcaggaugcuaaguacucccaugggauugacguuaccgaucucuuugccgcccaacccggacugacaagcgcugugaucgacgcccuuccgcggaauauggucaucaccugucagggcucugaugacauuagaaaacugcucgaaucccaggggcgcaaggauaucaaacugauugacaucgcgcugagcaagacagauucccggaaauaugagaacgcugugugggaccaguacaaggaucuuugccacaugcauaccggaauuguuguggagaagaaaaagagaggcgggaaagaagagaucacgccucacugugcccucauggacugcaucauguucgaugccgcugucucuggcggacugaauacaagcgugcugcgcgccguccucccccgggacaugguguuuagaaccuccaccccucgcguugugcuguga

SEQ ID NO: 2480 - RNA, 1710 nt, Artificial Sequence
  derived and/or modified CDS sequence (opt5) from Lassa virus__AIT17201__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugaauaugaucggaaugucuggcuccaaccagggggcccgggcuggacgcgacggcgucgugagaguuugggaugugaagaaugccgagcuucugaacaaucaguucggcacaaugccuagccucacccuggcgugucuuacaaaacaggggcaagucgaccugaacgaugccgugcaggcucucaccgaccugggacugauuuacacggccaaguauccgaauaccucugaccucgaucggcugacacagucccaucccauccuuaacaugaucgacaccaagaaaagcucccugaauauuucuggcuacaacuuuagccucggggcugccgugaaggcgggagccugcaugcuggauggcgggaacaugcuugaaacaaucaaagucuccccucaaaccauggacggcauucuuaagagcauccucaaaguuaagaaagcucugggaauguucauuucugaugcccccggcgagcgcaauccuuaugaaaacauccuguacaagauuugucucuccggggacggauggcccuauaucgcuagcagaacgucuaucacaggccgggccugggagaauaccgugguggaucuggagagcgacgggaagccucagaaagccggauccaacggcucuaauaagagccuucaguccgcuggguuuacagcgggacugaccuacagccagcucaugacccugaaagaugccaugcugcaacuugacccgaacgcuaagacauggauggauauugaaggcagacccgaggacccugucgaaaucgcccucuaccagcccucuuccggcugcuauauucacuucuuucgcgagccuacggaccugaaacaguucaagcaggaugccaaguacagccaugggaucgacgugaccgaucuguuugcugcccaacccggacucacaucugcgguuauugacgcucugccgcggaauauggugaucaccugucagggcuccgaugacaucaaaaagcuguucgaaagccaggggagaaaagauauuaagcugaucgacauugcccucuccaaaacagauucucgcaaguaugagaacgccgucugggaccaguacaaggaucugugccacaugcauaccggaaucgugguugagaaaaagaaacggggcgggaaggaagagauuacgccucacugugcucugauggacugcaucauguuugaugccgcugugagcggcggacuuaauacauccguccucagagccgugcugccccgcgacauggucuuccggaccucuaccccuagagugguucuguga

SEQ ID NO: 2481 - RNA, 1710 nt, Artificial Sequence
  derived and/or modified CDS sequence (opt5) from Lassa virus__AIT17205__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcaaggcucuccugaauaugaucggaaugucuggcuccaaccagggggccagaauuggacgggacggcgucgugcgcguuugggaugugaaaaaugcugagcuucugaacaaucaguucggcacaaugccuagccucacccuggccugucuuacaaagcaggggcaagucgaccugaacgaugcggugcaggcccucaccgaccugggacugaucuacacggcuaaguauccgaauaccucugaccucgauagacugacacagucccaucccauccuuaacaugauugacaccaaaaagagcucccugaauaucucuggcuacaacuuuagccucggggccgcugugaaagccggagcgugcaugcuggauggcgggaacaugcuugaaacaauuaaggucuccccucaaaccauggacggaauccugaaaagcauucucaagguuaaaaaggcccugggcauguucaucucugauacgcccggcgagcggaauccuuaugaaaacauucuguacaagaucugucucuccggggacggauggcccuauaucgcuagccgcacaucuauuaccggcagagccugggagaauacagugguggaucuggagagcgacgggaaaccucagaaggcuggauccaacucuagcaauaaaucccuucagagcgccggccugaccgccgggcucaccuacucucagcugaugacacugaaggaugcuaugcuucaacucgacccgaacgcgaaaacguggauggauaucgaaggacggcccgaggacccugucgaaauugcccuguaccagcccuccagcggcugcuauauccacuuuuucagagagccuaccgaccugaagcaguuuaagcaggaugcuaaauacucucauggcauugacgugacagaucucuucgccgcccaacccgggcugaccuccgcuguuaucgacgcccuuccgcgcaaucuggugaucacaugucagggaagcgaugacauucggaagcuccuggaaucccagggcagaaaagauaucaagcugauugacaucgcgcuuucuaaaaccgauagccgcaaguaugagaacgcugucugggaccaguacaaggaucucugccacaugcauacggggauugugguugagaaaaagaaacggggaggcaaggaagagaucacaccucacugugcccugauggacugcaucauguuugaugccgcuguguccgggggccugaaugccucuguccucagagcugugcugccccgcgacauggucuuccggaccagcaccccuagagugguucuuuga

SEQ ID NO: 2482 - RNA, 1710 nt, Artificial Sequence
  derived and/or modified CDS sequence (opt5) from Lassa virus__AIT17209__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugucuaugaucggaauguccggcgggaaucagggagcccgggcuggccgcgacggcgucgugagaguuugggaugugaagaacgccgagcuucugaauaaccaguucgggacaaugccuagccucacccuggcgugucuuacaaaacagggacaagucgaccugaaugauguggugcaggcccucaccgaccugggccugauuuacacggcuaaguauccgaacaccucugaccucgaucggcugacacagucccaucccauccuuaauaugaucgacaccaagaaaagcucccugaacauuucuggguacaauuuuagccucggagccgcugucaaggccggcgcgugcaugcuggaugggggaaacaugcuugaaacaaucaaaguuuccccucaaaccauggacggcauucuuaagagcauccucaaagugaagaaagcccugggcauguucauuucugauacgcccggggagcgcaacccuuaugaaaauauccuguacaagauuugucucuccggagacggcuggcccuauaucgcuagcagaacaucuaucaccgggcgggccugggagaacacaguggucgaucuggagagcgacggaaagcugcagaaaaccggcuccaauaacucuaauaagagccugcaguccgcuggguuuaccgccggacucacauacagccagcugaugacgcugaaagaugccaugcuucaacucgacccuaacgcuaagauuuggauggauaucgaaggcagaccggaggaccccguggaaauugcgcuguaccagccuucuuccggcugcuauauccacuucuuucgcgagcccaccgaccugaaacaguucaagcaggaugccaaguacagccaugggauugacguuacagaucucuuugcugcccaaccuggacugaccucugccgugaucgacgcccuuccccggaauauggucaucacaugucagggcuccgaugacauuagaaaacugcucgaaagccaggggcgcaaggauaucaaacugauugacaucgcucugaacaagaccgauucccggaaauaugagaaugcggugugggaccaguacaaggaucuuugccacaugcauacgggaguuguggucgagaagaaaaagaaaggcgggaaggaagagauuacaccgcacugugcucucauggacugcaucauguucgaugccgccgugucuggcggacugaacaccagcguccugagagcugugcucccucgcgacaugguuuuucggaccuccacacccagagugguccuguga

SEQ ID NO: 2483 - RNA, 1710 nt, Artificial Sequence
  derived and/or modified CDS sequence (opt5) from Lassa virus__AIT17211__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugaauaugaucggaaugucuggcgggaaccagggagcccaggcuggccgggacggcgucgugcgcguuugggaugugaagaaugccgagcuucugaacaaucaguucgggacaaugccuucccucacccuggcgugucuuacaaaacaaggacaggucgaccugaacgaugccgugcaggcucucaccgaccugggccugauuuacacggccaaguauccgaauaccagcgaccucgauagacugacacaaucucaucccauccuuaacaugaucgacaccaagaaauccagccugaauauuuccggguacaacuuuucucucggagcugccgugaaggcgggcgccugcaugcuggaugggggaaacaugcuugaaacaaucaaagucagcccucagaccauggacggcauucugaaguccauccucaaaguuaagaaagcucugggcauguucauuagcgauacgcccggggagcggaauccuuaugaaaacauccuguacaagauuugucucucuggagacggcuggcccuauaucgccucccgcacaagcaucaccgggagagcuugggagaauacagugguggaucuggagucugacggaaagccucagaaagccaacagcaauuccucuaacaagagccuucaguccgccggcuuuaccgcugggcugaccuacagccaacucaugacacugaaagaugcgaugcugcagcuugacccgaaugccaagacguggauggauauugaaggacggcccgaggacccugucgaaaucgcucucuaccagcccucuuccggcugcuauauucacuucuuuagagagccuaccgaccugaaacaguucaagcaagaugccaaguacagccauggcaucgacgugacagaucuguuugccgcucagcccgggcucaccucugccguuauugacgcgcugccgcgcaacauggugaucacaugucagggauccgaugacauccggaaacuucuggaaagccagggcagaaaggauauuaaacucaucgacauugcucuguccaagaccgauucucgcaaauaugagaaugccgucugggaccaauacaaggaucugugccacaugcauacggggaucgugguugagaagaaaaagcggggaggcaaagaagagauuacaccucacugugcccuuauggacugcaucauguucgaugcugccgugagcgggggccucaacaccuccguccugagagcugugcugccccgcgacauggucuuucggaccucuacaccuagagugguucucuga

SEQ ID NO: 2484 - RNA, 1710 nt, Artificial Sequence
  derived and/or modified CDS sequence (opt5) from Lassa virus__AIT17213__NP
augagcgccuccaaggagaucaaaucuuuccuguggacccagagccucagacgggaacuggcuggcuacugcuccaacauuaaacuucaaguggucaaggacgcccaggcgcugcuccacgggcuggauuuuucugagguuagcaaugugcagcgccuuaugagaaaggaacggcgcgacgauaacgaccugaaaagacuccgggaucugaaucaggcugugaacaaucuggucgagcucaaguccacacaacagaagucugugcugcgcguuggaacgcuuaccagcgacgaucugcucauccuggccgccgaccuugaaaaacugaaguccaaagugauuagaacagagcggccccucagcgcuggcgucuauauggggaaccugucuucccagcagcuggaucaacgcagagcccuccugaauaugaucggaaugagcggcucuaaccagggggugcgggcuggacgcgacggcguugugagagucugggaugugaagaaugccgagcuucugaacaaucaguucggcaccaugccuucccucacacuggcgugucuuaccaaacaggggcaaguggaccugaacgaugccguccaggcucucacagaccugggacugauuuacaccgccaaguauccgaauacgagcgaccucgaucggcugacccagucucaucccauccuuaacaugaucgacacaaagaaauccagccugaauauuuccggcuacaacuuuucucucggggcugccguuaaggcgggagccugcaugcuggauggcgggaacaugcuugaaaccaucaaagugagcccucaaacaauggacggcauucugaaguccauccucaaagugaagaaagcucugggaauguucauuagcgauacccccggcgagcgcaauccuuaugaaaacauccuguacaagauuugucucucuggggacggauggcccuauaucgccuccagaacgagcaucacaggccgggcuugggagaauaccgucguggaucuggagucugacgggaagccucagaaagccggaagcaacggcuccaauaagucucuucagagcgccggguuuacagcuggacugaccuacucccagcucaugacccugaaagaugcgaugcugcaacuugacccgaacgccaagacauggauggauauugaaggcagacccgaggacccuguugaaaucgcucucuaccagcccagcucuggcugcuauauucacuucuuucgcgagccuacggaccugaaacaguucaagcaggaugccaaguacucccaugggaucgacgugaccgaucuguuugccgcucaacccggacucacaagcgccgucauugacgcgcugccgcggaauauggugaucaccugucagggcucugaugacaucagaaaacuucuggaaucccaggggcgcaaggauauuaaacucaucgacauugcucugagcaagacagauucccggaaauaugagaacgccguuugggaccaguacaaggaucugugccacaugcauaccggaaucguggucgagaagaaaaagagaggcgggaaagaagagauuacgccucacugugcccuuauggacugcaucauguucgaugcugccgugucuggcggacucaauacaagcguccugcgcgcugugcugccccgggacaugguuuuuagaaccuccaccccucgcgugguccucuga

SEQ ID NO: 2485 - RNA, 1710 nt, Artificial Sequence
  derived and/or modified CDS sequence (opt5) from Lassa virus__AIT17217__NP
augagcgccuccaaggagaucaaaucuuuccuguggacccagagccucagacgggaacuguccggcuacugcucuaacauuaaacuucaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugucuaugaucggaauguccagcggcguccagggggcccgggcuggacgcgacggcgugguuagagugugggaugucaagaaugccgagcuucugaacaaucaguucggcacaaugccuucucucacccuggcgugucuuacaaaacaggggcaaguggaccugaacgaugugguccaggcccucaccgaccugggacugauuuacacggcuaaguauccgaauaccuccgaccucgaucggcugacacagagccaucccauccuuaacaugaucgacaccaagaaauccucucugaauauuagcggcuacaacuuuucccucggggccgcuguuaaggccggagcgugcaugcuggauggcgggaauaugcuugaaacaaucaaagugagcccucaaaccauggacggcauucugaagucuauccucaaagugaagaaagcccugggaauguucauuuccgagacgcccggcgaacgcaacccuuaugagaacauccuguacaagauuugucucagcggggauggauggcccuauaucgcuucuagaacaagcaucaccggccgggccugggagaauacagucguggaccuggaauccgaugggaagccucagaaagcuggaucuaacaauagcaacaagucccuucagagcaccggcuuugccgccgggcugaccuacucucagcucaugacacugaaagacgcuaugcugcaacuugauccgaaugcgaagacguggauggacauugagggaagacccgaagauccuguugagguggcccucuaccagcccuccagcggcugcuauauccacuucuuucgcgaaccuaccgaccugaaacaguucaagcaggacgcuaaguacucucauggcauugaugucacagaccuguuugccgcccaacccgggcucaccuccgcugugaucgaugcccugccgcggaacaugguuauuacaugucagggaagcgacgauaucaaaaagcugcuggagucccagggcagaaaagacaucaagcucauugauaucgcgcugucuaaaaccgacagccgcaaguaugagaaugcugugugggaucaguacaaggaccugugccacaugcauacgggggucguggucgaaaagaagaaacggggaggcaaggaggaaauuacaccucacugugcccuuauggauugcaucauguucgacgccgcuguguccgggggccucaacaccucuguucugagagccgugcugccccgcgauauggucuuucggaccagcacaccuagagugguucucuga

SEQ ID NO: 2486 - RNA, 1710 nt, Artificial Sequence
  derived and/or modified CDS sequence (opt5) from Lassa virus__AIT17225__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaagcagcggcgcgacgauaacgaccugaaaagacuccgggaucugaaucaagcggugaacaaucuggucgaacucaagucuacacagcaaaagagcgugcugcgcguuggaacgcuuaccuccgacgaucugcucgugcuggcugccgaccuugagaaacuuaagagcaaagucacaagaaccgaacggccccucucugccggcguguauauggggaaccuguccagccagcagcuggaucagcgcagagcucuccugaauaugaucggaaugucuggcgggaaccagggagcccgggcuggcaaugacggcguugugcgcgucugggaugugaagaacgccgaccuucugaauaaccaguucgggacaaugccuucccucacccuggcgugucuuacaaaacaaggacagguggaucugaaugacgucguucaggcccucaccgaccugggccugauuuacacggcuaaguauccgaacaccagcgaucucgacagacugacacaaucucaucccauccuuaauaugauugauaccaagaaauccagccugaacaucuccggguacaacuuuucucucggagccgcugugaaggccggcgcgugcaugcuggacgggggaaauaugcuugagacaaucaaagugagcccucagaccauggauggcauucugaaguccauccucaaagucaagaaagcccugggcauguucauuagcgacacgcccggggagcggaacccuuaugaaaauauccuguacaagauuugucucucuggagauggcuggcccuauaucgcuucccgcacaagcauuaccgggagagccugggagaacacagugguugaccuggaaucugauggaaagccucagaaaaccggcaauaacagcuccaauaagucucuucagagcgcuggguuuaccgccggacugacauacucccaacucaugacgcugaaagacgccaugcugcagcuugauccgaacgcuaagaccuggauggacaucgagggccggcccgaggacccuguggaagucgcgcucuaccagcccagcucuggcugcuauauccacuucuuuagagagccuacagaucugaaacaguucaagcaagacgccaaguacucccaugggauugaugugaccgaccuguuugcugcccagcccggacucacaagcgccguuaucgaagcucugccgcgcaauauggugauuaccugucagggcucugaugacauccggaaacuucuggagucccaggggagaaaggauauuaaacucaucgacaucgcccugagcaagauugauucccgcaaauaugaaaacgcggucugggaccaauacaaggaucugugccacaugcauacgggaguggucguggagaagaaaaagcggggcgggaaagaggaaaucacaccucacugugcucuuauggacugcauuauguucgaugccgccguuucuggcggacucaauacccuggugcugagagcuguccucccccgcgacaugguguuucggaccagcacaccuaagguugugcuguga

SEQ ID NO: 2487 - RNA, 1710 nt, Artificial Sequence
  derived and/or modified CDS sequence (opt5) from Lassa virus__AIT17229__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcgugcugcgcguuggaacgcuuaccuccgacgaucugcucauccuggcugccgaccuugaaaaacuuaagagcaaagugauuagaacagagcggccccucucugccggcgucuauauggggaaccuguccagccagcagcuggaucagcgcagagcucuccugucuaugaucggaauguccggcgggaaucagggaacccgggccggccgcgacggcgugguuagagugugggaugucaagaacgcugagcuucugaauaaccaguucgggacaaugccuagccucacccuggccugucuuacaaaacagggacaaguggaccugaaugaugcggugcaggcccucaccgaccugggccugauuuacacggcuaaguauccgaacaccucugaccucgaucggcugacacagucccaucccauccuuaauaugaucgacaccaagaaaagcucccugaacauuucuggguacaauuuuagccucggagccgcugucaaggccggcgcgugcaugcuggaugggggaaacaugcuugaaacaaucaaaguuuccccucaaaccauggacggcauucucaagagcauccugaaagugaagaaagcccugggcauguucauuucugauacgcccggggagcgcaacccuuaugaaaauauccuguacaagauuugucucuccggagacggcuggcccuauaucgcuagcagaacaucuaucaccgggcgggccugggagaacacaguggucgaucuggagagcgacggaaagccucagaaagcuggcuccaauaacucuaauaagagccuucaguccgccggguuuaccgccggacugaccuacagccagcucaugacacugaaagaugcuaugcugcaacuugacccgaacgcgaagacguggauggauauugaaggcagacccgaggacccuguggaaaucgcccucuaccagcccucuuccggcugcuauauucacuucuuucgcgagccuaccgaccugaaacaguucaagcaggaugcuaaguacagccaugggaucgacguuacagaucuguuugccgcccaacccggacucaccucugcugugauugacgcccugccgcggaauauggucaucacaugucagggcuccgaugacaucagaaaacuucuggaaagccaggggcgcaaggauauuaaacucaucgacauugcgcuguccaaggcugauucucggaaauaugagaacgccgugugggaccaguacaaggaucugugccacaugcauaccggaguuguggucgagaagaaaaagagaggcgggaaagaagagaucacgccucacugugcccuuauggacugcauuauguucgaugcugccgugagcggcggacucaauacauccguccugcgcgcugugcugccccgggacaugguuuuuagaaccucuaccccucgcgugguccucuga

SEQ ID NO: 2488 - RNA, 1710 nt, Artificial Sequence
  derived and/or modified CDS sequence (opt5) from Lassa virus__AIT17233__NP
augagcgccuccaaggaggugaaaucuuuccuguggacccagagccucagacgggaacuguccggcuacugcucuaacaucaagcugcaagucguuaaagacgcucaggcccugcuccacgggcuggauuuuagcgagguguccaaugugcagcgccuuaugagaaaggaacggcgcgacgauaacgaccugaaaagacuccgggaucugaaucaggcggucaacaaucugguggagcucaagucuacacaacaaaagagcauucugcgcguuggaacgcuuaccuccgacgaucugcucgugcuggcugccgaccuugaaaaacuuaagagcaaagucacaagaaccgagcggccccucucugccggcguguauauggggaaccuguccagccagcagcuggaucagcgcagagcucuccugucuaugaucggaauguccggcgggaaucagggagcccaggcuggccgggacggcguugugcgcgucugggaugugaagaacgccgagcuucugaauaaccaguucgggacaaugccuagccucacccuggcgugucuuacaaaacaaggacagguggaccugaaugaugccguccaggcucucaccgaccugggccugauuuacacggccaaguauccgaacaccucugaccucgauagacugacacaaucccaucccauccuuaauaugauugacaccaagaaaagcucccugaacaucucuggguacaauuuuagccucggagcugccguuaaggcgggcgccugcaugcuggaugggggaaacaugcuugaaacaaucaaaguguccccucagaccauggacggcauucucaagagcauccugaaagugaagaaagcucugggcauguucauuucugauacgcccggggagcggaacccuuaugaaaauauccuguacaagauuugucucuccggagacggcuggcccuauaucgccagccgcacaucuauuaccgggagagcuugggagaacacagucguggaucuggagagcgacggaaagccucagaaagccggcuccaauaacucuaauaagagccuucaguccgccggguuuaccgcuggacugaccuacagccaacucaugacacugaaagaugcgaugcugcagcuugacccgaacgccaagacguggauggauaucgaaggccggcccgaggacccuguugaaguggcucucuaccagcccucuuccggcugcuauauccacuucuuuagagagccuaccgaccugaaacaguucaagcaagaugccaaguacagccaugggauugacgucacagaucuguuugccgcucagcccggacucaccucugccgugaucgacgcgcugccgcgcaauaugguuauuacaugucagggcuccgaugacauccggaaacuucuggaaagccaggggagaaaggauauuaaacucaucgacaucgcucuguccaagaccgauucucgcaaauaugagaacgccgugugggaccaauacaaggaucugugccacaugcauacgggagucguggucgagaagaaaaagcggggcgggaaagaagagauuacaccucacugugcccuuauggacugcaucauguucgaugcugccgugagcggcggacucaauaccuccguucugagagcugugcugccccgcgacauggucuuucggaccucuacaccuagagugguucucuga

SEQ ID NO: 2489 - RNA, 1710 nt, Artificial Sequence
  derived and/or modified CDS sequence (opt5) from Lassa virus__AIT17237__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugucuaugaucggaauguccggcgggaaucagggagcccgggcuggccgcgacggcgucgugagaguuugggaugugaagaacgccgagcuucugaauaaccaguucgggacaaugccuagccucacccuggcgugucuuacaaaacagggacaagucgaccugaaugaugccgugcaggcucucaccgaccugggccugauuuacacggccaaguauccgaacaccucugaccucgaucggcugacacagucccaucccauccuuaauaugaucgacaccaagaaaagcucccugaacauuucuggguacaauuuuagccucggagcugccgugaaggcgggcgccugcaugcuggaugggggaaacaugcuugaaacaaucaaagucuccccucaaaccauggacggcauucucaagagcauccugaaaguuaagaaagcucugggcauguucauuucugauacgcccggggagcgcaacccuuaugaaaauauccuguacaagauuugucucuccggagacggcuggcccuauaucgccagcagaacaucuaucaccgggcgggcuugggagaacacagugguggaucuggagagcgacggaaagccucagaaagccggcuccaauaacucuaauaagagccuucaguccgccggguuuaccgcuggacugaccuacagccagcucaugacacugaaagaugcgaugcugcaacuugacccgaacgccaagacguggauggauauugaaggcagacccgaggacccugucgaaguggcucucuaccagcccucuuccggcugcuauauccacuucuuucgcgagccuaccgaccugaaacaguucaagcaggaugccaaguacagccaugggauugacguuacagaucuguuugccgcucaacccggacucaccucugccgugaucgacgcgcugccgcggaauauggucauuacaugucagggcuccgaugacaucagaaaacuucuggaaagccaggggcgcaaggauaucaaacucauugacaucgcucuguccaagaccgauucucggaaauaugagaacgccgugugggaccaguacaaggaucugugccacaugcauacgggaguuguggucgagaagaaaaagagaggcgggaaagaagagauuacaccucacugugcccuuauggacugcaucauguucgaugcugccgugagcggcggacucaauaccuccguccugcgcgcugugcugccccgggacaugguuuuuagaaccucuacaccucgcgugguccucuga

SEQ ID NO: 2490 - RNA, 1710 nt, Artificial Sequence
  derived and/or modified CDS sequence (opt5) from Lassa virus__AIT17241__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugucuaugaucggaauguccggcgggaaucagggagcccgggcuggccgcgacggcgucgugagaguuugggaugugaagaacgccgagcuucugaauaaccaguucgggacaaugccuagccucacccuggcgugucuuacaaaacagggacaagucgaccugaaugaugccgugcaggcucucaccgaccugggccugauuuacacggccaaguauccgaacaccucugaccucgaucggcugacacagucccaucccauccuuaauaugaucgacaccaagaaaagcucccugaacauuucuggguacaauuuuagccucggagcugccgugaaggcgggcgccugcaugcuggaugggggaaacaugcuugaaacaaucaaagucuccccucaaaccauggacggcauucucaagagcauccugaaaguuaagaaagcucugggcauguucauuucugauacgcccggggagcgcaacccuuaugaaaauauccuguacaagauuugucucuccggagacggcuggcccuauaucgccagcagaacaucuaucaccgggcgggcuugggagaacacagugguggaucuggagagcgacggaaagccucagaaagccggcuccaauaacucuaauaagagccuucaguccgccggguuuaccgcuggacugaccuacagccagcucaugacacugaaagaugcgaugcugcaacuugacccgaacgccaagacguggauggauauugaaggcagacccgaggacccugucgaaaucgcucucuaccagcccucuuccggcugcuauauucacuucuuucgcgagccuaccgaccugaaacaguucaagcaggaugccaaguacagccaugggaucgacgugacagaucuguuugccgcucaacccggacucaccucugccguuauugacgcgcugccgcggaauauggugaucacaugucagggcuccgaugacaucagaaaacuuuucgaaagccaggggcgcaaggauauuaaacugaucgacauugcucucuccaagaccgauucucggaaauaugagaacgccgucugggaccaguacaaggaucugugccacaugcauacgggagugguuguggagaagaaaaagagaggcgggaaagaagagaucacaccucacugugcccugauggacugcauuauguuugaugcugccgucagcggcggacuuaauaccuccgugcuccgcgcuguccugccccgggacaugguguucagaaccucuacaccucgcguugugcuguga

SEQ ID NO: 2491 - RNA, 1710 nt, Artificial Sequence
  derived and/or modified CDS sequence (opt5) from Lassa virus__AIT17245__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugaauaugaucggaaugucuggcuccaaccagggggcccggacaggacgcgacggcgucgugagaguuugggaugugaagaaugcugagcuucugaacaaucaguucggcaccaugccuagccucacacuggccugucuuaccaaacaggggcaagucgaccugaacgaugcggugcaggcccucacggaccugggacugauuuacaccgcuaaguauccgaauacaucugaccucgaucggcugacccagucccaucccauccuuaacaugaucgacacaaagaaaagcucccugaauauuucuggcuacaacuuuagccucggggccgcugugaaggccggagcgugcaugcuggauggcgggaacaugcuugaaaccaucaaagucuccccucaaacgauggacggcauucucaagagcauccugaaaguuaagaaagcccugggaauguucauuucugauacacccggcgagcgcaauccuuaugaaaacauccuguacaagauuugucucuccggggacggauggcccuauaucgcuagcagaaccucuaucacaggccgggccugggagaauaccgugguggaucuggagagcgacgggaagccucagaaagcuggauccaacaauucuaacaagagccuucaguccgccggccugaccgccgggcucacauacagccagcugaugacgcugaaagaugcuaugcuucaacucgacccgaaugcgaagaccuggauggauauugaaggaagacccgaggacccugucgaaaucgcccuguaccagcccucuuccggcugcuauauucacuuuuuccgcgagccuacagaccugaaacaguuuaagcaggaugcuaaguacagccauggcaucgacguggccgaucucuucgccgcucaacccgggcugaccucugccguuauugacgcgcuuccgcggaaccuggugaucacaugucagggauccgaugacaucagaaaacuccuggaaagccagggccgcaaggauauuaaacugaucgacauugcucuuuccaagaccgauucucggaaauaugagaaugccgucugggaccaguacaaggaucucugccacaugcauacggggaucgugguugagaagaaaaagagaggaggcaaagaagagauuacaccucacugugcccugauggacugcaucauguuugaugcugccgugagcgggggccugaacgcuuccguccuccgcgccgugcugccccgggacauggucuucagaaccucuaccccucgcgugguucuuuga

SEQ ID NO: 2492 - RNA, 1710 nt, Artificial Sequence
  derived and/or modified CDS sequence (opt5) from Lassa virus__AIT17247__NP
augagcgccuccaaggagaucaaaucuuuccuguggacccagagccucagacgggaacuguccggcuacugcucuaacauuaaacuucaaguggucaaggacgcucaggcccugcuccacgggcuggauuuuagcgagguuuccaaugugcagcgccuuaugagaaagcagcggcgcgacgauucugaccugaaaagacuccgggaucugaaccaagcggugaauaaccuggucgaacucaagagcacacagcagaaguccgugcugcgcguuggaacgcuuaccagcgacgaucugcucauccuggcugccgaccuugagaaacugaagucuaaagugauuagaacagaacggccccucuccagcggcgucuauauggggaaucugucuucccagcaacuggaucagcgcagagcccuccugaacaugaucggaaugagcggcgggaaucagggagcucaggugggccgggacggcguugugcgcgucugggaugugaagaacgccgaccuucugaauaaccaauucgggaccaugccuucucucacacuggcuugucuuaccaaacagggacagguggaucugaaugacgucguucaagcccucacagaccugggccugauuuacaccgcgaaguauccgaacacguccgaucucgacagacuggcccagagccaucccauccuuaauaugaucgauaccaagaaauccucucugaacauuagcggguacaauuuuucccucggagcugccgugaaggcuggcgccugcaugcuggacgggggaaacaugcuugagacaaucaaagugagcccucagaccauggauggcauucugaagucuauccucaaagucaagaaagcgcugggcauguucauuuccgagacacccggggaacggaacccuuaugagaauauccuguacaagauuugucucagcggagacggcuggcccuauaucgccucucgcaccagcaucacggggagagcuugggaaaacacaauuguggaucuggaguccgacggaaagccucagaaagccggcucuaauaacagcaauaagucccuucaaagcgcuggguuuaccgccggacugacauacucucagcucaugacccugaaagauuccaugcugcagcuugacccgaacgccaagaccuggauggauaucgagggccggcccgaagacccuguugagguggcucucuaccagcccagcucuggcugcuauauucacuucuuuagagaaccuacagaccugaaacaauucaagcaggaugcgaaguacucccaugggaucgacgucacggaucuguuugccgcucagcccggacucaccagcgccgugauugaggcccugccgcgcaauaugguuaucacaugucagggcuccgacgauauccggaaacuucuggaaucucaagggagaaaggacauuaaacucaucgauauugcucugaacaagaccgacagccgcaaauaugagaaugccgugugggaucaguacaaggaccugugccacaugcauacaggagucguggucgagaagaaaaagcggggcgggaaagaagagaucaccccucacugugcgcuuauggauugcauuauguucgacgcugccguguccggcggacucaagacgcugguucugagagccgugcucccccgcgauauggucuuucggacaucuaccccuaaagugguucuguga

SEQ ID NO: 2493 - RNA, 1710 nt, Artificial Sequence
  derived and/or modified CDS sequence (opt5) from Lassa virus__AIT17251__NP
augagcgccuccaaggagaucaaaucuuuccuguggacccagagccucagacgggaacuguccggcuacugcucuaacauuaaacuucaaguggucaaggacgcucaggcccugcuccacgggcuggauuuuagcgagguuuccaaugugcagcgccuuaugagaaagcagcggcgcgacgauucugaccugaaaagacuccgggaucugaaccaagcggugaauaaccuggucgaacucaagagcacacagcagaaguccgugcugcgcguuggaacgcuuaccagcgacgaucugcucauccuggcugccgaccuugagaaacugaagucuaaagugauuagaacagaacggccccucuccagcggcgucuauauggggaaucugucuucccagcaacuggaucagcgcagagcccuccugaacaugaucggaaugagcggcgggaaucagggagcucaggugggccgggacggcguugugcgcgucugggaugugaagaacgccgaccuucugaauaaccaauucgggaccaugccuucucucacacuggcuugucuuaccaaacagggacagguggaucugaaugacgucguucaagcccucacagaccugggccugauuuacaccgcgaaguauccgaacacguccgaucucgacagacuggcccagagccaucccauccuuaauaugaucgauaccaagaaauccucucugaacauuagcggguacaauuuuucccucggagcugccgugaaggcuggcgccugcaugcuggacgggggaaacaugcuugagacaaucaaagugagcccucagaccauggauggcauucugaagucuauccucaaagucaagaaagcgcugggcauguucauuuccgagacacccggggaacggaacccuuaugagaauauccuguacaagauuugucucagcggagacggcuggcccuauaucgccucucgcaccagcaucacggggagagcuugggaaaacacaauuguggaucuggaguccgacggaaagccucagaaaaccggcucuaauaacagcaauaagucccuucaaagcgccggguuuacagcuggacugaccuacucucagcucaugacccugaaagauuccaugcugcagcuugacccgaacgccaagacauggauggauaucgagggccggcccgaagacccuguugagguggcccucuaccagcccagcucuggcugcuauauucacuucuuuagagaaccuacggaccugaaacaauucaagcaggaugcuaaguacucccaugggaucgacgucaccgaucuguuugcggcccagcccggacucacaagcgcugugauugaggcccugccgcgcaauaugguuaucaccugucagggcuccgacgauauccggaaacuucuggaaucucaagggagaaaggacauuaaacucaucgauauugcccugaacaagacagacagccgcaaauaugagaaugcugugugggaucaguacaaggaccugugccacaugcauaccggagucguggucgagaagaaaaagcggggcgggaaagaagagaucacgccucacugugcccuuauggauugcauuauguucgacgcggcuguguccggcggacucaagacacugguucugagagccgugcucccccgcgauauggucuuucggaccucuaccccuaaagugguucuguga

SEQ ID NO: 2494 - RNA, 1710 nt, Artificial Sequence
  derived and/or modified CDS sequence (opt5) from Lassa virus__AIT17255__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcgugcugcgcguuggaacgcuuaccuccgacgaucugcucgugcuggcugccgaccuugaaaaacuuaagagcaaagucacaagaaccgagcggccccucucugccggcguguauauggggaaccuguccagccagcagcuggaucagcgcagagcucuccugucuaugaucggaauguccggcgggaaucagcgggcccaggcuggacgcgacggcguugugagagucugggaugugaagaacgccgagcuucugaauaaccaguucggcacaaugccuagccucacccuggcgugucuuacaaaacaaggacagguggaccugaaugaugccguccaggcucucaccgaccugggacugauuuacacgguuaaguauccgaacgccucugaccucgaucggcugacccaaucccaucccauccuuaauaugauugacacaaagaaaagcucccugaacaucucuggcuacaauuuuagccucggggcugccgugaaggcgggagccugcaugcuggauggcgggaacaugcuugaaaccaucaaaguguccccucagacaauggacgggauucucaagagcauccugaaagucaagaaaacccugggcauguucauuucugauacgcccggcgagcgcaacccuuaugaaaauauccuguacaagauuugucucuccggggacggauggcccuauaucgcuagcagaacaucuauuaccggccgggccugggagaacacagugguugaucuggagagcaaugggaagccucagaaagcugacuccaacucuagcaauaagucccuucagagcgccggauuuaccgccggccugaccuacucucaacucaugacacugaaagaugcuaugcugcagcuugacccgaacgcgaagacguggauggauaucgaagggagacccgaggacccuguggaaaucgccuucuaccagcccuccagcggaugcuauauucacuuuuuccgcgagccuaccgaccucaaacaguuuaagcaagaugcuaaguacucucauggcaucgacgucacagaucuguucgccgcccagcccggccugaccuccgcugugauugacgcccucccgcggaauaugguuaucacaugucaggggagcgaugacauuagaaaacugcuugaaucccagggacgcaaggauaucaaacugaucgacauugcgcucucuaagaccgauagccggaaauaugagaacgcugugugggaccaauacaaggaucugugccacaugcauacgggcgucguggucgagaagaaaaagagagggggaaaagaagagaucacaccucacugugcccugauggacugcauuauguuugaugccgcuguguccggcgggcuuaauacccucguucugcgcgccgugcugccccgggacauggucuucagaaccucuacaccucgcgugguucucuga

SEQ ID NO: 2495 - RNA, 1710 nt, Artificial Sequence
  derived and/or modified CDS sequence (opt5) from Lassa virus__AIT17259__NP
augagcgccuccaaggagaucaaaucuuuccuguggacccagagccucagacgggaacuguccucuuacugcagcaacauuaaacuucaaguggucaaggacgcucaggcccugcuccacggccuggauuuuuccgagguuucuaaugugcagcgccuuaugagaaaggaacggcgcgacgauaacgaccugaaaagacuccgggaucugaaucaggcggugaacaaucuggucgagcucaagagcacacaacagaaguccauccugcgcguggggacgcuuaccagcgacgaucugcucauucuggcugccgaccuugaaaaacugaagucuaaaguuacaagaaccgagcggccccucuccgccggaguguauaugggcaaccugagcucucagcagcuggaucaacgcagagcucuccugaauaugcuugggauguccggaagcaaccagggcgcccgggcugggcgcgacggagucgugagaguuugggaugugaagaaugccgagcugcucaacaaucaguucggcacaaugccuucucugacccuugcgugucugacaaaacagggccaagucgaccucaacgaugccgugcaggcucugaccgaccuggggcucaucuacacggccaaguauccgaauaccuccgaccuggaucggcuuacacagagccaucccauucugaacaugaucgacaccaagaaauccucucucaauaucagcggauacaacuuuucccugggcgcugccgugaaggcgggggccugcaugcuugauggaggcaacaugcuggaaacaauuaaagucagcccucaaaccauggacgggauccucaagucuauucugaaaguuaagaaagcucugggaauguucaucuccgauacgcccggcgagcgcaauccuuaugaaaacauucucuacaagaucugucugagcggcgacggguggcccuauauugccucuagaacaagcaucaccggacgggcuugggagaauacagugguggaucuugaguccgacggcaagccucagaaagccgggucuaacagcuccaauaagagccugcagucugccggauuuaccgcuggccucaccuacucccagcugaugacacugaaagaugcgaugcuucaacucgacccgaacgccaagacguggauggauaucgaagggagacccgaggacccugucgaaauugcucuguaccagcccagcucuggaugcuauauccacuucuuucgcgagccuaccgaccugaaacaguucaagcaggaugccaaguacucccauggcauugacgugacagaucucuuugccgcucaacccggccugaccagcgccguuaucgacgcgcuuccgcggaauauggugauuacaugucagggguccgaugacaucagaaaacugcucgaaucucagggacgcaaggauaucaaacugauugacaucgcucugagcaagaccgauucccggaaauaugagaacgccgucugggaccaguacaaggaucuuugccacaugcauacgggcauugugguugagaagaaaaagagagggggaaaagaagagaucacaccucacugugcccucauggacugcauuauguucgaugcugccgugucuggcgggcugaaugcuagcguccugcgcgccgugcucccccgggacauggucuuuagaaccuccaccccucgcgugguucuguga

SEQ ID NO: 2496 - RNA, 1710 nt, Artificial Sequence
  derived and/or modified CDS sequence (opt5) from Lassa virus__AIT17263__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcgugcugcgcguuggaacgcuuaccuccgacgaucugcucauccuggcugccgaccuugaaaaacuuaagagcaaagugauuagaacagagcggccccucucugccggcgucuauauggggaaccuguccagccagcagcuggaucagcgcagagcucuccugaauaugaucggaaugggcgggucuaaccagggagcccgggcuggccgcgacggcgugguuagagugugggaugucaagaaugccgagcuucugaacaaucaguucgggaccaugccuucccucacacuggcgugucuuaccaaacagggacaaguggaccugaacgaugccgugcaggcucucacagaccugggccugauuuacaccgccaaguauccgaauacgagcgaccucgaucggcugacccagucucaucccauccuuaacaugaucgacacaaagaaauccagccugaauauuuccggguacaacuuuucucucggagcugccgucaaggcgggcgccugcaugcuggaugggggaaacaugcuugaaaccaucaaaguuagcccucaaacaauggacggcauucugaaguccauccucaaagugaagaaagcucugggcauguucauuagcgauacccccggggagcgcaauccuuaugaaaacauccuguacaagauuugucucucuggagacggcuggcccuauaucgccuccagaacgagcaucacagggcgggcuugggagaauaccguggucgaucuggagucugacggaaagccucagaaagccggcagcaacggguccaauaagucucuucagagcgccggauuuacagcuggccugaccuacucccagcucaugacccugaaagaugcgaugcugcaacuugacccgaacacaaagacguggauggauauugaaggcagacccgaggacccuguggaaguugcccucuaccagcccagcucugggugcuauauccacuucuuucgcgagccuaccgaccugaaacaguucaagcaggaugcuaaguacucccauggaauugacgugacagaucuguuugccgcccaacccggccucaccagcgcugucaucgacgcccugccgcggaauauggugauuacaugucaggggucugaugacaucagaaaacuucuggaaucccagggacgcaaggauaucaaacucauugacaucgcgcugagcaagaccgauucccggaaauaugagaacgcuguuugggaccaguacaaggaucugugccacaugcauacgggcauuguggucgagaagaaaaagagagggggcaaagaagagaucacaccucacugugcccuuauggacugcauuauguucgaugccgcugugucuggaggccucaauaccagcguccugcgcgccgugcugccccgggacaugguuuuuagaaccuccacaccucgcgugguccucuga

SEQ ID NO: 2497 - RNA, 1710 nt, Artificial Sequence
  derived and/or modified CDS sequence (opt5) from Lassa virus__AIT17267__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcgugcugcgcguuggaacgcuuaccuccgacgaucugcucauccuggcugccgaccuugaaaaacuuaagagcaaagugacaagaaccgagcggccccucucugccggcgucuauauggggaaccuguccagccagcagcuggaucagcgcagagcucuccugaauaugauuggaaugucuggcgggaaccagggagcccgggcuggccgcgacggcgugguuagagugugggaugucaagaaugccgagcuucugaacaaucaguucgggacaaugccuucccucacccuggcgugucuuacaaaacagggacaaguggaccugaacgaugccgugcaggcucucaccgaccugggccugaucuacacggccaaguauccgaauaccagcgaccucgaucggcugacacagucucaucccauucuuaacaugaucgacaccaagaaauccagccugaauaucuccggguacaacuuuucucucggagcugccgucaaggcgggcgccugcaugcuggaugggggaaacaugcuugaaacaauuaaaguuagcccucaaaccauggacuccauccucaagagcauucugaaagugaagaaagcucugggcauguucaucucugauacgcccggcgagcgcaauccuuaugaaaacauucuguacaagaucugucucuccggggacggauggcccuauauugccagcagaacaucuaucaccggccgggcuugggagaauacaguggucgaucuggagagcgacgggaagccucagaaagccggauccaacaauucuaacaagagccuucaguccgccggcuuugcugcggggcugaccuacagccagcucaugacccugaaagaugccaugcugcaacuugacccgaaugcuaagacauggauggauaucgaaggaagacccgaggacccuguggaaauugcccucuaccagcccucuuccggcugcuauauccacuucuuucgcgagccuacggaccugaaacaguucaagcaggaugccaaguacagccauggcauugacguuaccgaucuguuugcugcccaacccgggcucacaucugcggugaucgacgcucugccgcggaacauggucauuaccugucagggauccgaugacaucagaaaacuucuggaaagccagggccgcaaggauaucaaacucauugacaucgcccuguccaagacagauucucggaaauaugagaaugccgugugggaccaguacaaggaucugugccacaugcauaccgggguuguggucgagaagaaaaagagaggaggcaaagaagagauuacgccucacugugcucuuauggacugcaucauguucgaugccgcugugagcgggggccucaacacauccguccugcgcgccgugcugccccgggacaugguuuuuagaaccaccacaccucgcgugguccucuga

SEQ ID NO: 2498 - RNA, 1710 nt, Artificial Sequence
  derived and/or modified CDS sequence (opt5) from Lassa virus__AIT17271__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugaauaugaucggaaugucuggcgggaaccagggagcccgggcuggccgcgacggcgucgugagaguuugggaugugaagaaugccgagcuucugaacaaucaguucgggacaaugccuucccucacccuggcgugucuuacaaaacagggacaagucgaccugaacgaugccgugcaggcucucaccgaccugggccugauuuacacggccaaguauccgaauaccagcgaccucgaucggcugacacagucucaucccauccuuaacaugaucgacaccaagaaauccagccugaauauuuccggguacaacuuuucucucggagcugccgugaaggcgggcgccugcaugcuggaugggggaaacaugcuugaaacaaucaaagucagcccucaaaccauggacggcauucugaagacgauccucaaaguuaagaaagcucugggcauguucauuuccgauacacccggggagcgcaauccuuaugaaaacauccuguacaagauuugucucagcggagacggcuggcccuauaucgccucuagaaccuccaucacagggcgggcuugggagaauaccgugguggaucuggagagcgacggaaagccucagaaaaccggcucuaacaauagcaacaagucccuucagucugccggguuugccgcuggacugacauacagccagcucaugacgcugaaagaugcgaugcugcaacuugacccgaaugccaagaccuggauggauauugaaggcagacccgaggacccugucgaaaucgcucucuaccagcccuccagcggcugcuauauucacuucuuucgcgagccuacagaccugaaacaguucaagcaggaugccaaguacucucaugggaucgacgugaccgaucuguuugccgcucaacccggacucacauccgccguuauugacgcgcugccgcggaacauggugaucaccugucagggcagcgaugacaucagaaaacuucuggaaucucaggggcgcaaggauauuaaacucaucgacauugcucuguccaaggccgauagccggaaauaugagaaugccgucugggaccaguacaaggaucugugccacaugcauacgggagugguuguggagaagaaaaagagaggcgggaaagaagagaucacaccucacugugcucuuauggacugcauuauguaugaugccgcugucuccggcggacucucuaccagcgugcugcgcgccguccugccccgggacaugguguucagaaccuccacaccucgcguugugcucuga

SEQ ID NO: 2499 - RNA, 1710 nt, Artificial Sequence
  derived and/or modified CDS sequence (opt5) from Lassa virus__AIT17275__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaagcagcggcgcgacgauggagaccugaaaagacuccgggaucugaaccaagcggugaauaaccuggucgaacucaagucuacacagcaaaagagcgugcugcgcguuggcacgcuuaccuccgacgaucugcucacacuggcugccgaccuugagaaacuuaagagcaaagugaccagaacagaacggccccucucugccggggucuauaugggaaaucuguccagccagcagcuggaucagcgcagagcucuccugaacaugaucggcaugucugggggaaaucagggcgcccggaccggcaaggacggggugguucgcauuugggaugugaaaaacgcugaccuucugaauaaccaguucggaacaaugccuucccucacccuggccugucuuacgaagcaaggccaggucgaucugaaugacguggugcaggcgcucaccgaccuggggcugaucuacacagccaaguauccgaacauuagcgaucucgacagacuggcucaaucucaucccauccuuaaaaugaucgauaccuccaagagcucccugaauauuucuggauacaacuuuagccucggcgccgcugucaaagccggggcgugcaugcuggacggaggcaauaugcuugagacaguuaagguguccccucagaccauggauggcauccugaaaagcauucucaaggugaaaaagucucuggggauguucaucuccgacacgcccggagagcggaacccuuaugaaaacauucuguacaagaucugucucagcggcgauggguggcccuauauugccucucgcacaagcaucaccggcagagcuugggagaauacagucguggaccuggaauccgauggaaaaccucagaagguugggucuaacaauagcaacaaaucccuucagagcaccggauuuaccgccggccugacauacucucaacucaugacgcugaaggacgcuaugcugcagcuugauccgaaugccaaaaccuggauggacaucgagggccggcccgaggacccuguggaaauugcccucuaccagcccuccagcgggugcuauauccacuucuuuagagagccuacagaucugaagcaguucaagcaagacgcuaaauacucucauggaauugaugucaccgaccuguuugcggcccagcccggccucacauccgcugugaucgauacccugccgcgcaacaugguuauuacgugucaggggagcgacgauaucggaaaacuucuggaaucccagggccggaaagacaucaagcucauugauaucgcccugucuaaaacagacagcagaaaguaugagaaugccgugugggaucaauacaaggaccugugccacaugcauaccggggucguggucgaaaagaagaaacgcggcggaaaggaggagauuaccccucacugugcucuuauggauugcaucauguucgacgccgcgguguccggcgggcucaacgcuucuguucugcgggccgugcugcccagagacauggucuuucgcacaagcaccccucgggugguucucuga

SEQ ID NO: 2500 - RNA, 1710 nt, Artificial Sequence
  derived and/or modified CDS sequence (opt5) from Lassa virus__AIT17277__NP
augagcgccuccaaggagaucaaaucuuuccuguggacccagagccucagacgggaacuguccucuuacugcagcaacauuaaacuucaaguggucaaggacgcucaggcccugcuccacggccuggauuuuuccgagguuucuaaugugcagcgccuuaugagaaaggaacggcgcgacgauaacgaccugaaaagacuccgggaucugaaucaggcggugaacaaucuggucgagcucaagagcacacaacagaaguccauccugcgcguggggacgcuuaccagcgacgaucugcucauucuggcugccgaccuugaaaaacugaagucuaaaguuacaagaaccgagcggccccucuccgccggaguguauaugggcaaccugagcucucagcagcuggaucaacgcagagcucuccuguccaugaucgggaugagcggaucuaaucagggcgcccgggcugggcgcgacggagucgugagaguuugggaugugaagaacgccgagcuucugaauaaccaguucggcacaaugccuucccucacccuggcgugucuuacaaaacagggccaagucgaccugaaugaugccgugcaggcucucaccgaccuggggcugauuuacacggccaaguauccgaacaccagcgaccucgaucggcugacacagucccaucccauccuuaauaugaucgacaccaagaaaucuagccugaacauuuccggauacaauuuuagccucggcgcugccgugaaggcgggggccugcaugcuggauggaggcaacaugcuugaaacaaucaaagucucuccucaaaccauggacgggauucugaaguccauccucaaaguuaagaaagcucugggaauguucauuagcgauacgcccggcgagcgcaacccuuaugaaaauauccuguacaagauuugucucucuggcgacggguggcccuauaucgccagcagaacauccaucaccggacgggcuugggagaacacagugguggaucuggagucugacggcaagccucagaaagccgggagcaauaacuccaauaagagccuucagucugccggauuuaccgcuggccugaccuacucccagcucaugacacugaaagaugcgaugcugcaacuugacccgaacgccaagacguggauggauauugaagggagacccgaggacccugucgaaguggcucucuaccagcccagcucuggaugcuauauccacuucuuucgcgagccuaccgaccugaaacaguucaagcaggaugccaaguacucccauggcauugacguuacagaucuguuugccgcucaacccggccucaccagcgccgugaucgacgcgcugccgcggaauauggucauuacaugucagggguccgaugacaucagaaaacuucuggaaucucagggacgcaaggauaucaaacucauugacaucgcucugagcaagaccgauucccggaaauaugagaacgccgugugggaccaguacaaggaucugugccacaugcauacgggcguuguggucgagaagaaaaagagagggggaaaagaagagauuacaccucacugugcccuuauggacugcaucauguucgaugcugccgugucuggcgggcucaauaccagcguccugcgcgcugugcugccccgggacaugguuuuuagaaccuccacaccucgcgugguccucuga

SEQ ID NO: 2501 - RNA, 1710 nt, Artificial Sequence
  derived and/or modified CDS sequence (opt5) from Lassa virus__AIT17281__NP
augagcgccuccaaggagaucaaaucuuuccuguggacccagagccucagacgggaacuguccggcuacugcucuaacauuaaacuucaaguggucaaggacgcucaggcccugcuccacgggcuggauuuuagcgagguuuccaaugugcagcgccuuaugagaaaggaacggcgcgacgauucugaccugaaaagacuccgggaucugaaccaggcggugaauaaccuggucgagcucaagagcacacaacagaaguccgugcugcgcguuggaacgcuuaccagcgacgaucugcucgugcuggcugccgaccuugaaaaacugaagucuaaagucacaagaaccgagcggccccucuccgccggcguguauauggggaaucugagcucucagcagcuggaucaacgcagagcucuccuguccaugaucggaaugagcggcgggaaccagggagcccgggcuggccgcgacggcguugugagaauuugggaugucaagaaugccgagcuucugaacaaucaguucgggacaaugccuucucucacccuggcgugucuuacaaaacagggacaaguggaccugaacgaugugguccaggcccucaccgaccugggccugaucuacacggcuaaguauccgaauaccuccgaccucgaucggcugacacagagccaucccauucuuaacaugaucgacaccaagaaauccucucugaauaucagcggguacaacuuuucccucggagccgcuguuaaggccggcgcgugcaugcuggaugggggaaauaugcuugaaacaauuaaagugagcccucaaaccauggacggcauccugaagucuauucucaaagugaagaaagcccugggcauguucaucuccgauacgcccggggagcgcaacccuuaugaaaacauucuguacaagaucugucucagcggagacggcuggcccuauauugcuucuagaacaagcaucaccgggcgggccugggagaauacaaucgucgaucuggaguccgacggaaagccucagaaaaccucuaccacaaacagcaauaagucccuucagagcgcuggcuuugccgccgggcugacguacucucagcucaugacccugaaagaugcuaugcugcaacuugacccgaacgcgaagacauggauggauauugaaggaagacccgaggacccuguggaaaucgcccucuaccagcccuccagcggcugcuauauucacuucuuucgcgagccuaccgaccugaaacaguucaagcaggaugcuaaguacucucauggcaucgacguuacagaucuguuugccgcccaacccgggcucaccuccgcugugauugacacgcugccgcggaauauggucaucacaugucagggaagcgaagauaucagacgccuucuggagucccagggccggaaagacauuaagcucaucgauauugcccugucuaaaaccgacagcagaaaguaugagaacgcggugugggaucaguacaaagaccugugccacaugcauaccgggguuguggucgaaaagaagaaaaagggaggcaaagaggaaaucacaccucacugugcucuuauggauugcauuauguucgacgccgccguguccgggggccucaauaccucuguccugcgcgcugugcugccccgggauaugguuuuuagaacaagcacgccucgcgugguccucuga

SEQ ID NO: 2502 - RNA, 1710 nt, Artificial Sequence
  derived and/or modified CDS sequence (opt5) from Lassa virus__AIT17285__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgcucuaugagaaaggaacggcgcgacgauaacgaccuuaaaagacugcgggaucucaaucaggcggugaacaaucuggucgagcuuaagagcacacaacagaaguccauccuccgcgugggaacgcugaccagcgacgaucuucugauucucgcugccgaccuggaaaaacuuaagucuaaaguuacaagaaccgagcggccccuguccgccggcguguauauggggaaccucagcucucagcagcuggaucaacgcagagcucugcucaauaugaucggaauguccggcagcaaccagggggcccgggcuggacgcgacggcgucgugagaguuugggaugugaagaaugccgagcugcuuaacaaucaguucggcacaaugccuucucugacccucgcgugucugacaaaacaggggcaagucgaccuuaacgauguggugcaggcccugaccgaccucggacugauuuacacggcuaaguauccgaaugccuccgaccuggaucggcucacccagagccaucccauccugaacaugaucgacacaaagaaauccucucuuaauauuagcggcuacaacuuuucccugggggcugccgucaaggcgggagccugcaugcucgauggcgggaacaugcuggaaaccaucaaaguuagcccucaaacaauggacggcauucuuaagucuauccugaaagugaagaaagcucucggaauguucauuuccgauacccccggcgagcgcaauccuuaugaaaacauccuguacaagauuugucugagcggggacggauggcccuauaucgccucuagaacgagcaucacaggccgggcuugggagaauaccauuguggaucucgaguccgacgggaagccucagaaagccggaaacaauggcucuaacaagagccugcaguccgccggguuuacagcuggacuuaccuacagccagcugaugacccucaaagaugcgaugcugcaacuggacccgaaugccaagacauggauggauaucgaaggcagacccgaggacccugucgaaauugcucuuuaccagcccucuuccggcugcuauauccacuucuuucgcgagccuacggaccucaaacaguucaagcaggaugccaaguacagccaugggauugacgugaccgaucuguuugccgcucaacccggacugacaucugccguuaucgacgcgcucccgcggaaccuggugaucaccugucagggcuccgaugacauuagaaaacuucuggaaagccaggggcgcaaggauaucaaacucauugacaucgcucuguccaagacagauucucggaaauaugagaaugccgucugggaccaguacaaggaucugugccacaugcauaccggaauugugguugagaagaaaaagagaggcgggaaagaagagaucacgccucacugugcccuuauggacugcaucauguucgaugcugccgugagcggcggacucaacacauccguccugcgcgcugugcugccccgggacauggucuuuagaaccucuaccccucgcgugguucucuga

SEQ ID NO: 2503 - RNA, 1710 nt, Artificial Sequence
  derived and/or modified CDS sequence (opt5) from Lassa virus__AIT17289__NP
augagcgccuccaaggagaucaaaucuuuccuguggacccagagccucagacgggaacuguccggcuacugcucuaacauuaaacuucaaguggucaaggacgcucaggcccugcuccacgggcuggauuuuagcgagguuuccaaugugcagcgccuuaugagaaaggaacggcgcgacgauucugaccugaaaagacuccgggaucugaaccaggcggugaauaaccuggucgagcucaagagcacacaacagaaguccgugcugcgcguuggaacgcuuaccagcgacgaucugcucgugcuggcugccgaccuugaaaaacugaagucuaaagucacaagaaccgagcggccccucuccgccggcguguauauggggaaucugagcucucagcagcuggaucaacgcagagcucuccuguccaugaucggaaugagcggcgggaaccagggaguucgggccggccgcgacggcguggucagaauuugggaugugaagaaugcugagcuucugaacaaucaguucgggacaaugccuucucucacccuggccugucuuacaaaacagggacaaguggaccugaacgaugucguucaggcgcucaccgaccugggccugaucuacacggccaaguauccgaauaccuccgaccucgaucggcugacacagagccaucccauucuuaacaugaucgacaccaagaaauccucucugaauaucagcggguacaacuuuucccucggagcugccgugaaggcuggcgccugcaugcuggaugggggaaauaugcuugaaacaauuaaagugagcccucaaaccauggacggcauccugaagucuauucucaaagucaagaaagcgcugggcauguucaucuccgauacgcccggggagcgcaacccuuaugaaaacauucuguacaagaucugucucagcggagacggcuggcccuauauugccucuagaacaagcaucaccgggcgggcuugggagaauacaaucguggaucuggaguccgacggaaagccucagaaaaccggcucuauuaacagcaauaagucccuucagagcaccggguuugccgcuggacugacauacucucagcucaugacgcugaaagaugccaugcugcaacuugacccgaacgccaagaccuggauggauaucgaaggcagacccgaggacccuguugaaauugcucucuaccagcccuccagcggcugcuauauccacuucuuucgcgagccuacagaccugaaacaguucaagcaggaugcgaaguacucucaugggauugacgugaccgaucuguuugccgcucaacccggacucacauccgccgucaucgacgcccugccgcggaauauggugaucaccugucagggcagcgaugacauuagaaaacuucuggaaucccaggggcgcaaggauaucaaacucauugacaucgcucugucuaagacggauagccggaaauaugagaacgccguuugggaccaguacaaggaucugugccacaugcauacaggaauuguggucgagaagaaaaagagaggcgggaaagaagagaucaccccucacugugcgcuuauggacugcaucauguucgaugcugccguguccggcggacucaauaccucuguccugcgcgccgugcugccccgggacaugguuuuuagaacaagcaccccucgcgugguccucuga

SEQ ID NO: 2504 - RNA, 1710 nt, Artificial Sequence
  derived and/or modified CDS sequence (opt5) from Lassa virus__AIT17293__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaagcagcggcgcgacgauaacgaccugaaaagacuccgggaucugaaucaagcggugaacaaucuggucgaacucaagucuacacagcaaaagagcgugcugcgcguuggaacgcuuaccuccgacgaucugcucgugcuggcugccgaccuugagaaacuuaagagcaaagucacaagaaccgaacggccccucucugccggcguguauauggggaaccuguccacacagcagcuggaucagcgcagagcucuccugaauaugaucggaaugagcggcgggaaccagggagcccgggcuggccgcgacggcguugugagagucugggaugugaagaaugccgaccuucugaacaaucaguucgggaccaugccuucucucacacuggcgugucuuaccaaacaaggacagguggaucugaacgacgucguucaggcccucacggaccugggccugauuuacaccgcuaaguauccgaauacauccgaucucgaccggcugacccaaagccaucccauccuuaacaugauugauacaaauaagucuucccugaacaucagcggguacaacuuuucccucggagccgcugugaaagccggcgcgugcaugcuggacgggggaaauaugcuugagaccaucaaggugucuccucagacgauggauggcauucugaaaagcauccucaaggucaaaaaggcccugggcauguucauuuccgacacacccggggagcgcaacccuuaugaaaauauccuguacaaaauuugucucagcggagauggcuggcccuauaucgcuucuagaaccuccauuacagggcgggccugggagaacaccgugguugaccuggaaagcgauggaaagccucagaaggcuggcgggaauaacucuaauaaaagccuucaguccgccggauuuaccgccggccugacauacucucaacucaugacgcugaaggacgcuaugcugcagcuugauccgaacgcgaaaaccuggauggacaucgagggcagacccgaggacccuguggaaaucgcccucuaccagcccagcuccgggugcuauauucacuucuuucgcgagccuacagaucugaagcaguucaaacaagacgcuaaguacagccauggaaucgaugucaccgaccuguuugccgcccagcccggccucacaucugcugugauugaugcccugccgcggaauaugguuaucaccugucagggguccgacgauauuagaaaacuucuggaaagccagggacgcaaggacaucaagcucaucgauauugcgcugucuaaaacggacucccggaaguaugagaacgcugugugggaucaauacaaagaccugugcaauaugcacacaggcaucgucguggaaaagaagaaaagagggggcaaggaggagauuaccccucauugugcccuuauggauugcaucauguucgacgccgcugucagcggaggcaugaacaccuccgugcuccgcgccguucugccccgggacaugguguuuagaacaucuaccccucgcgucgugcuguga

SEQ ID NO: 2505 - RNA, 1710 nt, Artificial Sequence
  derived and/or modified CDS sequence (opt5) from Lassa virus__AIT17295__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcgugcugcgcguuggaacgcuuaccuccgacgaucugcucauccuggcugccgaccuugaaaaacuuaagagcaaagugauuagaacagagcggccccucucugccggcgucuauauggggaaccuguccagccagcagcuggaucagcgcagagcucuccugaauaugaucggaaugggcgggucuaaccagggagcccgggcuggccgcgacggcgugguuagagugugggaugucaagaaugccgagcuucugaacaaucaguucgggaccaugccuucccucacacuggcgugucuuaccaaacagggacaaguggaccugaacgaugccgugcaggcucucacagaccugggccugauuuacaccgccaaguauccgaauacgagcgaccucgaucggcugacccagucucaucccauccuuaacaugaucgacacaaagaaauccagccugaauauuuccggguacaacuuuucucucggagcugccgucaaggcgggcgccugcaugcuggaugggggaaacaugcuugaaaccaucaaaguuagcccucaaacaauggacggcauucugaaguccauccucaaagugaagaaagcucugggcauguucauuagcgauacccccggggagcgcaauccuuaugaaaacauccuguacaagauuugucucucuggagacggcuggcccuauaucgccuccagaacgagcaucacagggcgggcuugggagaauaccauuguggaucuggagucugacggaaagccucagaaagccggcagcaacggguccaauaagucucuucagagcgccggauuuacagcuggccugaccuacucccagcucaugacccugaaagaugcgaugcugcaacuugacccgaacgccaagacauggauggauaucgaaggcagacccgaggacccugucgaaauugcucucuaccagcccagcucugggugcuauauccacuucuuucgcgagccuacggaccugaaacaguucaagcaggaugccaaguacucccauggaauugacgugaccgaucuguuugccgcucaacccggccucacaagcgccaucaucgacgcgcugccgcggaauaugguuauuaccugucaggggucugaugacaucagaaaacuucuggaaucccagggacgcaaggauauuaaacucaucgacauugcucugagcaagacagauucccggaaauaugagaacgccgugugggaccaguacaaggaucugugccacaugcauaccggcaucgucguggagaagaaaaagagagggggcaaagaagagaucacgccucacugugcccuuauggacugcauuauguucgaugcugccguuucuggaggccucaauacaagcgugcugcgcgcuguccugccccgggacaugguguuuagaaccuccaccccucgcgucgugcucuga

SEQ ID NO: 2506 - RNA, 1710 nt, Artificial Sequence
  derived and/or modified CDS sequence (opt5) from Lassa virus__AIT17299__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcgugcugcgcguuggaacgcuuaccuccgacgaucugcucgugcuggcugccgaccuugaaaaacuuaagagcaaagucacaagaaccgagcggccccucucugccggcguguauauggggaaccuguccagccagcagcuggaucagcgcagagcucuccugucuaugaucggaauguccggcgggaaucagggagcccggacaggccgcgacggcguugugagagucugggaugugaagaacgcugagcuucugaauaaccaguucgggaccaugccuagccucacacuggccugucuuaccaaacagggacaaguggaccugaaugaugucguucaggcgcucacggaccugggccugauuuacaccgccaaguauccgaacacaucugaccucgaucggcugacccagucccaucccauccuuaauaugauugacacaaagaaaagcucccugaacaucucuggguacaauuuuagccucggagcugccgugaaggcuggcgccugcaugcuggaugggggaaacaugcuugaaaccaucaaaguguccccucaaacgauggacggcauucucaagagcauccugaaagucaagaaagcgcugggcauguucauuucugauacacccggggagcgcaacccuuaugaaaauauccuguacaagauuugucucuccggagacggcuggcccuauaucgccagcagaaccucuauuacagggcgggcuugggagaacaccgugguugaucuggagagcgacggaaagccucagaaagccggcuccaauaacucuaauaagagccuucaguccgcuggguuuaccgccggacugacauacagccagcucaugacgcugaaagaugccaugcugcaacuugacccgaacgcuaagaccuggauggauaucgaaggcagacccgaggacccuguggaaaucgcgcucuaccagcccucuuccggcugcuauauucacuucuuucgcgagccuagcgaccugaaacaguucaagcaggaugccaaguacucucaugggaucgacgucacagaucuguuugcugcccaacccggacucaccuccgccgugauugacgcucugccgcggaauaugguuaucacaugucagggcagcgaugacauuagaaaacuuuucgaaucccaggggcgcaaggauaucaaacugaucgacauugcccucucuaagaccgauagccggaaauaugagaacgcggugugggaccaguacaaggaucugugccacaugcauacgggagucguggucgagaagaaaaagagaggcgggaaagaagagaucacaccucacugugcucugauggacugcauuauguuugaugccgccguguccggcggacuuaauucucucguucugcgcgcugugcugccccgggacauggucuucagaaccagcaccccucgcgugguucucuga

SEQ ID NO: 2507 - RNA, 1710 nt, Artificial Sequence
  derived and/or modified CDS sequence (opt5) from Lassa virus__AIT17303__NP
augagcgccuccaaggagaucaaaucuuuccuguggacccagagccucagacgggaacuguccggcuacugcucuaacauuaaacuucaaguggucaaggacgcucaggcccugcuccacgggcuggauuuuagcgagguuuccaaugugcagcgccuuaugagaaagcagcggcgcgacgauucugaccugaaaagacuccgggaucugaaccaagcggugaauaaccuggucgaacucaagagcacacagcagaaguccgugcugcgcguuggaacgcuuaccagcgacgaucugcucgugcuggcugccgaccuugagaaacugaagucuaaagucaucagaacagaacggccccucuccagcggcguguauauggggaaucugucuucccagcaacuggaucagcgcagagcccuccugaacaugauuggaaugagcggcgggaaucagggagcucagguuggccgggacggcgugguccgcgugugggaugugaagaacgccgaccuucugaauaaccaauucgggaccaugccuucucucacacuggcuugucuuaccaaacagggacaggucgaucugaaugacguugugcaagcccucacagaccugggccugaucuacaccgcgaaguauccgaacacguccgaucucgacagacuggugcagagccaucccauucuuaauaugaucgauaccaagaaauccucucugaacaucagcggguacaauuuuucccucggagccgcugucaaggccggcgcuugcaugcuggacgggggaaacaugcuugagacaauuaaagugagcccucagaccauggauggcauccugaagucuauucucaaaguuaagaaagcccugggcauguucaucuccgagacacccggggaacggaacccuuaugagaauauucuguacaagaucugucucagcggagacggcuggcccuauauugcgucucgcaccagcaucacggggagagccugggaaaacacaaucguggaucuggaguccgacggaaagccucagaaagcuggcucuaauaacagcaauaagucccuucaaagcgccggguuuaccgcuggacugacauacucucagcucaugacccugaaagauuccaugcugcagcuugacccgaacgccaagaccuggauggauauugagggccggcccgaagacccugucgagguggcccucuaccagcccagcucuggcugcuauauccacuucuuuagagaaccuacagaccugaaacaauucaagcaggaugcuaaguacucccaugggauugacguuacggaucuguuugcggcccagcccggacucaccagcgcugugaucgaggcccugccgcgcaauauggucauuacaugucagggcuccgacgauauccggaaacuucuggaaucucaagggagaaaggacaucaaacucauugauaucgcccugaacaagaccgacagccgcaaauaugagaaugcugugugggaucaguacaaggaccugugccacaugcauacaggagucgugguugagaagaaaaagcggggcgggaaagaagagauuaccccucacugugcccuuauggauugcaucauguucgacgcggcuguguccggcggacucaagacgcugguccugagagccgugcucccccgcgauaugguuuuucggacaucuaccccuaaagugguccuguga

SEQ ID NO: 2508 - RNA, 1710 nt, Artificial Sequence
  derived and/or modified CDS sequence (opt5) from Lassa virus__AIT17307__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcgugcugcgcguuggaacgcuuaccuccgacgaucugcucauccuggcugccgaccuugaaaaacuuaagagcaaagugacaagaaccgagcggccccucucugccggcgucuauauggggaaccuguccagccagcagcuggaucagcgcagagcucuccugucuaugauuggaauguccggcgggaaucagggagcccggacaggccgcgacggcgugguuagagugugggaugucaagaacgcugagcuucugaauaaccaguucgggaccaugccuagccucacacuggccugucuuaccaaacagggacaaguggaccugaaugaugugguccaggcgcucacggaccugggccugaucuacaccgccaaguauccgaacacaucugaccucgaucggcugacccagucccaucccauucuuaauaugaucgacacaaagaaaagcucccugaacaucucuggguacaauuuuagccucggagcugccguuaaggcuggcgccugcaugcuggaugggggaaacaugcuugaaaccauuaaaguguccccucaaacgauggacggcauccuuaagagcauucucaaagugaagaaagcgcugggcauguucaucucugauacacccggggagcgcaacccuuaugaaaauauucuguacaagaucugucucuccggagacggcuggcccuauauugccagcagaaccucuaucacagggcgggcuugggagaacaccgucguggaucuggagagcgacggaaagcugcagaaaaccggcuccaauaacucuaauaagagccugcaguccgccggguuuacagcuggacucacguacagccagcugaugacccugaaagaugccaugcuucaacucgacccuaacgccaagaucuggauggauauugaaggcagaccggaggaccccguugaaaucgcucuguaccagccuucuuccggcugcuauauucacuucuuucgcgagcccacagaccugaaacaguucaagcaggaugcgaaguacagccaugggaucgacgugaccgaucucuuugccgcucaaccuggacugacaucugccgucauugacgcccuuccccggaauauggugaucaccugucagggcuccgaugacaucagaaaacugcucgaaagccaggggcgcaaggauauuaaacugaucgacauugcucugaacaagacggauucccggaaauaugagaaugccguuugggaccaguacaaggaucuuugccacaugcauacaggaguggucguggagaagaaaaagaaaggcgggaaggaagagaucaccccgcacugugcgcucauggacugcauuauguucgaugcugccgucucuggcggacugaacaccagcgugcugagagccguucucccucgcgacaugguguuucggacauccacccccagagucgugcuguga

SEQ ID NO: 2509 - RNA, 1710 nt, Artificial Sequence
  derived and/or modified CDS sequence (opt5) from Lassa virus__AIT17311__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcgugcugcgcguuggaacgcuuaccuccgacgaucugcucauccuggcugccgaccuugaaaaacuuaagagcaaagugauuagaacagagcggccccucucugccggcgucuauauggggaaccuguccagccagcagcuggaucagcgcagagcucuccugaauaugaucggaaugggcgggucuaaccagggagcccgggcuggccgcgacggcgugguuagagugugggaugucaagaaugccgagcuucugaacaaucaguucgggaccaugccuucccucacacuggcgugucuuaccaaacagggacaaguggaccugaacgaugccgugcaggcucucacagaccugggccugauuuacaccgccaaguauccgaauacgagcgaccucgaucggcugacccagucucaucccauccuuaacaugaucgacacaaagaaauccagccugaauauuuccggguacaacuuuucucucggagcugccgucaaggcgggcgccugcaugcuggaugggggaaacaugcuugaaaccaucaaaguuagcccucaaacaauggacggcauucugaaguccauccucaaagugaagaaagcucugggcauguucauuagcgauacccccggggagcgcaauccuuaugaaaacauccuguacaagauuugucucucuggagacggcuggcccuauaucgccuccagaacgagcaucacagggcgggcuugggagaauaccguggucgaucuggagucugacggaaagccucagaaagccggcagcaacggguccaauaagucucuucagagcgccggauuuacagcuggccugaccuacucccagcucaugacccugaaagaugcgaugcugcaacuugacccgaacgccaagacauggauggauauugaaggcagacccgaggacccuguggaaguugcucucuaccagcccagcucugggugcuauauccacuucuuucgcgagccuacggaccugaaacaguucaagcaggaugccaaguacucccauggaauugacgugaccgaucuguuugccgcucaacccggccucacaagcgccgucaucgacgcgcugccgcggaauauggugauuaccugucaggggucugaugacaucagaaaacuucuggaaucccagggacgcaaggauaucaaacucauugacaucgcucugagcaagacagauucccggaaauaugagaacgccguuugggaccaguacaaggaucugugccacaugcauaccggcauuguggucgagaagaaaaagagagggggcaaagaagagaucacgccucacugugcccuuauggacugcauuauguucgaugcugccgugucuggaggccucaauacaagcguccugcgcgcugugcugccccgggacaugguuuuuagaaccuccaccccucgcgugguccucuga

SEQ ID NO: 2510 - RNA, 1710 nt, Artificial Sequence
  derived and/or modified CDS sequence (opt5) from Lassa virus__AIT17315__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcgugcugcgcguuggaacgcuuaccuccgacgaucugcucauccuggcugccgaccuugaaaaacuuaagagcaaagugacaagaaccgagcggccccucucugccggcgucuauauggggaaccuguccagccagcagcuggaucagcgcagagcucuccugaauaugauuggaaugucuggcuccaaccagggggcccgggcuggacgcgacggcgugguuagagugugggaugucaagaauguggagcuucugaacaaucaguucggcacaaugccuagccucacccuggccugucuuacaaaacaggggcaaguggaccugaacgaugcgguccaggcccucaccgaccugggacugaucuacacggcuaaguauccgaauaccucugaccucgaucggcugacacagucccaucccauucuuaacaugaucgacaccaagaaaagcucccugaauaucucuggcuacaacuuuagccucggggccgcuguuaaggccggagcgugcaugcuggauggcgggaacaugcuugaaacaauuaaaguguccccucaaaccauggacggaauccucaagagcauucugaaagugaagaaagcccugggcauguucaucucugauacgcccggcgagcgcaauccuuaugaaaacauucuguacaagaucugucucuccggggacggauggcccuauauugcuagcagaacaucuaucaccggccgggccugggagaauacagucguggaucuggagagcgacgggaagccucagaaagcuggauccaacucuagcaauaagucccuucagagcgccggcuuuaccgccgggcugaccuacucucagcucaugacacugaaagaugcuaugcugcaacuugacccgaacgcgaagacguggauggauaucgaaggaagacccgaggacccuguugaaauugcccucuaccagcccuccagcggcugcuauauccacuucuuucgcgagccuaccgaccugaaacaguucaagcaggaugcuaaguacucucauggcauugacgugacagaucuguuugccgcccaacccgggcucaccuccgcugucaucgacgcccugccgcggaauauggugauuacaugucagggaagcgaugacaucagaaaacuucuggaaucccagggccgcaaggauaucaaacucauugacaucgcgcugucuaagaccgauagccggaaauaugagaacgcuguuugggaccaguacaaggaucugugccacaugcauacggggauuguggucgagaagaaaaagaaaggauccaaggaagagaucacaccucacugugcccuuauggacugcauuauguucgaugccgcugugucuggcgggcucaaugccagcguccugagagcugugcugccccgcgacaugguuuuucggaccuccaccccuagagugguccucuga

SEQ ID NO: 2511 - RNA, 1710 nt, Artificial Sequence
  derived and/or modified CDS sequence (opt5) from Lassa virus__AIT17319__NP
augagcgccuccaaggagaucaaaucuuuccuguggacccagagccucagacgggaacuguccggcuacugcucuaacauuaaacuucaaguggucaaggacgcucaggcccugcuccacgggcuggauuuuagcgagguuuccaaugugcagcgccuuaugagaaagcagcggcgcgacgauucugaccugaaaagacuccgggaucugaaccaagcggugaauaaccuggucgaacucaagagcacacagcagaaguccgugcugcgcguuggaacgcuuaccagcgacgaucugcucgugcuggcugccgaccuugagaaacugaagucuaaagucaucagaacagaacggccccucuccagcggcguguauauggggaaucugucuucccagcaacuggaucagcgcagagcccuccugaacaugauuggaaugagcggcgggaaucagggagcucagguuggccgggacggcgugguccgcgugugggaugugaagaacgccgacaugcuuaauaaccaauucgggaccaugccuucucugacacucgcuugucugaccaaacagggacaggucgaucuuaaugacguugugcaagcccugacagaccucggccugaucuacaccgcgaaguauccgaacacguccgaucuggacagacucgcccagagccaucccauucugaauaugaucgauaccaagaaauccucucuuaacaucagcggguacaauuuuucccugggagcugccgugaaggcuggcgccugcaugcucgacgggggaaacaugcuggagacaauuaaagucagcccucagaccauggauggcauccuuaagucuauucugaaagugaagaaagcgcucggcauguucaucuccgagacacccggggaacggaacccuuaugagaauauucuguacaagaucugucugagcggagacggcuggcccuauauugccucucgcaccagcaucacggggagagcuugggaaaacacaaucguugaucucgaguccgacggaaagccucagaaagccggcucuaauaacagcaauaagucccugcaaagcgcuggguuuaccgccggacuuacauacucucagcugaugacccucaaagauuccaugcugcagcuggacccgaacgccaagaccuggauggauauugagggccggcccgaagacccuguggaggucgcucuuuaccagcccagcucuggcugcuauauccacuucuuuagagaaccuacagaccucaaacaauucaagcaggaugcgaaguacucccaugggauugacgugacggaucuguuugccgcucagcccggacugaccagcgccguuaucgaggcccucccgcgcaauauggugauuacaugucagggcuccgacgauauccggaaacugcuugaaucucaagggagaaaggacaucaaacugauugauaucguccucaacaagaccgacagccgcaaauaugagaaugcugugugggaucaguacaaggaccugugccacaugcauacaggagucgugguugagaagaaaaagcggggcgggaaagaagagauuaccccucacugugcccugauggauugcaucauguucgacgcggcuguguccggcggacuuaagacgaugguccucagagccgugcugccccgcgauaugguuuuucggacaucuaccccuaaagugguccuguga

SEQ ID NO: 2512 - RNA, 1710 nt, Artificial Sequence
  derived and/or modified CDS sequence (opt5) from Lassa virus__AIT17323__NP
augagcgccuccaaggagaucaaaucuuuccuguggacccagagccucagacgggaacuguccggcuacugcucuaacauuaaacuucaaguggucaaggacgcucaggcccugcuccacgggcuggauuuuagcgagguuuccaaugugcagcgccuuaugagaaagcagcggcgcgacgauucugaccugaaaagacuccgggaucugaaccaagcggugaauaaccuggucgaacucaagagcacacagcagaaguccgugcugcgcguuggaacgcuuaccagcgacgaucugcucgugcuggcugccgaccuugagaaacugaagucuaaagucaucagaacagaacggccccucuccagcggcguguauauggggaaucugucuucccagcaacuggaucagcgcagagcccuccugaacaugauuggaaugagcggcgggaaucagggagcucagguuggccgggacggcgugguccgcgugugggaugugaagaacgccgaccuucugaauaaccaauucgggaccaugccuucucucacacuggcuugucuuaccaaacagggacaggucgaucugaaugacguugugcaagcccucacagaccugggccugaucuacaccgcgaaguauccgaacacguccgaucucgacagacuggcccagagccaucccauucuuaauaugaucgauaccaagaaauccucucugaacaucagcggguacaauuuuucccucggagcugccgugaaggcuggcgccugcaugcuggacgggggaaacaugcuugagacaauuaaagucagcccucagaccauggauggcauccugaagucuauucucaaagugaagaaagcgcugggcauguucaucuccgagacacccggggaacggaacccuuaugagaauauucuguacaagaucugucucagcggagacggcuggcccuauauugccucucgcaccagcaucacggggagagcuugggaaaacacaaucguugaucuggaguccgacggaaagccucagaaagccggcucuaauaacagcaauaagucccuucaaagcgcuggguuuaccgccggacugacauacucucagcucaugacccugaaagauuccaugcugcagcuugacccgaacgccaagaccuggauggauauugagggccggcccgaagacccuguggaggucgcucucuaccagcccagcucuggcugcuauauccacuucuuuagagaaccuacagaccugaaacaauucaagcaggaugcgaaguacucccaugggauugacgugacggaucuguuugccgcucagcccggacucaccagcgccguuaucgaggcccugccgcgcaauauggugauuacaugucagggcuccgacgauauccggaaacuucuggaaucucaagggagaaaggacaucaaacucauugauaucgcucugaacaagaccgacagccgcaaauaugagaaugccgucugggaucaguacaaggaccugugccacaugcauacaggaguggucguggagaagaaaaagcggggcgggaaagaagagauuaccccucacugugcgcuuauggauugcaucauguucgacgcugccguuuccggcggacucaagacgcuggugcugagagccguccucccccgcgauaugguguuucggacaucuaccccuaaaguugugcuguga

SEQ ID NO: 2513 - RNA, 1710 nt, Artificial Sequence
  derived and/or modified CDS sequence (opt5) from Lassa virus__AIT17325__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaagcagcggcgcgacgauaacgaccugaaaagacuccgggaucugaaucaagcggugaacaaucuggucgaacucaagucuacacagcaaaagagcgugcugcgcguuggaacgcuuaccuccgacgaucugcucgugcuggcugccgaccuugagaaacuuaagagcaaagucacaagaaccgaacggccccucucugccggcguguauauggggaaccuguccagccagcagcuggaucagcgcagagcucuccugaauaugaucggaaugacaggcgggucucggggagcccaggcuggcggcgacgggguugugcgcgucugggaugugaagaacgccgaccuucugaauaaccaguucggaaccaugccuucccucacacuggcgugucuuaccaaacaaggccagguggaucugaaugacgucguucaggcccucacggaccuggggcugauuuacaccgcuaaguauccgaacacaagcgaucucgacagacugacccaaucucaucccauccuuaauaugauugauacaaagaaauccagccugaacaucuccggauacaauuuuucucucggcgccgcugugaaggccggggcgugcaugcuggacggaggcaacaugcuugagaccaucaaagugagcccucagacgauggauggcauucugaaguccauccucaaagucaagaaaagccuggggauguucauuucugacacacccggagagcggaacccuuaugaaaauauccuguacaagauuugucucuccggcgauggguggcccuauaucgccagccgcaccucuauuacaggcagagcuugggagaacaccgugguugaccuggaaagcgauggaaagccucagaaagccgggggaaauaacuccaauaagucucuucagagcgcuggcuuuaccgccggccugacauacucccaacucaugacgcugaaagacaccaugcugcagcuugauccgaacgccaagacauggauggacaucgaggggcggcccgaggacccuguggaagucgcucucuaccagcccagcucuggaugcuauauccacuucuuuagagagccuaccgaucugaaacaguucaagcaagacgcgaaguacucccauggcauugaugugacagaccuguuugccgcucagcccgggcucaccagcgccguuaucgaagcccugccgcgcaauauggugauuacgugucagggaucugaugacauccggaaacuucuggagucccagggcagaaaggauauuaaacucaucgacaucgcucugagcaaggucgauucccgcaaauaugaaaacgccgugugggaccaauacaaggaucugugccacaugcauacaggggucgugguugagaagaaaaagcggggcggaaaagaggaaauuaccccucacugugcgcuuauggacugcaucauguucgaugcugccgugucuggcgggcucaauacccugguccugagagccgugcucccccgcgacaugguuuuucggacaagcaccccuaaggugguccuguga

SEQ ID NO: 2514 - RNA, 1710 nt, Artificial Sequence
  derived and/or modified CDS sequence (opt5) from Lassa virus__AIT17329__NP
augagcgccuccaaggagaucaaaucuuuccuguggacccagagccucagacgggaacuguccggcuacugcucuaacauuaaacuucaaguggucaaggacgcucaggcccugcuccacgggcuggauuuuagcgagguuuccaaugugcagcgccuuaugagaaaggaacggcgcgacgauucugaccugaaaagacuccgggaucugaaccagacagugaauaaccuggucgagcucaagagcacgcaacagaaguccauccugcgcgugggaacccuuacaagcgacgaucugcucauucuggcggcugaccuugaaaaacugaagucuaaaguuaucagaaccgagcggccccucuccgccggcguguauauggggaaucugagcucucagcagcuggaucaacgcagagcccuccugaacaugauuggaauguccagcggcaaucagggggcucaggccggacgggacggcgucgugcgcguuugggaugugaagaacgcugagcuucugaauaaccaguucggcacaaugccuucucucacccuggccugucuuacaaaacaagggcaggucgaccugaaugaugcggugcaggcccucaccgaccugggacugaucuacacggcuaaguauccgaacaccuccgaccucgauagacugacacaaagccaucccauccuuaauaugauugacaccaagaaauccucucugaacaucagcggcuacaauuuuucccucggggccgcugugaaggccggagcgugcaugcuggauggcgggaacaugcuugaaacaauuaaagucagcccucagaccauggacggaauccugaagucuauucucaaaguuaagaaagcccugggcauguucaucuccgauacgcccggcgagcggaacccuuaugaaaauauucuguacaagaucugucucagcggggacggauggcccuauaucgcuucucgcacaagcauuaccggcagagccugggagaacacagugguggaucuggaguccgacgggaugccucagaaggcuggaucuagcuccagcaauaaaucucuucaguccgccggcuuugucgccgggcugaccuacagccaacucaugacccugaaggaugcuaugcugcagcuugacccgaacgcgaaaacauggauggauaucgaaggacggcccgaggacccuguggaaauugcccucuaccagcccucuuccggcugcuauauccacuucuuuagagagccuacggaccugaagcaguucaaacaagaugcuaaguacagccauggcauugacguuaccgaucuguuugccgcccagcccgggcucacauccgcugugaucgacgcccugccgcgcaauauggucaucaccugucagggaucugaugacauucggaaacuucuggaaagccagggcagaaaggauaucaagcucauugacaucgcgcuguccaaagcugauucucgcaaguaugagaacgccgugugggaccaauacaaagaucugugccacaugcauacagggguuguggucgagaagaagaaacggggaggcaaggaagagauuaccccucacugugcccuuauggacugcaucauguaugaugcugccgugagcgggggccucaauacguccguccugagagcugugcugccccgcgacaugguuuuccggacaagcaccccuagagugguccucuga

SEQ ID NO: 2515 - RNA, 1710 nt, Artificial Sequence
  derived and/or modified CDS sequence (opt5) from Lassa virus__AIT17333__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcgugcugcgcguuggaacgcuuaccuccgacgaucugcucauccuggcugccgaccuugaaaaacuuaagagcaaagugacaagaaccgagcggccccucucugccggcgucuauauggggaaccuguccagccagcagcuggaucagcgcagagcucuccugaauaugauuggaaugucuggcgggaaccagggagcccgggcuggccgcgacggcgugguuagagugugggaugucaagaaugccgagcuucugaacaaucaguucgggacaaugccuucccucacccuggcgugucuuacaaaacagggacaaguggaccugaacgaugccgugcaggcucucaccgaccugggccugaucuacacggccaaguauccgaauaccagcgaccucgaucggcugacacagucucaucccauucuuaacaugaucgacaccaagaaauccagccugaauaucuccggguacaacuuuucucucggagcugccgucaaggcgggcgccugcaugcuggaugggggaaacaugcuugaaacaauuaaaguuagcccucaaaccauggacuccauccucaagagcauucugaaagugaagaaagcucugggcauguucaucucugauacgcccggcgagcgcaauccuuaugaaaacauucuguacaagaucugucucuccggggacggauggcccuauauugccagcagaacaucuaucaccggccgggcuugggagaauacaguggucgaucuggagagcgacgggaagccucagaaagccggauccaacaauucuaacaagagccuucaguccgccggcuuugcugcggggcugaccuacagccagcucaugacccugaaagaugccaugcugcaacuugacccgaaugcuaagacauggauggauaucgaaggaagacccgaggacccuguggaaauugcccucuaccagcccucuuccggcugcuauauccacuucuuucgcgagccuacggaccugaaacaguucaagcaggaugccaaguacagccauggcauugacguuaccgaucuguuugcugcccaacccgggcucacaucugcggugaucgacgcucugccgcggaacauggucauuaccugucagggauccgaugacaucagaaaacuucuggaaagccagggccgcaaggauaucaaacucauugacaucgcccuguccaagacagauucucggaaauaugagaaugccgugugggaccaguacaaggaucugugccacaugcauaccgggauuguuguggagaagaaaaagagaggaggcaaagaagagaucacgccucacugugcucuuauggacugcauuauguucgaugccgcugucagcgggggccucaacacauccgugcugcgcgccguccugccccgggacaugguguuuagaaccucuaccccucgcguugugcucuga

SEQ ID NO: 2516 - RNA, 1710 nt, Artificial Sequence
  derived and/or modified CDS sequence (opt5) from Lassa virus__AIT17335__NP
augagcgccuccaaggagaucaaaucuuuccuguggacccagagccucagacgggaacuguccggcuacugcucuaacauuaaacuucaaguggucaaagacgcucaggcccugcuccacgggcuggauuuuagcgagguuuccaaugugcagcgccuuaugagaaaggaacggcgcgacgauucugaccugaaaagacuccgggaucugaaccaggcggugaauaaccuggucgagcucaagagcacacaacagaaguccauccugcgcgugggaacgcuuaccagcgacgaucugcucauucuggcugccgaccuugaaaaacugaagucuaaaguuacaagaaccgagcggccccucuccgccggcguguauauggggaaucugagcucucagcagcuggaucaacgcagagcucuccuguccaugaucggaaugagcucuggcguccagggggcccgggcuggacgcgacggcgugguuagagugugggaugucaagaacgccgagcuucugaauaaccaguucggcacaaugccuucccucacccuggcgugucuuacaaaacaggggcaaguggaccugaaugaugugguccaggcccucaccgaccugggacugauuuacacggcuaaguauccgaacaccagcgaccucgaucggcugacacagucccaucccauccuuaauaugaucgacaccaagaaaucuagccugaacauuuccggcuacaauuuuagccucggggccgcuguuaaggccggagcgugcaugcuggauggcgggaacaugcuugaaacaaucaaagugucuccucaaaccauggacggcauucugaaguccauccucaaagugaagaaagcccugggaauguucauuagcgagacgcccggcgaacgcaauccuuaugagaacauccuguacaagauuugucucucuggggauggauggcccuauaucgcuagcagaacauccaucaccggccgggccugggagaacacagucguggaccuggaaucugaugggaagccucagaaagcuggaagcaauaacuccaauaagagccuucagucuaccggcuuugccgccgggcugaccuacucccagcucaugacacugaaagacgcuaugcugcaacuugauccgaacgcgaagacguggauggacauugagggaagacccgaagauccuguugagguggcccucuaccagcccagcucuggcugcuauauccacuucuuucgcgaaccuaccgaccugaaacaguucaagcaggacgcuaaguacucccauggcauugaugucacagaccuguuugccgcccaacccgggcucaccagcgcugugaucgaugcccugccgcggaauaugguuauuacaugucagggauccgacgauaucaaaaagcugcuugagucucagggcagaaaagacaucaagcucauugauaucgcgcugagcaaaaccgacucccgcaaguaugagaacgcugugugggaucaguacaaggaccugugccacaugcauacgggggucguggucgaaaagaagaaacggggaggcaaggaggaaauuacaccucacugugcccuuauggauugcaucauguucgacgccgcugugucugggggccucaauaccagcguucugagagccgugcugccccgcgauauggucuuucggaccuccacaccuagagugguucucuga

SEQ ID NO: 2517 - RNA, 1710 nt, Artificial Sequence
  derived and/or modified CDS sequence (opt5) from Lassa virus__AIT17341__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugaauaugaucggaaugucuggcgggaaccagggagcccgggcuggccgcgacggcgucgugagaguuugggaugugaagaaugccgagcuucugaacaaucaguucgggacaaugccuucccucacccuggcgugucuuacaaaacagggacaagucgaccugaacgaugccgugcaggcucucaccgaccugggccugauuuacacggccaaguauccgaauaccagcgaccucgaucggcugacacagucucaucccauccuuaacaugaucgacaccaagaaauccagccugaauauuuccggguacaacuuuucucucggagcugccgugaaggcgggcgccugcaugcuggaugggggaaacaugcuugaaacaaucaaagucagcccucaaaccauggacggcauucugaaguccauccucaaaguuaagaaagcucugggcauguucauuagcgaugcccccggggagcgcaauccuuaugaaaacauccuguacaagauuugucucucuggagacggcuggcccuauaucgcuuccagaacgagcaucacagggcgggccugggagaauaccgugguggaucuggagucugacggaaagccucagaaagccggcagcaacggguccaauaagucucuucagagcgcuggauuuacagcgggccugaccuacucccagcucaugacccugaaagaugccaugcugcaacuugacccgaacgcuaagacauggauggauauugaaggcagacccgaggacccugucgaaaucgcccucuaccagcccagcucugggugcuauauucacuucuuucgcgagccuacggaccugaaacaguucaagcaggaugccaaguacucccauggaaucgacgugaccgaucuguuugcugcccaacccggccucacaagcgcgguuauugacgcucugccgcggaauauggugaucaccugucaggggucugaugacaucagaaaacuuuucgaaucccagggacgcaaggauauuaaacugaucgacauugcccucagcaaggccgauucccggaaauaugagaacgcugucugggaccaguacaaggaucugugccacaugcauacaggcgugguuguggagaagaaaaagagagggggcaaagaagagaucaccccucacugugcccugauggacugcauuauguuugaugcugccgucucuggaggccuuaauacgagcgugcuccgcgcgguccugccccgggacaugguguucagaacauccaccccucgcguugugcuguga

SEQ ID NO: 2518 - RNA, 1710 nt, Artificial Sequence
  derived and/or modified CDS sequence (opt5) from Lassa virus__AIT17345__NP
augagcgccuccaaggagaucaaaucuuuccuguggacccagagccucagacgggaacuguccggcuacugcucuaacauuaaacuucaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugucuaugaucggaauguccagcggcguccagggggcccgggcuggacgcgacggcgugguuagagugugggaugucaagaaugccgagcuucugaacaaucaguucggcacaaugccuucucucacccuggcgugucuuacaaaacaggggcaaguggaccugaacgaugugguccaggcccucaccgaccugggacugauuuacacggcuaaguauccgaauaccuccgaccucgaucggcugacacagagccaucccauccuuaacaugaucgacaccaagaaauccucucugaauauuagcggcuacaacuuuucccucggggccgcuguuaaggccggagcgugcaugcuggauggcgggaauaugcuugaaacaaucaaagugagcccucaaaccauggacggcauucugaagucuauccucaaagugaagaaagcccugggaauguucauuuccgagacgcccggcgaacgcaacccuuaugagaacauccuguacaagauuugucucagcggggauggauggcccuauaucgcuucuagaacaagcaucaccggccgggccugggagaauacagucguggaccuggaauccgaugggaagccucagaaagcuggaucuaacaauagcaacaagucccuucagagcgccggcuuuaccgccgggcugaccuacucucagcucaugacacugaaagacgcuaugcugcaacuugauccgaaugcgaagacguggauggacauugagggaagacccgaagauccuguugagguggcccucuaccagcccuccagcggcugcuauauccacuucuuucgcgaaccuaccgaccugaaacaguucaagcaggacgcuaaguacucucauggcauugaugucacagaccuguuugccgcccaacccgggcucaccuccgcugugaucgaugcccugccgcggaacaugguuauuacaugucagggaagcgacgauaucaaaaagcugcuggagucccagggcagaaaagacaucaagcucauugauaucgcgcugucuaaaaccgacagccgcaaguaugagaaugcugugugggaucaguacaaggaccugugccacaugcauacgggggucguggucgaaaagaagaaacggggaggcaaggaggaaauuacaccucacugugcccuuauggauugcaucauguucgacgccgcuguguccgggggccucaacaccucuguucugagagccgugcugccccgcgauauggucuuucggaccagcacaccuagagugguucucuga

SEQ ID NO: 2519 - RNA, 1710 nt, Artificial Sequence
  derived and/or modified CDS sequence (opt5) from Lassa virus__AIT17351__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaagcagcggcgcgacgauggagaccugaaaagacuccgggaucugaaccaagcggugaauaaccuggucgaacucaagucuacacagcaaaagagcgugcugcgcguuggcacgcuuaccuccgacgaucugcucauccuggcugccgaccuugagaaacuuaagagcaaagugauuagaacagaacggccccucucugccggggucuauaugggaaaucuguccagccagcagcuggagcagcgcagagcucuccugaacaugaucggcaugucuuccgggaaucagggagcccggaccggcaaggauggcgugguucgcauuugggacgugaaaaacgcugaucuucugaauaaccaguucgggacaaugccuagccucacccuggccugucuuacaaagcaaggacaggucgaccugaaugauguggugcaggcgcucaccgaccugggccugaucuacacggccaaguauccgaacaccucugaccucgauagacugacacaaucccaucccauccuuaauauggucgacaccagcaaauccucucugaacauuagcggguacaauuuuucccucggagcugccguuaaggcuggcgccugcaugcuggaugggggaaacaugcuugagacaaucaaagugagcccucagaccauggacggcauucugaagucuauccucaaagugaagaaaucccugggcauguucgucagcgauacgcccggggaacggaacccuuaugagaauauucuguacaagaucugucucucuggagacggcuggcccuauauugcgagccgcacauccaucaccgggagagccugggaaaacacagugguugaucuggagucuaauggaaagccucagaaagcuggcagcaacaauuccaacaagagccuucagucuaccggguuuaccgccggacugacauacucccaacucaugacgcugaaagacgcuaugcugcagcuugauccgaaugccaagaccuggauggacaucgagggccggcccgaagauccuguggagauugcccucuaccagcccagcucuggcugcuauauccacuucuuuagagaaccuacagaccugaaacaguucaagcaagacgcuaaguacucccaugggauugaugucaccgaccuguuugcggcccagcccggacucacaagcgcugugaucgauacccugccgcgcaacaugguuauuacgugucagggcuccgacgauauccggaaacuucuggagucucaggggagaaaggacaucaaacucauugauaucgcccugagcaagauugacucccgcaaauaugaaaaugccgugugggaucaauacaaggaccugugccacaugcauacaggagucguggucgagaagaaaaagcggggcgggaaagaggaaaucaccccucacugugcucuuauggauugcauuauguucgacgccgcggugucuggcggacucaacgcuagcguucugagagccgugcugccccgcgauauggucuuucggaccuccacaccuagagugguucucuga

SEQ ID NO: 2520 - RNA, 1710 nt, Artificial Sequence
  derived and/or modified CDS sequence (opt5) from Lassa virus__AIT17359__NP
augagcgccuccaaggagaucaaaucuuuccuguggacccagagccucagacgggaacuguccggcuacugcucuaacauuaaacuucaaguggucaaggacgcucaggcccugcuccacgggcuggauuuuagcgagguuuccaaugugcagcgccuuaugagaaaggaacggcgcgacgauucugaccugaaaagacuccgggaucugaaccaggcggugaauaaccuggucgagcucaagagcacacaacagaaguccauccugcgcgugggaacgcuuaccagcgacgaucugcucauucuggcugccgaccuugaaaaacugaagucuaaaguuacaagaaccgagcggccccucuccgccggcguguauauggggaaucugagcucucagcagcuggaucaacgcagagcucuccugaacaugcuuggaauguccggcagcaaucagggggcccgggcuggacgcgacggcgucgugagaguuugggaugugaagaacgccgagcugcucaauaaccaguucggcacaaugccuucucugacccuugcgugucugacaaaacaggggcaagucgaccucaaugaugccgugcaggcucugaccgaccugggacucaucuacacggccaaguauccgaacaccuccgaccuggaucggcuuacacagagccaucccauucugaauaugaucgacaccaagaaauccucucucaacaucagcggcuacaauuuuucccugggggcugccgugaaggcgggagccugcaugcuugauggcgggaacaugcuggaaacaauuaaagucagcccucaaaccauggacggaauccucaagucuauucugaaaguuaagaaagcucugggcauguucaucuccgauacgcccggcgagcgcaacccuuaugaaaauauucucuacaagaucugucugagcggggacggauggcccuauauugccucuagaacaagcaucaccggccgggcuugggagaacacagugguggaucuugaguccgacgaaaagccucagaaagccgggucuaauagcuccaacaagagccugcagucugccggauuuaccgcuggccucaccuacucccagcugaugacacugaaagaugcgaugcuucaacucgacccgaaugccaagacguggauggauaucgaggggagacccgaagacccugucgagauugcucuguaccagcccagcucuggaugcuauauccacuucuuucgcgaaccuaccgaccugaaacaguucaagcaggaugccaaguacucccauggcauugacgugacagaucucuuugccgcucaacccggccugaccagcgccguuaucgacgcgcuuccgcggaacauggugauuacaugucagggguccgaugacaucagaaaacugcucgagucucagggacgcaaggauaucaaacugauugacaucgcucugagcaagaccgauucccggaaauaugagaaugccgucugggaccaguacaaggaucuuugccacaugcauacgggcauugugguugaaaagaaaaagagagggggaaaagaggaaaucacaccucacugugcccucauggacugcauuauguucgaugcugccgugucuggcgggcugaacgcuagcguccugcgcgccgugcucccccgggacauggucuuuagaaccuccaccccucgcgugguucuguga

SEQ ID NO: 2521 - RNA, 1710 nt, Artificial Sequence
  derived and/or modified CDS sequence (opt5) from Lassa virus__AIT17361__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauucugaccugaaaagacuccgggaucugaaccaggcggugaauaaccuggucgagcucaagagcacacaacagaaguccgugcugcgcguuggaacgcuuaccagcgacgaucugcucgugcuggcugccgaccuugaaaaacugaagucuaaagucacaagaaccgagcggccccucuccgccggcguguauauggggaaucugagcucucagcagcuggaucaacgcagagcucuccugaacaugaucggaauguccggcgggaaucagggagcccgggcuggccgcgacggcguugugagaauuugggaugucaagaacgccgagcuucugaauaaccaguucgggacaaugccuagccucacccuggcgugucuuacaaaacagggacaaguggaccugaaugaugugguccaggcccucaccgaccugggccugaucuacacggcuaaguauccgaacaccucugaccucgaucggcugacacagucccaucccauucuuaauaugaucgacaccaagaaaagcucccugaacaucucuggguacaauuuuagccucggagccgcuguuaaggccggcgcgugcaugcuggaugggggaaacaugcuugaaacaauuaaaguguccccucaaaccauggacggcauccuuaagagcauucucaaagugaagaaagcccugggcauguucaucucugauacgcccggggagcgcaacccuuaugaaaauauucuguacaagaucugucucuccggagacggcuggcccuauauugcuagcagaacaucuaucaccgggcgggccugggagaacacaaucgucgaucuggagagcgacggaaagccucagaaaaccaauaacaccaauuccaacaagucucuucagagcgcuggcuuugccgccgggcugacauacucccagcucaugacgcugaaagaugcuaugcugcaacuugacccgaaugcgaagaccuggauggauauugaaggaagacccgaggacccuguggaaaucgcccucuaccagcccagcucuggcugcuauauucacuucuuucgcgagccuacagaccugaaacaguucaagcaggaugcuaaguacucccauggcaucgacguuaccgaucuguuugccgcccaacccgggcucacaagcgcugugauugacacccugccgcggaacauggucaucacgugucagggaucugaagauaucagacgccuucuggagucccagggccggaaagacauuaagcucaucgauauugcccugagcaaaacagacuccagaaaguaugagaaugcggugugggaucaguacaaagaccugugccacaugcauaccgggguuguggucgaaaagaagaaaaagggaggcaaagaggaaaucaccccucacugugcucuuauggauugcauuauguucgacgccgccgugucugggggccucaacacaagcguccugcgcgcugugcugccccgggauaugguuuuuagaaccuccacaccucgcgugguccucuga

SEQ ID NO: 2522 - RNA, 1710 nt, Artificial Sequence
  derived and/or modified CDS sequence (opt5) from Lassa virus__AIT17365__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugaauaugaucggaaugucuggcuccaaccagggggcccaggcuggacgggacggcgucgugcgcguuugggaugugaagaaugccgagcuucugaacaaucaguucggcacaaugccuagccucacccuggcgugucuuacaaaacaagggcaggucgaccugaacgaugccgugcaggcucucaccgaccugggacugauuuacacggccaaguauccgaauaccucugaccucgauagacugacacaaucccaucccauccuuaacaugaucgacaccaagaaaagcucccugaauauuucuggcuacaacuuuagccucggggcugccgugaaggcgggagccugcaugcuggauggcgggaacaugcuugaaacaaucaaagucuccccucagaccauggacggcauucucaagagcauccugaaaguuaagaaagcucugggaauguucauuucugaugcccccggcgagcggaauccuuaugaaaacauccuguacaagauuugucucuccggggacggauggcccuauaucgcuagccgcacgucuaucacaggcagagccugggagaauaccgugguggaucuggagagcgacgggaagccucagaaagccggauccaacggcucuaauaagagccuucaguccgcuggguuuacagcgggacugaccuacagccaacucaugacccugaaagaugccaugcugcagcuugacccgaacgcuaagacauggauggauauugaaggccggcccgaggacccugucgaaaucgcccucuaccagcccucuuccggcugcuauauucacuucuuuagagagccuacggaccugaaacaguucaagcaagaugccaaguacagccaugggaucgacgugaccgaucuguuugcugcccagcccggacucacaucugcgguuauugacgcucugccgcgcaauauggugaucaccugucagggcuccgaugacauccggaaacuuuucgaaagccaggggagaaaggauauuaaacugaucgacauugcccucuccaagacagauucucgcaaauaugagaacgccgucugggaccaauacaaggaucugugccacaugcauaccggaaucgugguugagaagaaaaagcggggcgggaaagaagagauuacgccucacugugcucugauggacugcaucauguuugaugccgcugugagcggcggacuuaauacauccguccucagagccgugcugccccgcgacauggucuuccggaccucuaccccuagagugguucuguga

SEQ ID NO: 2523 - RNA, 1710 nt, Artificial Sequence
  derived and/or modified CDS sequence (opt5) from Lassa virus__AIT17371__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugaauaugaucggaaugucuggcuccaaccagggggcccaggcuggacgggacggcgucgugcgcguuugggaugugaagaaugccgagcuucugaacaaucaguucggcacaaugccuagccucacccuggcgugucuuacaaaacaagggcaggucgaccugaacgaugccgugcaggcucucaccgaccugggacugauuuacacggccaaguauccgaauaccucugaccucgauagacugacacaaucccaucccauccuuaacaugaucgacaccaagaaaagcucccugaauauuucuggcuacaacuuuagccucggggcugccgugaaggcgggagccugcaugcuggauggcgggaacaugcuugaaacaaucaaagucuccccucagaccauggacggcauucucaagagcauccugaaaguuaagaaagcucugggaauguucauuucugaugcccccggcgagcggaauccuuaugaaaacauccuguacaagauuugucucuccggggacggauggcccuauaucgcuagccgcacgucuaucacaggcagagccugggagaauaccgugguggaucuggagagcgacgggaagccucagaaagccggauccaacucuagcaauaagucccuucagagcgcuggcuuuacagcggggcugaccuacucucaacucaugacccugaaagaugccaugcugcagcuugacccgaacgcuaagacauggauggauauugaaggacggcccgaggacccugucgaaaucgcccucuaccagcccuccagcggcugcuauauucacuucuuuagagagccuacggaccugaaacaguucaagcaagaugccaaguacucucauggcaucgacgugaccgaucuguuugcugcccagcccgggcucacauccgcgguuauugacgcucugccgcgcaauauggugaucaccugucagggaagcgaugacauccggaaacuuuucgaaucccagggcagaaaggauauuaaacugaucgacauugcccucucuaagacagauagccgcaaauaugagaacgccgucugggaccaauacaaggaucugugccacaugcauaccgggaucgugguugagaagaaaaagcggggaggcaaagaagagauuacgccucacugugcucugauggacugcaucauguuugaugccgcuguguccgggggccuuaauacaucuguccucagagccgugcugccccgcgacauggucuuccggaccagcaccccuagagugguucuguga

SEQ ID NO: 2524 - RNA, 1710 nt, Artificial Sequence
  derived and/or modified CDS sequence (opt5) from Lassa virus__AIT17379__NP
augagcgccuccaaggagaucaaaucuuuccuguggacccagagccucagacgggaacuguccggcuacugcucuaacauuaaacuucaaguggucaaggacgcucaggcccugcuccacgggcuggauuuuagcgagguuuccaaugugcagcgccuuaugagaaaggaacggcgcgacgauucugaccugaaaagacuccgggaucugaaccaggcggugaauaaccuggucgagcucaagagcacacaacagaaguccgugcugcgcguuggaacgcuuaccagcgacgaucugcucauccuggcugccgaccuugaaaaacugaagucuaaagugacaagaaccgagcggccccucuccgccggcgucuauauggggaaucugagcucucagcagcuggaucaacgcagagcucuccugaacaugauuggaauguccagcggcaaucggggagcccaggcuggacgcgacggcgugguuagagugugggaugucaagaacgccgagcuucugaauaaccaguucggcacaaugccuucucucacccuggcgugucuuacaaaacaggggcaaguggaccugaaugaugccgugcaggcucucaccgaccugggacugaucuacacggccaaguauccgaacaccuccgaccucgaucggcugacacagagccaucccauucuuaauauggucgacaccaagaaauccucucugaacaucagcggcuacaauuuuucccucggggcugccguuaaggcgggagccugcaugcuggauggcgggaacaugcuugaaacaaucaaagugagcccucaaaccauggacgggauucugaagucuauccucaaagugaagaaagcucugggcauguucauuuccgauacgcccggcgagcgcaacccuuaugaaaauauccuguacaagauuugucucagcggggacggauggcccuauaucgccucuagaacaagcauuaccggccgggcuugggagaacacagucguggaucuggaguccgacgggaagccucagaaagccggaucuaauaacagcaauaagucccuucagagcgccggcuuugcugcggggcugaccuacucucagcucaugacccugaaagaugccaugcugcaacuugacccgaacgcuaagacauggauggauaucgaaggaagacccgaggacccuguugaaaucgcccucuaccagcccuccagcggcugcuauauucacuucuuucgcgagccuacggaccugaaacaguucaagcaggaugccaaguacucucauggcaucgacgugaccgaucuguuugcugcccaacccgggcucacauccgcggucauugacgcucugccgcggaauauggugaucaccugucagggaagcgaugacauuagaaaacuucuggaaucccagggccgcaaggauaucaaacucaucgacauugcccugucuaagacagauagccggaaauaugagaacgccguuugggaccaguacaaggaucugugccacaugcauaccgggaucguggucgagaagaaaaagagaggaggcaaagaagagauuacgccucacugugcucuuauggacugcaucauguucgaugccgcuguguccgggggccucaauacaucuguccugcgcgccgugcugccccgggacaugguuuuuagaaccagcaccccucgcgugguccucuga

SEQ ID NO: 2525 - RNA, 1710 nt, Artificial Sequence
  derived and/or modified CDS sequence (opt5) from Lassa virus__AIT17381__NP
augagcgccuccaaggagaucaaaucuuuccuguggacccagagccucagacgggaacuguccggcuacugcucuaacauuaaacuucaaguggucaaggacgcucaggcccugcuccacgggcuggauuuuagcgagguuuccaaugugcagcgccuuaugagaaaggaacggcgcgacgauucugaccugaaaagacuccgggaucugaaccaggcggugaauaaccuggucgagcucaagagcacacaacagaaguccgugcugcgcguuggaacgcuuaccagcgacgaucugcucgugcuggcugccgaccuugaaaaacugaagucuaaagucacaagaaccgagcggccccucuccgccggcguguauauggggaaucugagcucucagcagcuggaucaacgcagagcucuccuguccaugaucggaaugagcggcgggaaccagggagcccgggcuggccgcgacggcguugugagaauuugggaugucaagaaugccgagcuucugaacaaucaguucgggacaaugccuucucucacccuggcgugucuuacaaaacagggacaaguggaccugaacgaugugguccaggcccucaccgaccugggccugaucuacacggcuaaguauccgaauaccuccgaccucgaucggcugacacagagccaucccauucuuaacaugaucgacaccaagaaauccucucugaauaucagcggguacaacuuuucccucggagccgcuguuaaggccggcgcgugcaugcuggaugggggaaauaugcuugaaacaauuaaagugagcccucaaaccauggacggcauccugaagucuauucucaaagugaagaaagcccugggcauguucaucuccgauacgcccggggagcgcaacccuuaugaaaacauucuguacaagaucugucucagcggagacggcuggcccuauauugcuucuagaacaagcaucaccgggcgggccugggagaauacaaucgucgaucuggaguccgacggaaagccucagaaaaccucuaacaccaauagcaacaagucccuucagagcgcuggcuuugccgccgggcugacauacucucagcucaugacgcugaaagaugcuaugcugcaacuugacccgaaugcgaagaccuggauggauauugaaggaagacccgaggacccuguggaaaucgcccucuaccagcccuccagcggcugcuauauucacuucuuucgcgagccuacagaccugaaacaguucaagcaggaugcuaaguacucucauggcaucgacguuaccgaucuguuugccgcccaacccgggcucacauccgcugugauugacgcccugccgcggaacauggucaucaccugucagggaagcgaagauaucagaaaacuucuggagucccagggccgcaaggacauuaaacucaucgauauugcgcugucuaagacggacagccggaaauaugagaaugcugugugggaucaguacaaggaccugugccacaugcauacagggguuguggucgaaaagaaaaagaaaggaggcaaggaggaaaucaccccucacugugcccuuauggauugcauuauguucgacgccgcuguguccgggggccucaacaccucuguccugagagccgugcugccccgcgauaugguuuuucggacaagcaccccuagagugguccucuga

SEQ ID NO: 2526 - RNA, 1710 nt, Artificial Sequence
  derived and/or modified CDS sequence (opt5) from Lassa virus__AIT17389__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaagcagcggcgcgacgauggagaccugaaaagacuccgggaucugaaccaagcggugaauaaccuggucgaacucaagucuacacagcaaaagagcgugcugcgcguuggcacgcuuaccuccgacgaucugcucauccuggcugccgaccuugagaaacuuaagagcaaagugacaagaaccgaacggccccucucugccggggucuauaugggaaaucuguccagccagcagcuggaucagcgcagagcucuccugaacaugauuggcaugucugggggaaaucagggcgcccggacaggcaaggacggggugguucgcaucugggaugugaaaaacgcugaccuucugaauaaccaguucggaaccaugccuucccucacacuggccugucuuaccaagcaaggccaggucgaucugaaugacguggugcaggcgcucacggaccuggggcugauuuacaccgccaaguauccgaacacaagcgaucucgacagacugacccaaucucaucccauccuuaauaugaucgauacauccaaaagcucccugaacauuucuggauacaauuuuagccucggcgcugccgucaaggcuggggccugcaugcuggacggaggcaacaugcuugagaccaucaaaguuuccccucagacgauggauggcauucucaagagcauccugaaagugaagaaaucucuggggauguucauuuccgacacacccggagagcggaacccuuaugaaaauauccuguacaagauuugucucagcggcgauggguggcccuauaucgcgucucgcaccagcaucacagggagagccugggagaacaccguggucgaccuggaauccgauggcaagccucagaaagcugggucuaauaacagcaauaagucccuucagagcaccggauuuacagccggccugacguacucucaacucaugacccugaaagacgcuaugcugcagcuugauccgaacgccaagacauggauggacauugagggccggcccgaggacccuguggaaaucgcccucuaccagcccuccagcgggugcuauauucacuucuuuagagagccuaccgaucugaaacaguucaagcaagacgcuaaguacucucauggaaucgauguuacagaccuguuugcggcccagcccggccucaccuccgcugugauugauacgcugccgcgcaauauggucaucacaugucaggggagcgacgauauccggaaacuucuggaaucccagggaagaaaggacauuaaacucaucgauauugcccugucuaagaccgacagccgcaaauaugagaacgccgugugggaucaauacaaggaccugugccacaugcauaccggcguuguggucgaaaagaaaaagcggggaggcaaagaggagaucacaccucacugugcucuuauggauugcauuauguucgacgccgcgguguccggaggccucaaugucucugugcugagagcuguucugccccgcgacaugguguuucggaccagcacaccuagagucgugcucuga

SEQ ID NO: 2527 - RNA, 1710 nt, Artificial Sequence
  derived and/or modified CDS sequence (opt5) from Lassa virus__AIT17399__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaagcagcggcgcgacgauucugaccugaaaagacuccgggaucugaaccaagcggugaauaaccuggucgaacucaagagcacacagcagaaguccgugcugcgcguuggaacgcuuaccagcgacgaucugcucgugcuggcugccgaccuugagaaacugaagucuaaagucaucagaacagaacggccccucuccagcggcguguauauggggaaucugucuucccagcaacuggaucagcgcagagcccuccugaacaugauuggaaugagcggcgggaaucagggagcucagguuggccgggacggcgugguccgcgugugggaugugaagaacgccgaccuucugaauaaccaauucgggaccaugccuucucucacacuggcuugucuuaccaaacagggacaggucgaucugaaugacguugugcaagcccucacagaccugggccugaucuacaccgcgaaguauccgaacacguccgaucucgacagacuggcccagagccaucccauucuuaauaugaucgauaccaagaaauccucucugaacaucagcggguacaauuuuucccucggagcugccgugaaggcuggcgccugcaugcuggacgggggaaacaugcuugagacaauuaaagucaccccucagacaauggauggcauccuuaagagcauucucaaagugaagaaagcgcugggcauguucaucucugagacccccggggaacggaacccuuaugagaauauucuguacaagaucugucucuccggagacggcuggcccuauauugccagccgcacgucuaucacagggagagcuugggaaaacaccguuguggaucuggagagcgacggaaagccucagaaagccggcaauaacaauuccaacaagucucuucaaagcgcuggguuuacagccggacugaccuacucccagcucaugacccugaaagauagcaugcugcagcuugacccgaaugccaagacauggauggauaucgagggccggcccgaagacccugucgagguggcucucuaccagcccucuuccggcugcuauauucacuucuuuagagaaccuacggaccugaaacaauucaagcaggaugcgaaguacagccaugggaucgacguuaccgaucuguuugccacacagcccggacucaccucugcugugauugaggcccugccgcgcaacauggucaucacaugucagggcuccgacgauauucggaaacuucuggaaagccaagggagaaaggacaucaaacucaucgauauugcccugaauaagaccgacucccgcaaauaugagaacgcugugugggaucaguacaaggaccugugccacaugcauacgggagucgugguugagaagaaaaagcggggcgggaaagaagagaucacaccucacugugcccuuauggauugcauuauguucgacgcggcugugucuggcggacucaagacccuggcccugagagccguccucccccgcgauaugguguuucggaccagcacaccuaaaguugugcuguga

SEQ ID NO: 2528 - RNA, 1710 nt, Artificial Sequence
  derived and/or modified CDS sequence (opt5) from Lassa virus__AIT17405__NP
augagcguguccaaggaggucaaaucuuuccuguggacccagagccucagacgggaacuguccggcuacugcucuaacaucaaacuucaaguugugaaggacgcccaggcucugcuccacgggcuggauuuuagcgagguguccaauguccagcgccuuaugagaaagcagaaacgggacgauucugaccugaagcgccucagagaucugaaccaagccgugaauaaccugguugaacucaagagcacacagcagaaauccauucugcgggugggaacgcuuaccagcgacgaucugcucacacuggcggcugaccuugagaagcugaaaucuaaggucauccgcaccgaaagaccccucuccagcggcguguauauggggaaucugucuacacagcaacuggagcagcggcgcgcccuccugaacaugauuggaaugguuggcggggcccagggaacccagccuggcagagauggcgugguccgggugugggacgugaaaaauccggaucuucugaacaaucaauucgggacaaugcccucccucacccuggcuugucuuacgaagcagggacaggucgaccugaacgaugccguucucgcucugaccgaccugggccucaucuacacagccaaguauccuaauagcucugaccuggaucgccuuucccaaagccaucccauucugaacaugguggacaucaaaaaguccucucucaauaucagcggguacaacuuuucccugggagcggccgugaaagcuggcgccugcaugcuugaugggggaaauaugcuggagaccauuaaggucacaccucagaccauggacggcauccucaaaagcauucugaaggugaaaagaucucugggcauguucguuuccgauacgcccggggaacggaacccuuaugagaacauccucuacaagauuugucugagcggagacggcuggccguauaucgcuucucgcacaagcauuguggggagagccugggaaaauaccacagucgaucuugaguccgacggaaagccccagaaagugggcucugcggggagcaacaagucccugcagagcgccggauuuccuaccggccucaccuacucucaacugaugacacugaaagauuccaugaugcagcuugaccccagcgcuaagacguggaucgauaucgagggccggccugaagaccccguugagauugcccucuaccagccgaugucugggugcuauauccacuucuuuagagaaccuaccgaccugaaacaguucaagcaagaugcuaaguacucccauggaauugacguggccgaucuguuucccgcccagccuggccucacaagcgcugucaucgaggcgcugccccgcaauauggugcuuaccugucagggguccgacgauauuaaacggcugcucgacucucagggaagacgcgauaucaagcugaucgacauugcccugagcaaagcugauucccggagauucgaaaacgccgucugggaccaaugcaaggaucuuugucacaugcauacaggcgugguuguggagaaaaagaagcgcgggggcaaagaggaaaucacgccccacugcgcccucauggacuguauuauguaugaugcugccgucucuggaggccugaauaucccugugcugcgggcgguucucccgagagacaugguguuucgcaccagcucccccaaggucgugcuguga

SEQ ID NO: 2529 - RNA, 1710 nt, Artificial Sequence
  derived and/or modified CDS sequence (opt5) from Lassa virus__AIT17409__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauggagaccugaagcgccucagagaucugaaccaagcggucaauaaccugguggaacucaagucuacccagcagaaaagcauucugcggguuggcacgcuuaccuccgacgaucugcucacacuggcugccgaccuugagaagcugaaaagcaaggugauccgcaccgaaagaccccucucuuccggggucuauaugggaaaucugagcacacagcaacuggagcagcggcgcgcccuccugaacaugauuggcaugguugggggagcucagggcacccagccuggcagagaugggguggugcgggucugggacgugaaaaauccggaucuucugaacaaucaauucggaacaaugcccucucucacccuggccugucuuacgaagcagggccagguggaccugaacgaugcuguccucgcccugaccgaccuggggcucaucuacacagcgaaguauccuaauuccagcgaccuggaucgccuuucucaaucccaucccauucugaacaugguugacaccaaaaagagcucccucaauaucucuggauacaacuuuagccugggcgccgcugugaaagccggggcuugcaugcuugauggaggcaauaugcuggagacaaucaaggugaccccucagacgauggacggcauucucaaauccauccugaaggucaaaaagagccuggggauguucgugucugauacacccggagaaagaaacccuuaugagaacauucucuacaagaucugucuguccggcgacggguggccguauauugccagccggaccucuaucguuggacgcgcgugggaaaauacaaccguggaucuugagagcgacggcaaaccccagaaggucgggaccgccggauccaacaaaucucugcagagcgcuggcuuuccuacaggccucacguacucccaacugaugacccugaaggauagcaugaugcagcuugaccccucugccaaaacauggauugauaucgaggggagaccugaagaccccguggagaucgcucucuaccagccgauguccggaugcuauauucacuucuuucgggaaccuaccgaccugaagcaguucaagcaagaugccaaauacagccauggcaucgacguuacagaucuguuuucugcccagcccgggcucaccuccgcugugauugaggcgcugccuagaaauaugguccuuacgugucagggaagcgacgauaucaagcgccugcucgacucccagggccggagagauauuaaacugaucgacaucgcccugaacaaggcugauucucgccgguucgaaaaugccgugugggaccaaugcaaagaucuuugucacaugcauacaggggucgugguugagaagaagaaaagaggcggaaaggaggaaauuacaccccacugcgcccucauggacuguaucauguaugaugcugccgugagcggcgggcugaacauucccguccugcgcgcggugcucccucgggacaugguuuuuagaaccuccucuccgaaagugguccuguga

SEQ ID NO: 2530 - RNA, 1710 nt, Artificial Sequence
  derived and/or modified CDS sequence (opt5) from Lassa virus__AIT17413__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugggcggggcucagggaacccagccuggcagagauggcguugugcgggucugggacgugaaaaacccggaucuucugaauaaccaauucgggacaaugcccagccucacccuggccugucuuacgaagcagggacagguggaccugaaugaugcuguccucgcccugaccgaccugggccucaucuacacagcgaaguauccuaacucuuccgaccuggaucgccuuagccaaucccaucccauucugaauaugguugacaccaaaaagucuagccucaacaucuccggguacaauuuuagccugggagccgcugugaaagccggcgcuugcaugcuugaugggggaaacaugcuggagacaaucaaggugaccccucagacgauggacggcauucucaaaucuauccugaaggucaaaagaucccugggcauguucgugagcgaugcccccggggaacggaauccuuaugagaacauucucuacaagaucugucugucuggagacggcuggccguauauugcgagccgcacauccaucguugggagagccugggaaaacaccacaguggaucuugagucugacggaaagccccagaaaaugggcaccgcugggagcaauaagucccugcagagcgccggauuuccuaccggccucacauacucucaacugaugacgcugaaagauuccaugaugcagcuugaccccagcgcuaagaccuggauugauaucgagggccggccugaagaccccgucgagaucgcccucuaccagccgaugucugggugcuauauucacuucuuuagagaaccuacagaccugaaacaguucaagcaagaugccaaguacucccauggaaucgacguggcugaucuguuucccgcgcagccuggccucaccagcgccguuauugaggcucugccccgcaacauggugcuuacaugucagggguccgacgauaucaaaaagcugcucgacucucagggacggagagauauuaaacugaucgacaucgcccugagcaaggccgauucccgccgguucgaaaaugcugucugggaccaaugcaaagaucuuugucacaugcauaccggcguggucguggagaagaagaaaagagggggcaaggaggaaauuacgccccacugcgcccucauggacuguaucauguaugaugcggcuguuucuggaggccugaacauuccugugcugcgcgccguccucccgcgggacaugguguuuagaacaagcucccccaaaguugugcuguga

SEQ ID NO: 2531 - RNA, 1710 nt, Artificial Sequence
  derived and/or modified CDS sequence (opt5) from Lassa virus__AIT17421__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaacaugauuggaaugguguccggcgcucaggggacccagccuggaagagauggcguugugcgggucugggacgugaaaaauccggaucuucugaacaaucaauucggcacaaugcccagccucacccuggccugucuuacgaagcagggacagguggaccugaacgaugcuguccucgcccugaccgaccuggggcucaucuacacagcgaaguauccuaauucuuccgaccuggaucgccuuagccaaucccaucccauucugaacaugguugacaucaaaaagucuagccucaauaucuccggcuacaacuuuagccugggggccgcugugaaagccggagcuugcaugcuugauggcgggaauaugcuggagaccauuaaggugacaccucagaccauggacggaauccucaaaucuauucugaaggucaaaagaucccugggcauguucgugagcgauacgcccggcgaacggaacccuuaugagaacauccucuacaagauuugucugucuggggacggauggccguauaucgccagccgcacauccauuguuggcagagcgugggaaaauaccacaguggaucuugagucugacgggaagccccagaaaaugggaagcgccggcuccaacaagagccugcagucugcuggguuuccuaccggacucaccuacucccaacugaugacacugaaagauagcaugaugcagcuugaccccucugccaagacguggaucgauaucgagggccggccugaagaccccgucgagauugcucucuaccagccgauguccggcugcuauauccacuucuuuagagaaccuaccgaccugaaacaguucaagcaagaugccaaguacagccaugggauugacguggccgaucuguuucccgcucagccuggacucacauccgcgguuaucgaggcccugccccgcaauauggugcuuaccugucagggcucugacgauauuaaacggcugcucgacagccaggggagacgcgauaucaagcugaucgacauugcucuguccaaagccgauucucggagauucgaaaacgccgucugggaccaaugcaaggaucuuugucacaugcauacaggaguggucguggagaaaaagaagcgcggcgggaaagaggaaaucacgccccacugcgcucucauggacuguauuauguaugaugccgcgguuagcggcggacugaauaucccugugcugcgggcuguccucccgagagacaugguguuucgcaccuccagccccaagguugugcuguga

SEQ ID NO: 2532 - RNA, 1710 nt, Artificial Sequence
  derived and/or modified CDS sequence (opt5) from Lassa virus__AIT17425__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugggcggggcucagggaacccagccuggcagagauggcguugugcgggucugggacgugaaaaacccggaucuucugaauaaccaauucgggacaaugcccagccucacccuggccugucuuacgaagcagggacagguggaccugaaugaugcuguccucgcccugaccgaccugggccucaucuacacagcgaaguauccuaacucuuccgaccuggaucgccuuagccaaucccaucccauucugaauaugguugacaccaaaaagucuagccucaacaucuccggguacaauuuuagccugggagccgcugugaaagccggcgcuugcaugcuugaugggggaaacaugcuggagacaaucaaggugaccccucagacgauggacggcauucucaaaucuauccugaaggucaaaaagucccugggcauguucgugagcgauacacccggggaaagaaauccuuaugagaacauucucuacaagaucugucugucuggagacggcuggccguauauugccagccggaccuccaucguugggcgcgcgugggaaaacacaauuguggaucuugagucugacggaaaaccccagaaggucggcaccgccgggagcaauaaaucccugcagagcgcuggauuuccuaccggccucacauacucucaacugaugacgcugaaggauuccaugaugcagcuugaccccagcgccaaaaccuggaucgauaucgagggcagaccugaagaccccguggagauugcucucuaccagccgaugucugggugcuauauccacuucuuucgggaaccuacagaccugaagcaguucaagcaagaugccaaauacucccauggaauugacguugccgaucuguuucccgcucagccuggccucaccagcgcggugaucgaggcccugcccagaaacaugguccuuacaugucagggguccgacgauauuaagcgccugcucgacucucagggacggagagauaucaaacugaucgacauugcucugagcaaggccgauucccgccgguucgaaaaugccgugugggaccaaugcaaagaucuuugucacaugcauaccggcgucgugguugagaagaagaaaagagggggcaaggaggaaaucacgccccacugcgcucucauggacuguauuauguaugaugccgcggugucuggaggccugaacaucccuguccugcgcgcugugcucccgcgggacaugguuuuuagaacaagcucccccaaagugguccuguga

SEQ ID NO: 2533 - RNA, 1710 nt, Artificial Sequence
  derived and/or modified CDS sequence (opt5) from Lassa virus__AIT17429__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucugcccagcaacuggagcagcggcgcgcucuccugaacaugauuggaauggugggcggggcccagggaacacagccuggcagagauggcguugugcgggucugggacgugaaaaauccggaucuucugaacaaucaauucgggaccaugcccucccucacacuggcuugucuuaccaagcagggacagguggaccugaacgaugccguccucgcgcugacggaccugggccucaucuacaccgccaaguauccuaauagcucugaccuggaucgccuuucccaaagccaucccauucugaacaugguugacaccaaaaaguccucucucaauaucagcggguacaacuuuucccugggagcugccgugaaagcuggcgccugcaugcuugaugggggaaauaugcuggagaccaucaaggugacaccucagaccauggacggcauucucaaaagcauccugaaggucaaaagaucucugggcauguucguguccgaugcgcccggggaacggaacccuuaugagaacauucucuacaagaucugucugagcggagacggcuggccguauauugccucucgcacgagcaucguugggagagcuugggaaaauacaaccguggaucuugaguccgacggaaagccccagaaagucggcacagccgggucuaacaagagccugcaguccgcuggauuuccuaccggccucaccuacagccaacugaugacacugaaagauucuaugaugcagcuugaccccuccgccaagacguggauugauaucgagggccggccugaagaccccguggagaucgcccucuaccagccgaugagcgggugcuauauucacuucuuuagagaaccuaccgaccugaaacaguucaagcaagaugcuaaguacucucauggaaucgacguugcggaucuguuucccgcccagccuggccucacauccgcugugauugaggcccugccccgcaauaugguccuuaccugucaggggagcgacgauaucaaacggcugcucgacucccagggaagacgcgauauuaagcugaucgacaucgcccugucuaaagcugauagccggagauucgaaaacgccgugugggaccaaugcaaggaucuuugucacaugcauacaggcgucgugguugagaaaaagaagcgcgggggcaaagaggaaauuacaccccacugcgcgcucauggacuguaucauguaugaugcugccguguccggaggccugaauauuccuguccugcgggccgugcucccgagagacaugguuuuucgcacgucuagccccaaggugguccuguga

SEQ ID NO: 2534 - RNA, 1710 nt, Artificial Sequence
  derived and/or modified CDS sequence (opt5) from Lassa virus__AIT17431__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaacaugauuggaauggugggcggggcucagggaacccagccuggcagagauggcguugugcgggucugggacgugaaaaauccggaucuucugaacaaucaauucgggacaaugcccucccucacccuggccugucuuacgaagcagggacagguggaccugaacgaugcuguccucgcccugaccgaccugggccucaucuacacagcgaaguauccuaauagcucugaccuggaucgccuuucccaaagccaucccauucugaacaugguugacaccaaaaaguccucucucaauaucagcggguuuaacuucucccugggagccgcugugaaagccggcgcuugcaugcuugaugggggaaauaugcuggagacaaucaaggugaccccucagacgauggacggcauucucaaaagcauccugaaggucaaaaagucucugggcauguuuguguccgauacacccggggaaagaaacccuuacgagaacauucucuauaagaucugucugagcggagacggcuggccguacauugccucucggaccagcaucguugggcgcgcgugggaaaauacaaccguggaucuugaguccgacggaaaaccccagaaggucggcaccgccgggucuaacaaaagccugcaguccgcuggauucccuacaggccucacguauagccaacugaugacccugaaggauucuaugaugcagcuugaccccuccgccaaaacauggauugauaucgagggcagaccugaagaccccguggagaucgcucucuaccagccgaugagcgggugcuacauucacuuuuuccgggaaccuaccgaccugaagcaguuuaagcaagaugccaaauauucucauggaaucgacguugccgaucuguuccccgcucagccuggccucacauccgcggugauugaggcccugcccagaaauaugguccuuaccugucaggggagcgacgauaucaagcgccugcucgacucccagggacggagagauauuaaacugaucgacaucgcucugucuaaggccgauagccgccgguuugaaaacgccgugugggaccaaugcaaagaucuuugucacaugcauacgggcgucgugguugagaagaagaaaagagggggcaaggaggaaauuacaccccacugcgcucucauggacuguaucauguacgaugccgcgguguccggaggccugaauauuccuguccugcgcgcugugcucccgcgggacaugguuuucagaaccgccucucccaaagugguccuguga

SEQ ID NO: 2535 - RNA, 1710 nt, Artificial Sequence
  derived and/or modified CDS sequence (opt5) from Lassa virus__AIT17439__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugggcggggcucagggaacccagccuggcagagauggcguugugcgggucugggacgugaaaaacccggaucuucugaauaaccaauucgggacaaugcccagccucacccuggccugucuuacgaagcagggacagguggaccugaaugaugcuguccucgcccugaccgaccugggccucaucuacacagcgaaguauccuaacucuuccgaccuggaucgccuuagccaaucccaucccauucugaauaugguugacaccaaaaagucuagccucaacaucuccggguuuaauuucagccugggagccgcugugaaagccggcgcuugcaugcuugaugggggaaacaugcuggagacaaucaaggugaccccucagacgauggacggcauucucaaaucuauccugaaggucaaaagaucccugggcauguuugugagcgauacacccggggaacggaauccuuacgagaacauucucuauaagaucugucugucuggagacggcuggccguacauugccagccgcaccuccaucguugggagagcgugggaaaacacaaccguggaucuugagucugacggaaagccccagaaaaugggcaccgccgggagcaauaagucccugcagagcgcuggauucccuacaggccucacguauucucaacugaugacccugaaagauuccaugaugcagcuugaccccagcgccaagacauggauugauaucgagggccggccugaagaccccgucgagaucgcucucuaccagccggugucugggugcuacauucacuuuuucagagaaccuaccgaccugaaacaguuuaagcaagaugccaaguauucccauggaaucgacguugccgaucuguucagcgcucagcccggccucacauccgcggugauugaggcccugccucgcaacaugguccuuaccugucaggggucugacgauaucaaacggcugcucgacagccagggaagacgcgauauuaagcugaucgacaucgcucuguccaaagccgauucucggagauuugaaaaugccgugugggaccaaugcaaggaucuuugucacaugcauacgggcgucgugguugagaaaaagaagcgcgggggcaaagaggaaauuacaccccacugcgcucucauggacuguaucauguacgaugccgcggugagcggaggccugaacauucccgucuuccgggcugugcugccuagagacaugguuuuucgcaccuccagcccgaaggugguccucuga

SEQ ID NO: 2536 - RNA, 1710 nt, Artificial Sequence
  derived and/or modified CDS sequence (opt5) from Lassa virus__AIT17443__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugggcggggcucagggaacccagccuggcagagauggcguugugcgggucugggacgugaaaaacccggaucuucugaauaaccaauucgggacaaugcccagccucacccuggccugucuuacgaagcagggacagguggaccugaaugaugcuguccucgcccugaccgaccugggccucaucuacacagcgaaguauccuaacucuuccgaccuggaucgccuuagccaaucccaucccauucugaauaugguugacaccaaaaagucuagccucaacaucuccggguacaauuuuagccugggagccgcugugaaagccggcgcuugcaugcuugaugggggaaacaugcuggagacaaucaaggugaccccucagacgauggacggcauucucaaaucuauccugaaggucaaaagaucccugggcauguucgugagcgaugcccccggggaacggaauccuuaugagaacauucucuacaagaucugucugucuggagacggcuggccguauauugcgagccgcacauccaucguugggagagccugggaaaacaccacaguggaucuugagucugacggaaagccccagaaagucggcaccgcugggagcaauaagucccugcagagcgccggauuuccuaccggccucacauacucucaacugaugacgcugaaagauuccaugaugcagcuugaccccagcgcuaagaccuggauugauaucgagggccggccugaagaccccguggagaucgcccucuaccagccgaugucugggugcuauauucacuucuuuagagaaccuacagaccugaaacaguucaagcaagaugccaaguacucccauggaaucgacguugcugaucuguuucccgcgcagccuggccucaccagcgccgugauugaggcucugccccgcaacaugguccuuacaugucagggguccgacgauaucaaaaagcugcucgacucucagggacggagagauauuaaacugaucgacaucgcccugagcaaggccgauucccgccgguucgaaaaugcugugugggaccaaugcaaagaucuuugucacaugcauaccggcgucgugguugagaagaagaaaagagggggcaaggaggaaauuacgccccacugcgcccucauggacuguaucauguaugaugcggcugugucuggaggccugaacauuccuguccugcgcgccgugcucccgcgggacaugguuuuuagaacaagcucccccaaagugguccuguga

SEQ ID NO: 2537 - RNA, 1710 nt, Artificial Sequence
  derived and/or modified CDS sequence (opt5) from Lassa virus__AIT17447__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaacaugauuggaauggugggcggggcucagggaacccagccuggcagagauggcguugugcgggucugggacgugaaaaauccggaucuucugaacaaucaauucgggacaaugcccucccucacccuggccugucuuacgaagcagggacagguggaccugaacgaugcuguccucgcccugaccgaccugggccucaucuacacagcgaaguauccuaauagcucugaccuggaucgccuuucccaaagccaucccauucugaacaugguugacaccaaaaaguccucucucaauaucagcggguacaacuuuucccugggagccgcugugaaagccggcgcuugcaugcuugaugggggaaauaugcuggagacaaucaaggugaccccucagacgauggacggcauucucaaaagcauccugaaggucaaaaagucucugggcauguucguguccgauacacccggggaaagaaacccuuaugagaacauucucuacaagaucugucugagcggagacggcuggccguauauugccucucggaccagcaucguugggcgcgcgugggaaaauacaaccguggaucuugaguccgacggaaaaccccagaaggucggcaccacagggucuaacaaaagccugcaguccgccggauuuccuacgggccucaccuacagccaacugaugacacugaaggauucuaugaugcagcuugaccccuccgcuaaaaccuggauugauaucgagggcagaccugaagaccccguggagaucgcccucuaccagccgaugagcgggugcuauauucacuucuuucgggaaccuacagaccugaagcaguucaagcaagaugcuaaauacucucauggaaucgacguuaccgaucuguuucccgcccagccuggccucacguccgccgugauugaggcucugcccagaaauaugguccuuacaugucaggggagcgacgauaucaagcgccugcucgacucccagggacggagagauauuaaacugaucgacaucgcgcugucuaaggccgauagccgccgguucgaaaacgcugugugggaccaaugcaaagaucuuugucacaugcauaccggcgucgugguugagaagaagaaaagagggggcaaggaggaaauuacaccccacugcgcccucauggacuguaucauguaugaugccgcuguguccggaggccugaauauuccuguccugcgcgccgugcucccgcgggacaugguuuuuagaaccucuagccccaaagugguccuguga

SEQ ID NO: 2538 - RNA, 1710 nt, Artificial Sequence
  derived and/or modified CDS sequence (opt5) from Lassa virus__AIT17451__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacccagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaacaugauuggaauggugggcggggcucagggaacccagccuggcagagauggcguugugcgggucugggacgugaaaaauccggaucuucugaacaaucaauucgggacaaugcccucccucacccuggccugucuuacgaagcagggacagguggaccugaacgaugcuguccucgcccugaccgaccugggccucaucuacacagcgaaguuuccuaauagcucugaccuggaucgccuuucccaaagccaucccauucugaacaugguugacaccaaaaaguccucucucaauaucagcggguauaacuucucccugggagccgcugugaaagccggcgcuugcaugcuugaugggggaaauaugcuggagacaaucaaggugaccccucagacgauggacggcauucucaaaagcauccugaaggucaaaaagucucugggcauguuuguguccgauacacccggggaaagaaacccuuacgagaacauucucuauaagaucugucugagcggagacggcuggccguacauugccucucggaccagcaucguugggcgcgcgugggaaaauacaaccguggaucuugaguccgacggaaaaccccagaaggucggcaccacagggucuaacaaaagccugcaguccgccggauucccuacgggccucaccuauagccaacugaugacacugaaggauucuaugaugcagcuugaccccuccgcuaaaaccuggauugauaucgagggcagaccugaagaccccguggagaucgcccucuaccagccgaugagcgggugcuacauucacuuuuuccgggaaccuacagaccugaagcaguuuaagcaagaugcuaaauauucucauggaaucgacguugccgaucuguuccccgcccagccuggccucaccuccgcugugauugaggcgcugcccagaaauaugguccuuacgugucaggggagcgacgauaucaagcgccugcucgacucccagggacggagagauauuaaacugaucgacaucgcccugucuaaggcugauagccgccgguuugaaaacgccgugugggaccaaugcaaagaucuuugucacaugcauacaggcgucgugguugagaagaagaaaagagggggcaaggaggaaauuacaccccacugcgcccucauggacuguaucauguacgaugcugccguguccggaggccugaauauuccuguccugcgcgcggugcucccgcgggacaugguuuucagaaccucuagccccaaagugguccuguga

SEQ ID NO: 2539 - RNA, 1710 nt, Artificial Sequence
  derived and/or modified CDS sequence (opt5) from Lassa virus__AIT17455__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcguucugcgggugggaacgcuuaccucugacgaucugcucacacuggcugccgaccuugagaagcugaaauccaaggucauucgcaccgaaagaccccucagcucuggcguguauauggggaaccuguccacacagcaacuggagcagcggcgcgcccuccugagcaugaucggaaugguuggcggggcucagggaacccagccuggcagagauggcgugguccgggugugggacgugaaaaauccggaucuucugaacaaucaauucgggacaaugcccucucucacccuggccugucuuacgaagcagggacaggucgaccugaacgaugcuguucucgcccugaccgaccugggccucauuuacacagcgaaguauccuaauuccagcgaccuggaucgccuuucccaaucucaucccauccugaacaugguggacaccaaaaagagcucccucaauauuagcggguacaacuuuucucugggagccgcugugaaagccggcgcuugcaugcuugaugggggaaauaugcuggagacaaucaaggucaccccucagacgauggacggcauccucaaauccauucugaaggugaaaagaagccugggcauguucguuucugauacacccggggaacggaacccuuaugagaauauccucuacaagauuugucugagcggagacggcuggccguauaucgccucccgcaccucuauuguggggagagcgugggaaaacacaaccgucgaucuugagagcgacggaaagccccagaaagugggcaccgccggguccaacaagagccugcagucugcuggauuuccuacaggccucacguacucccaacugaugacccugaaagauagcaugaugcagcuugaccccucugccaagacauggaucgauauugagggccggccugaagaccccguugagaucgcucucuaccagccgauguccgggugcuauauccacuucuuuagagaaccuaccgaccugaaacaguucaagcaagaugccaaguacagccauggaauugacguggccgaucuguuucccgcucagccuggccucacauccgcggucaucgaggcccugccccgcaauauggugcuuaccugucaggggucugacgauauuaaacggcugcucgacagccagggaagacgcgauaucaagcugauugacaucgcucuguccaaagccgauucucggagauucgaaaacgccgucugggaccaaugcaaggaucuuugucacaugcauacgggcgugguuguggagaaaaagaagcgcgggggcaaagaggaaaucacaccccacugcgcucucauggacuguauuauguaugaugccgcggucagcggaggccugaauaucccugugcugcgggcuguucucccgagagacaugguguuucgcaccuccagccccaaggucgugcuguga

SEQ ID NO: 2540 - RNA, 1710 nt, Artificial Sequence
  derived and/or modified CDS sequence (opt5) from Lassa virus__AIT17459__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugggcggggcucagggaacccagccuggcagagauggcguugugcgggucugggacgugaaaaacccggaucuucugaauaaccaauucgggacaaugcccagccucacccuggccugucuuacgaagcagggacagguggaccugaaugaugcuguccucgcccugaccgaccugggccucaucuacacagcgaaguauccuaacucuuccgaccuggaucgccuuagccaaucccaucccauucugaauaugguugacaccaaaaagucuagccucaacaucuccggguacaauuuuagccugggagccgcugugaaagccggcgcuugcaugcuugaugggggaaacaugcuggagacaaucaaggugaccccucagacgauggacggcauucucaaaucuauccugaaggucaaaagaucccugggcauguucgugagcgauacacccggggaacggaauccuuaugagaacauucucuacaagaucugucugucuggagacggcuggccguauauugccagccgcaccuccaucguugggagagcgugggaaaacacaaccguggaucuugagucugacggaaagccccagaaaaugggcaccgccgggagcaauaagucccugcagagcgcuggauuuccuacaggccucacguacucucaacugaugacccugaaagauuccaugaugcagcuugaccccagcgccaagacauggauugauaucgagggccggccugaagaccccgucgagaucgcucucuaccagccggugucugggugcuauauucacuucuuuagagaaccuaccgaccugaaacaguucaagcaagaugccaaguacucccauggaaucgacguugccgaucuguuucccgcucagccuggccucacaagcgcggugauugaggcccugccccgcaacaugguccuuaccugucagggguccgacgauaucaaacggcugcucgacucucagggaagacgcgauauuaagcugaucgacaucgcucugagcaaagccgauucccggagauucgaaaaugccgugugggaccaaugcaaggaucuuugucacaugcauacgggcgucgugguugagaaaaagaagcgcgggggcaaagaggaaauuacaccccacugcgcucucauggacuguaucauguaugaugccgcggugucuggaggccugaacauuccuguccugcgggcugugcucccgagagacaugguuuuucgcaccagcucccccaaggugguccuguga

SEQ ID NO: 2541 - RNA, 1710 nt, Artificial Sequence
  derived and/or modified CDS sequence (opt5) from Lassa virus__AIT17463__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcauaaacgggacgauagcgaccugaagcgccucagagaucugaaucaggcggucaacaaucugguggaacucaaguccacacaacagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcagcuggagcaacggcgcgcccuccugaauaugauuggaauggugggcggggcucagagcacccagccuggaagagauggcguugugcgggucugggacgugaaaaacccggaucuucugaauaaccaguucggcacaaugcccucucucacccuggccugucuuacgaagcaaggacagguggaccugaaugaugcuguccucgcccugaccgaccugggacucaucuacacagcgaaguauccuaacuccagcgaccuggaucgccuuucccagucucaccccauucugaccaugguugacaccaaaaagagcucccucaauaucagcggcuuuaacuucucucugggggccgcugugaaagccggagcuugcaugcuugauggcgggaauaugcuggagaccaucaaggugacgccucaaacaauggacgggauucucaaauccauccugaaggucaaaaagagccugggcauguuugugucugauacccccggcgaaagaaacccuuacgagaauauucucuauaagaucugucugagcggggacggauggccguacauugccucccggacaucuaucguuggccgcgcgugggaaaacaccauuguggaucuugagaccgacgggaaaccccagaaggucggaacagccggcagcuccagaagccugcagucugcuggguucccuacgggacucaccuauucccagcugaugacacugaaagauagcaugaugcaacuugaccccucugccaagaccuggaucgauaucgagggccggccugaagaccccguggagauugcucucuaccagccgauguccggcugcuacauccacuuuuucagagaaccuacagaccugaaacaguuuaagcaggaugccaaguauagccaugggauugacguugccgaucuguuccccgcucaaccuggacucaccuccgcggugaucgaggcccugccccgcaacaugguccuuacgugucagggcucugacgauauuaaaaagcugcucgacagccaggggcggagagauaucaaacugaucgacauugcucuguccaaggccgauucucgccgguuugaaaaugccgugugggaccagugcaaagaucuuugucauaugcacacaggagucgugguugagaagaagaaaagaggcgggaaggaggaaaucacaccccacugcgcucucauggacuguauuauguacgaugccgcggugagcggcggacugaacaucccuguccugcgcgcugugcucccgcgggacaugguuuucagaaccuccagccccaaagugguccuguga

SEQ ID NO: 2542 - RNA, 1710 nt, Artificial Sequence
  derived and/or modified CDS sequence (opt5) from Lassa virus__AIT17467__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugggcgggacccagggaacacagccuggcagagauggcguugugcgggucugggacgugaaaaacccggaucuucugaauaaccaauucgggaccaugcccagccucacgcuggcuugucuuaccaagcagggacagguggaccugaaugaugccguccucgcucugacagaccugggccucaucuacaccgccaaguauccuaacucuuccgaccuggaucgccuuagccaaucccaucccauucugaauaugguugacaccaaaaagucuagccucaacaucuccggguacaauuuuagccugggagcggccgugaaagcuggcgccugcaugcuugaugggggaaacaugcuggagaccaucaaggugacgccucagacaauggacggcauucucaaaucuauccugaaggucaaaaagucccugggcauguucgugagcgauacccccggggaaagaaauccuuaugagaacauucucuacaagaucugucugucuggagacggcuggccguauauugcuagccggacauccaucguugggcgcgccugggaaaacaccaccguggaucuugagucugacggaaaaccccagaaggucggcacagcggggagcaauaaaucccugcagagcgccggauuuccuacgggccucaccuacucucaacugaugacacugaaggauuccaugaugcagcuugaccccagcgcuaaaaccuggauugauaucgagggcagaccugaagaccccguggagaucgcccucuaccagccgaugucugggugcuauauucacuucuuucgggaaccuacagaccugaagcaguucaagcaagaugcuaaauacucccauggaaucgacguugccgaucuguuucccgcccagccuggccucaccagcgcugugauugaggcgcugcccagaaacaugguccuuacgugucagggguccgacgauaucaagcgccugcucgacucucagggacggagagauauuaaacugaucgacaucagccuguccaaggccgauucucgccgguucgaaaaugcugugugggaccaaugcaaagaucuuugucacaugcauacaggcgucgugguugagaagaagaaaagagggggcaaggaggaaauuacaccccacugcgcccucauggacuguaucauguaugaugccgcugugagcggaggccugaacauuccuguccugcgcgccgugcucccgcgggacaugguuuuuagaaccuccagccccaaagugguccuguga

SEQ ID NO: 2543 - RNA, 1710 nt, Artificial Sequence
  derived and/or modified CDS sequence (opt5) from Lassa virus__AIT17471__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacccagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugggcggggcucagggaacccagccuggcagagauggcguugugcgggucugggacgugaaaaacccggaucuucugaauaaccaauucgggacaaugcccagccucacccuggccugucuuacgaagcagggacagguggaccugaaugaugcuguccucgcccugaccgaccugggccucaucuacacagcgaaguauccuaacucuuccgaccuggaucgccuuagccaaucccaucccauucugaauaugguugacaccaaaaagucuagccucaacaucuccggguacaauuuuagccugggagccgcugugaaagccggcgcuugcaugcuugaugggggaaacaugcuggagacaaucaaggugaccccucagacgauggacggcauucucaaaucuauccugaaggucaaaagaucccugggcauguucgugagcgauacacccggggaacggaauccuuaugagaacauucucuacaagaucugucugucuggagacggcuggccguauauugccagccgcaccuccaucguugggagagcgugggaaaacacaaccguggaucuugagucugacggaaagccccagaaaaugggcaccacagggagcaauaagucccugcagagcgccggauuuccuacgggccucaccuacucucaacugaugacacugaaagauuccaugaugcagcuugaccccagcgcuaagaccuggauugauaucgagggccggccugaagaccccgucgagaucgcccucuaccagccgaugucugggugcuauauucacuucuuuagagaaccuacagaccugaaacaguucaagcaagaugcuaaguacucccauggaaucgacguggccgaucuguuucccgcccagccuggccucaccagcgcuguuauugaggcgcugccccgcaacauggugcuuacgugucagggguccgacgauaucaaaaagcugcucgacucucagggacggagagauauuaaacugaucgacaucgcccugagcaaggcugauucccgcaaauucgaaaaugucgugugggaccaaugcaaggaucuuugucacaugcauacaggcgucgugguugagaagaaaaagagagggggcaaagaggaaauuacaccccacugcgcccucauggacuguaucauguaugaugccgcugugucuggaggccugaacauuccuguccugcgggccgugcucccgcgcgacaugguuuuucggaccagcucccccaaggugguccuguga

SEQ ID NO: 2544 - RNA, 1710 nt, Artificial Sequence
  derived and/or modified CDS sequence (opt5) from Lassa virus__AIT17475__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacccagcagaaaagcguucugcgggugggaacgcuuaccucugacgaucugcucacacuggcugccgaccuugagaagcugaaauccaaggucauucgcaccgaaagaccccucagcucuggcguguauauggggaaccuguccgcccagcaacuggagcagcggcgcgcucuccugagcaugaucggaaugguuggcggggcccagggaacacagccuggcagagauggcgugguccgggugugggacgugaaaaauccggaucuucugaacaaucaauucgggaccaugcccucucucacacuggcuugucuuaccaagcagggacaggucgaccugaacgauacgguucucgcccugaccgaccugggccucauuuacacagcgaaguauccuaauuccagcgaccuggaucgccuuucccaaucucaucccauccugaacaugguggacaccaaaaagagcucccucaauauuagcggguacaacuuuucucugggagccgcugugaaagccggcgcuugcaugcuugaugggggaaauaugcuggagacaaucaaggucaccccucagacgauggacggcauccucaaauccauucugaaggugaaaagaagccugggcauguucguuucugauacacccggggaacggaacccuuaugagaauauccucuacaagauuugucugagcggagacggcuggccguauaucgccucccgcaccucuauuguggggagagcgugggaaaacacaaccgucgaucuugagagcgacggaaagccccagaaagugggcaccgccggguccaacaagagccugcagucugcuggauuuccuacaggccucacguacucccaacugaugacccugaaagauagcaugaugcagcuugaccccucugccaagacauggaucgauauugagggccggccugaagaccccguugagaucgcucucuaccagccgaucuccgggugcuauauucacuucuuuagagaaccuaccgaccugaaacaguucaagcaagaugccaaguacagccauggaaucgacgugacagaucuguuucccgcccagccuggccucaccuccgcugucauugaggcgcugccccgcaauauggugcuuacgugucaggggucugacgauaucaaacggcugcucgacagccagggaagacgcgauauuaagaucaucgacauugcccuguccaaagcugauucucggagauucgaaaacgccgucugggaccaaugcaaggaucugugucacaugcauacaggcgugguuguggagaaaaagaagcgcgggggcaaagaggaaaucacaccccacugcgcccuuauggacuguauuauguaugaugcugccgucagcggaggccucaauaucccugugcugcgggcgguucugccgagagacaugguguuucgcaccuccagccccaaggucgugcucuga

SEQ ID NO: 2545 - RNA, 1710 nt, Artificial Sequence
  derived and/or modified CDS sequence (opt5) from Lassa virus__AIT17479__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccguucugcgggugggaacgcuuaccagcgacgaucugcucacacuggcugccgaccuugagaagcugaaaucuaaggucauucgcaccgaaagaccccucuccagcggcguguauauggggaaucugucuacacagcaacuggagcagcggcgcgcccuccugaacaugaucggaaugguuggcggggcucagggaacccagccuggcagagauggcgugguccgggugugggacgugaaaaauccggaucuucugaacaaucaauucgggacaaugcccucccucacccuggccugucuuacgaagcagggacaggucgaccugaacgaugcuguucucgcccugaccgaccugggccucauuuacacagcgaaguauccuaauagcucugaccuggaucgccuuucccaaagccaucccauccugaacaugguggacaccaaaaaguccucucucaauauuagcggguacaacuuuucccugggagccgcugugaaagccggcgcuugcaugcuugaugggggaaauaugcuggagacaaucaaggucaccccucagacgauggacggcauccucaaaagcauucugaaggugaaaagaucucugggcauguucguuuccgauacacccggggaacggaacccuuaugagaacauccucuacaagauuugucugagcggagacggcuggccguauaucgccucucgcaccagcauuguggggagagcgugggaaaauacaaccgucgaucuugaguccgacggaaagccccagaaagugggcaccgccgggucuaacaagagccugcaguccgcuggauuuccuacaggccucacguacagccaacugaugacccugaaagauucuaugaugcagcuugaccccuccgccaagacauggaucgauauugagggccggccugaagaccccguugagaucgcucucuaccagccgaugagcgggugcuauauccacuucuuuagagaaccuaccgaccugaaacaguucaagcaagaugccaaguacucucauggaauugacguggccgaucuguuucccgcucagccuggccucacauccgcggucaucgaggcccugccccgcaauauggugcuuaccugucaggggagcgacgauauuaaaaagcugcucgacucccagggacggaaagauaucaagcugauugacaucgcucugucuaaagucgauagcagacgcuucgaaaacgccgugugggaccaaugcaaggaucuuugucacaugcauacgggcguuguggucgagaagaaaaagagagggggcaaagaggaaaucacaccccacugcgcccucauggacuguauuauguaugaugcugccguguccggaggccugaauaucccuguucugcgggcggugcucccgcgcgacauggucuuucggaccucuagccccaagguggugcuguga

SEQ ID NO: 2546 - RNA, 1710 nt, Artificial Sequence
  derived and/or modified CDS sequence (opt5) from Lassa virus__AIT17491__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauggagaccugaagcgccucagagaucugaaccaagcggucaauaaccugguggaacucaagucuacacagcagaaaagcguucugcgggugggcacgcuuaccuccgacgaucugcucacacuggcugccgaccuugagaagcugaaaagcaaggucauucgcaccgaaagaccccucucuuccgggguguauaugggaaaucugagcacacagcaacuggagcagcggcgcgcccuccugucuaugaucggcaugguugggggagcuagaggcacccagccuggccgggauggggugguccgcgugugggacgugaaaaacccggaucuucugaauaaccaguucggaacaaugcccucccucacccuggccugucuuacgaagcaaggccaggucgaccugaaugauguugugcucgcucugaccgaccuggggcucauuuacacagccaaguauccuaacagcucugaccuggauagacuuucccagagccaucccauccugaauaugguggacaccaaaaaguccucucucaacauuagcggauacaauuuuucccugggcgcggccgucaaagcuggggccugcaugcuugauggaggcaacaugcuggagacaaucaaggugaccccucaaacgauggacggcauccucaaaagcauucugaagguuaaaaagucucuggggauguucguguccgauacacccggagaacggaauccuuaugagaacauccucuacaagauuugucugagcggcgacggguggccguauaucgcuucucgcaccagcauugucggcagagccugggaaaacacaaccguggaucuugaguccgacggaaaaccccagaagguuggggcggccggaucuaauaaaagccugcaguccgcuggcuuuccuaccggccucacauacagccagcugaugacgcugaaggauucuaugaugcaacuugaccccuccgccaaaaccuggaucgauauugaggggcggccugaagaccccguggagaucgcucucuaccagccgaugagcggaugcuauauccacuucuuuagagaaccuacagaccugaagcaguucaagcaggaugccaaauacucucauggcauugacgucaccgaucuguuuuccgcccaacccgggcucacaagcgcugugaucgaggcgcugccucgcaacaugguccuuaccugucagggauccgacgauauuaagcggcugcucgacucucagggcagacgcgauaucaaacugauugacaucgcccugagcaaggcugauucccggagauucgaaaaugccgugugggaccagugcaaagaucuuugucacaugcauacggggguuguggucgagaagaagaaacgcggcggaaaggaggaaaucacaccccacugcgcccucauggacuguauuauguaugaugcugccgugucuggcgggcugaacauccccguucugcgggcggugcucccuagagacauggucuuucgcaccagcuccccgaaaguggugcuguga

SEQ ID NO: 2547 - RNA, 1710 nt, Artificial Sequence
  derived and/or modified CDS sequence (opt5) from Lassa virus__AIT17495__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaacaugauuggaauggugggcggggcucaguccgcccagccuggaagagauggcguugugcgggucugggacgugaaaaauccggaucuucugaacaaucaauucggcaccaugcccagccucacacuggcuugucuuaccaagcagggacagguggaccugaacgaugccguccucgcgcugacggaccugggacucaucuacaccgccaaguauccuaauucuuccgaccuggaucgccuuagccaaucccaucccauucugaacaugguugacaccaaaaagucuagccucaauaucuccggcuuuaacuucagccugggggcugccgugaaagcuggagccugcaugcuugauggcgggaauaugcuggagaccaucaaggugacaccucagaccauggacgggauucucaaaucuauccugaaggucaaaagaucccugggcauguuugugagcgaugcgcccggcgaacggaacccuuacgagaacauucucuauaagaucugucugucuggggacggauggccguacauugccagccgcacguccaucguuggcagagcuugggaaaauacaaccguggaucuugagucugacgggaagccccagaaagucggaacagccggcagcaacaagucccugcagagcgcuggguucccuaccggacucaccuauucucaacugaugacacugaaagauuccaugaugcagcuugaccccagcgccaagacguggauugauaucgagggccggccugaagaccccguggagaucgcccucuaccagccgaugucuggcugcuacauucacuuuuucagagaaccuaccgaccugaaacaguuuaagcaagaugcuaaguauucccaugggaucgacguugcggaucuguuccccgcccagccuggacucacaagcgcugugauugaggcccugccccgcaauaugguccuuaccugucagggcuccgacgauaucaaaaagcugcucgacucucaggggcggagagauauuaaacugaucgacaucgcccugagcaaggcugauucccgccgguuugaaaacgccgugugggaccaaugcaaagaucuuugucacaugcauacaggagucgugguugagaagaagaaaagaggcgggaaggaggaaauuacaccccacugcgcgcucauggacuguaucauguacgaugcugccgugucuggcggacugaauauuccuguccugcgcgccgugcucccgcgggacaugguuuucagaacgagcucccccaaagugguccuguga

SEQ ID NO: 2548 - RNA, 1710 nt, Artificial Sequence
  derived and/or modified CDS sequence (opt5) from Lassa virus__AIT17499__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauauuaucggaauggugggcggggcucagggaacccagccuggcagagauggcguugugcgggucugggacgugaaaaacccggaucuucugaauaaccaauucgggacaaugcccagccucacccuggccugucuuacgaagcagggacagguggaccugaaugaugcuguccucgcccugaccgaccugggccucauuuacacagcgaaguauccuaacucuuccgaccuggaucgccuuagccaaucccaucccauccugaauaugguugacaccaaaaagucuagccucaacaucuccggguacaauuuuagccugggagccgcugugaaagccggcgcuugcaugcuugaugggggaaacaugcuggagacaauuaaggugaccccucagacgauggacggcauccucaaaucuauucugaaggucaaaagaucccugggcauguucgugagcgauacacccggggaacggaauccuuaugagaacauccucuacaagauuugucugucuggagacggcuggccguauaucgccagccgcaccuccauuguugggagagcgugggaaaacacaaccguggaucuugagucugacggaaagccccagaaagucggcgccgcugggagcaauaagucccugcagagcgccggauuuccuaccggccucacauacucucaacugaugacgcugaaagauuccaugaugcagcuugaccccagcgcuaagaccuggaucgauaucgagggccggccugaagaccccguggagauugcccucuaccagccgaugucugggugcuauauccacuucuuuagagaaccuacagaccugaaacaguucaagcaagaugccaaguacucccauggaauugacguugcugaucuguuucccgcgcagccuggccucaccagcgccgugaucgaggcucugccccgcaacaugguccuuacaugucagggguccgacgaugugaaacggcugcucgacucucagggaagacgcgauauuaagcugaucgacaucgcccugagcaaagccgauucccggagauucgaaaaugcugucugggaccaaugcaaggaucuuugucacaugcauaccggcgugguuguggagaaaaagaagcgcgggggcaaagaggaaauuacgccccacugcgcccucauggacuguaucauguaugaugcggcugucucuggaggccugaacauuccugugcugcgggccguucucccgagagacaugguguuucgcacaagcucccccaaggucgugcuguga

SEQ ID NO: 2549 - RNA, 1710 nt, Artificial Sequence
  derived and/or modified CDS sequence (opt5) from Lassa virus__AIT17503__NP
augagcuccucuaaggaggugaaauccuuccuguggacccagagccucagacgggaacugucuggcuacugcagcuccaucaaacuucaagucguuaaggacgcccaggcucugcuccacgggcuggauuuuucugaggugagcaacgugcagcgccuuaugagaaagcagaaacgggacgauuccgaccugaagcgccucagagaucugaaucaagccgucaacaaucugguggaacucaagagcacacagcagaaaucuauucugcggguuggaacgcuuaccuccgacgaucugcucacacuggcggcugaccuugagaagcugaaaagcaaggugauccgcaccgaaagaccccucucuuccggcgucuauauggggaaccugagcgcccagcaacuggagcagcggcgcgcccuccugaauaugauuggaauggugggcggggcucagggaacacagccuggcagagauggcguugugcgggucugggacgugaaaaacccggaucuucugaauaaccaauucgggaccaugcccucucucacacuggccugucuuaccaagcagggacagguggaccugaaugaugcuguccucgcccugacggaccugggccucaucuacaccgcgaaguauccuaacuccagcgaccuggaucgccuuucccaaucucaucccauucugaauaugguugacaccaaaaagagcucccucaacaucagcggguacaauuuuucucugggagccgcugugaaagccggcgcuugcaugcuugaugggggaaacaugcuggagacaaucaaggugacaccucagaccauggacggcauucucaaauccauccugaaggucaaaaagagccugggcauguucgugucugauacgcccggggaaagaaauccuuaugagaacauucucuacaagaucugucugagcggagacggcuggccguauauugccucccggacaucuaucguugggcgcgcgugggaaaacaccacaguggaucuugagagcgacggaaaaccccagaaggucggcaccgccggguccaauaaaagccugcagucugcuggauuuccuaccggccucacauacucccaacugaugacgcugaaggauagcaugaugcagcuugaccccucugccaaaaccuggauugauaucgagggcagaccugaagaccccguggagaucgcucucuaccagccgauguccgggugcuauauucacuucuuucgggaaccuacagaccugaagcaguucaagcaagaugccaaauacagccauggaaucgacguugccgaucuguuucccgcucagccuggccucaccuccgcggugauugaggcccugcccagaaacaugguccuuacaugucaggggucugacgauaucaagcgccugcucgacagccagggacggagagauauuaaacugaucgacaucgcucuguccaaggccgauucucgccgguucgaaaaugccgugugggaccaaugcaaagaucuuugucacaugcauaccggcgucgugguugagaagaagaaaagagggggcaaggaggaaauuacgccccacugcgcucucauggacuguaucauguaugaugccgcggugagcggaggccugaacauuccuguccugcgcgcugugcucccgcgggacaugguuuuuagaacauccagccccaaagugguccuguga

SEQ ID NO: 2550 - RNA, 1710 nt, Artificial Sequence
  derived and/or modified CDS sequence (opt5) from Lassa virus__AIT17507__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaaccuuauuggaauggugggcggggcucagggaacccagccuggcagagauggcguugugcgggucugggacgugaaaaauccggaucugcucaacaaucaauucgggacaaugcccucccugacccuugccugucugacgaagcagggacagguggaccucaacgaugcuguccuggcccugaccgaccucggccugaucuacacagcgaaguauccuaauagcucugaccuugaucgccugucccaaagccaucccauucucaacaugguugacaccaaaaaguccucucugaauaucagcggguuuaacuucucccuuggagccgcugugaaagccggcgcuugcaugcuggaugggggaaauaugcucgagacaaucaaggugaccccucagacgauugacggcauccugaaaagcauucugaaggucaaaaagucucucggcauguuuguguccgauacacccggggaaagaaacccuuacgagaacauccuguauaagauuugucuuagcggagacggcuggccguacaucgccucucggaccagcauuguugggcgcgcgugggaaaauacaaccguggaucuggaguccgacggaaaaccccacaaggucggcaccgccgggucuaacaaaagccuccaguccgcuggauucccuacaggccugacguauagccagcugaugacccuuaaggauucuaugaugcaacucgaccccuccgccaaaacauggaucgauaucgagggcagaccugaagaccccguggagauugcucuguaccagccgaugagcgggugcuacauccacuuuuuccgggaaccuaccgaccugaagcaguuuaagcaggaugccaaauauucucauggaauugacguugccgaucucuuccccgcucaaccuggccugacauccgcggugaucgaggcccuucccagaaauaugguccugaccugucaggggagcgacgauauuaagcgccuccuggacucccagggacggagagauaucaaacugaucgacauugcucuuucuaagguggauagccgccgguuugaaaacgccgucugggaccagugcaaagaucucugucauaugcacacgggcgugguuguggagaagaagaaaagagggggcaaggaggaaaucacaccccacugcgcccugauggacuguauuauguacgaugcugccgucuccggaggccugaauaucccugugcuccgcgcgguucugccgcgggacaugguguucagaaccucuagccccaaagucgugcuuuga

SEQ ID NO: 2551 - RNA, 1710 nt, Artificial Sequence
  derived and/or modified CDS sequence (opt5) from Lassa virus__AIT17511__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauggagaccugaagcgccucagagaucugaaccaagcggucaauaaccugguggaacucaagucuacccagcagaaaagcauucugcggguuggcacgcuuaccuccgacgaucugcucacacuggcugccgaccuugagaagcugaaaagcaaggugauccgcaccgaaagaccccucucuuccggggucuauaugggaaaucugagcacacagcaacuggagcagcggcgcgcccuccugaacaugauuggcaugguugggggagcucagggcacccagccuggcagagaugggguggugcgggucugggacgugaaaaauccggaucuucugaacaaucaauucggaacaaugcccucucucacccuggccugucuuacgaagcagggccagguggaccugaacgaugcuguccucgcccugaccgaccuggggcucaucuacacagcgaaguauccuaauuccagcgaccuggaucgccuuucucaaucccaucccauucugaacaugguugacaccaaaaagagcucccucaauaucucuggauacaacuuuagccugggcgccgcugugaaagccggggcuugcaugcuugauggaggcaauaugcuggagacaaucaaggugaccccucagacgauugacggcauccucaaauccauucugaaggucaaaaagagccuggggauguucgugucugauacacccggagaaagaaacccuuaugagaacauccucuacaagauuugucuguccggcgacggguggccguauaucgccagccggaccucuauuguuggacgcgcgugggaaaauacaaccguggaucuugagagcgacggcaaaccccagaaggucgggaccgccggauccaacaaaucucugcagagcgcuggcuuuccuacaggccucacguacucccaacugaugacccugaaggauagcaugaugcagcuugaccccucugccaaaacauggaucgauaucgaggggagaccugaagaccccguggagauugcucucuaccagccgauguccggaugcuauauccacuucuuucgggaaccuaccgaccugaagcaguucaagcaagaugccaaauacagccauggcauugacguuacagaucuguuuucugcccagcccgggcucaccuccgcugugaucgaggcgcugccuagaaauaugguccuuacgugucagggaagcgacgauauuaagcgccugcucgacucccagggccggagagauaucaaacugaucgacauugcccugucuaaggcugauagccgccgguucgaaaacgccgugugggaccaaugcaaagaucuuugucacaugcauacaggggucgugguugagaagaagaaaagaggcggaaaggaggaaaucacaccccacugcgcccucauggacuguauuauguaugaugcugccguguccggcgggcugaauauccccguccugcgcgcggugcucccucgggacaugguuuuuagaaccucuagcccgaaagugguccuguga

SEQ ID NO: 2552 - RNA, 1710 nt, Artificial Sequence
  derived and/or modified CDS sequence (opt5) from Lassa virus__AIT17515__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugggcggggcucagggaacccagccuggcagagauggcguugugcgggucugggacgugaaaaacccggaucuucugaauaaccaauucgggacaaugcccagccucacccuggccugucuuacgaagcagggacagguggaccugaaugaugcuguccucgcccugaccgaccugggccucaucuacacagcgaaguauccuaacucuuccgaccuggaucgccuuagccaaucccaucccauucugaauaugguugacaccaaaaagucuagccucaacaucuccggguacaauuuuagccugggagccgcugugaaagccggcgcuugcaugcuugaugggggaaacaugcuggagacaaucaaggugaccccucagacgauggacggcauucucaaaucuauccugaaggucaaaagaucccugggcauguucgugagcgauacacccggggaacggaauccuuaugagaacauucucuacaagaucugucugucuggagacggcuggccguauauugccagccgcaccuccaucguugggagagcgugggaaaacacaaccguggaucuugagucugacggaaagccccagaaagucggcgccgcugggagcuccaagagccugcagucugccggauuuccuaccggccucacauacucccaacugaugacgcugaaagauagcaugaugcagcuugaccccucugcuaagaccuggauugauaucgagggccggccugaagaccccguggagaucgcccucuaccagccgguuuccgggugcuauauucacuucuuuagagaaccuacagaccugaaacaguucaagcaagaugccaaguacagccauggaaucgacguggcugaucuguuucccgcgcagccuggccucaccuccgccgucauugaggcucugccccgcaauauggugcuuacaugucaggggucugacgauaucaaacggcugcucgacagccagggaagacgcgauauuaagcugaucgacaucgcccuguccaaagccgauucucggagauucgaaaacgcugucugggaccaaugcaaggaucuuugucacaugcauaccggcgugguuguggagaaaaagaagcgcgggggcaaagaggaaauuacgccccacugcgcccucauggacuguaucauguaugaugcggcugucagcggaggccugaauauuccugugcugcgggccguucucccgagagacaugguguuucgcacauccagccccaaggucgugcuguga

SEQ ID NO: 2553 - RNA, 1710 nt, Artificial Sequence
  derived and/or modified CDS sequence (opt5) from Lassa virus__AIT17519__NP
augagcgccuccaaggaggugaaaucuuuccuguggacccagagccucagacgggaacuguccggcuacugcucuaacaucaaacuucaagucguuaaagacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucugcccagcaacuggagcagcggcgcgcucuccugaacaugauuggaauggugggcggggcccagggaacacagccuggcagagauggcguugugcgggucugggacgugaaaaauccggaucuucugaacaaucaauucgggaccaugcccucccucacacuggcuugucuuaccaagcagggacagguggaccugaacgaugccguccucgcgcugacggaccugggccucaucuacaccgccaaguauccuaauagcucugaccuggaucgccuuucccaaagccaucccauucugaacaugguugacacaaagaaguccucucucaauaucagcggguuuaacuucucccugggagcugccgugaaagcuggcgccugcaugcuugaugggggaaauaugcuggagaccaucaaggugacaccucagaccauggacggcauucucaaaagcauccugaaggucaaaagaucucugggcauguuuguguccgauacgcccggggaacggaacccuuacgagaacauucucuauaagaucugucugagcggagacggcuggccguacauugcgucucgcacaagcaucguugggagagccugggaaaauaccacaguggaucuugaguccgacggaaagccccagaaagucggcaccgcugggucuaacaagagccugcaguccgccggauucccuaccggccucacauauagccaacugaugacgcugaaagauucuaugaugcagcuugaccccuccgcuaagaccuggauugauaucgagggccggccugaagaccccguggagaucgcccucuaccagccgaugagcgggugcuacauucacuuuuucagagaaccuacagaccugaaacaguuuaagcaagaugccaaguauucucauggaaucgacguugcugaucuguuccccgcgcagccuggccucaccuccgccgugauugaggcucugccccgcaauaugguccuuacaugucaggggagcgacgauaucaaacggcugcucgacucccagggaagacgcgauauuaagcugaucgacaucgcccugucuaaagccgauagccggagauuugaaaacgcugugugggaccaaugcaaggaucuuugucacaugcauaccggcgucgugguugagaaaaagaagcgcgggggcaaagaggaaauuacgccccacugcgcccucauggacuguaucauguacgaugcggcuguguccggaggccugaauauuccuguccugcgggccgugcucccgagagacaugguuuuccgcacaucuagccccaaggugguccuguga

SEQ ID NO: 2554 - RNA, 1710 nt, Artificial Sequence
  derived and/or modified CDS sequence (opt5) from Lassa virus__AIT17525__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagcggcgcgacgauagcgaccugaaaagacuccgggaucugaaucaagcggucaacaaucugguggaacucaaguccacccagcaaaagagcauucugcgcguuggaacgcuuaccucugacgaucugcucacacuggcugccgaccuugagaaacugaaguccaaagugaucagaaccgaacggccccucagcucuggcgucuauauggggaaccuguccacacagcagcuggagcagcgcagagcccuccugaauaugauuggaauggugggcggggcucagggaacccagccuggccgggauggcguugugcgcgucugggacgugaagaacccggaucuucugaauaaccaauucgggacaaugcccagccucacccuggccugucuuacgaaacagggacagguggaccugaaugaugcuguccucgcccugaccgaccugggccucaucuacacagcgaaguauccuaacucuuccgaccuggauagacuuagccaaucccaucccauucugaauaugguugacaccaagaaaucuagccucaacaucuccggguacaauuuuagccugggagccgcugugaaggccggcgcuugcaugcuugaugggggaaacaugcuggagacaaucaaagugaccccucagacggucgacggcauucucaagucuauccugaaagugaagcggucccugggcauguucguuagcgauacacccggggaacgcaauccuuaugagaacauucucuacaaaaucugucugucuggagacggcuggccguauauugccagcagaaccuccaucguggggcgggcgugggaaaacacaaccgucgaucuugagucugacggaaagccccagaaggugggcaccgccgggagcaauaaaucccugcagagcgcuggauuuccuacaggccucacguacucucaacugaugacccugaaggauuccaugaugcagcuugaccccagcgccaaaacauggauugauaucgagggcagaccugaagaccccguugagaucgcucucuaccagccgaugucugggugcuauauucacuucuuucgcgaaccuaccgaccugaagcaguucaaacaagaugccaaguacucccauggaaucgacguggccgaucuguuucccacacagccuggccucaccagcgcugucauugaggcgcugccccggaacauggugcuuacgugucagggguccgacgauaucaagagacugcucgacucucagggacgccgggauauuaaacugaucgacaucgcccugagcaaggcugauuccagaaaauucgaaaaugccgucugggaccaaugcaaggaucuuugucacaugcauacaggcgugguuguggagaaaaagaagcgcgggggcaaagaggaaauuacaccccacugcgcccucauggacuguaucauguaugaugcugccgucucuggaggccugaacauuccugugcugcgggcgguucucccgagagacaugguguuucgcaccagcucccccaaggucgugcuguga

SEQ ID NO: 2555 - RNA, 1710 nt, Artificial Sequence
  derived and/or modified CDS sequence (opt5) from Lassa virus__AIT17533__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgaggugaauaacgugcagcgccuuaugagaaagcagaaacgggacgauuccgaccugaagcgccucagagaucugaaucaagcggucaacaaucugguggaacucaagucuacacagcagaaaagcauucugcggguuggaacgcuuaccuccgacgaucugcucacacuggcugccgaccuugagaagcugaaaagcaaggugauccgcaccgaaagaccccucucuuccggcgucuauauggggaaccugagcacacagcaacuggagcagcggcgcgcccuccugaauaugauuggaauggcuggcgggacccagggaacacagccuggcagagauggcgugguucgggugugggacgucaaaaacccggaucuucugaauaaccaauucgggaccaugcccucucucacgcuggccugucuuaccaagcagggacagguggaccugaaugaugcugugcucgcccugacagaccugggccucaucuacaccgcgaaguauccuaacuccagcgaccuggaucgccuuucucaaucccaucccauucugaauauggucgacaccaaaaagagcucccucaacaucucuggguacaauuuuagccugggagccgcuguuaaagccggcgcuugcaugcuugaugggggaaacaugcuggagaccaucaaggugacgccucagacaauggacggcauucucaaauccauccugaaggugaaaagaagccugggcauguucgucucugauacccccggggaacggaacccuuaugagaauauucucuacaagaucugucuguccggagacggcuggccguauauugccagccgcacaucuaucguggggagagcgugggaaaacaccaccguugaucuugagagcgacggaaagccccagaaagugggcacagccggguccaauaagucucugcagagcgcuggauuuccuacgggccucaccuacucccaacugaugacacugaaagauagcaugaugcagcuugaccccucugccaagaccuggauugauaucgagggccggccugaagaccccgucgagaucgcucucuaccagccgauguccgggugcuauauucacuucuuuagagaaccuacagaccugaaacaguucaagcaagaugccaaguacagccauggaaucgacguggccgaucuguuucccgcucagccuggccucaccucugcgguuauugaggcccugccccgcaacauggugcuuacgugucagggguccgacgauaucaaaaagcugcucgacagccagggacggagagauauuaaacugaucgacaucucccugucuaagauugauagccgcaaauucgaaaaugcugucugggaccaaugcaaggaucuuugucacaugcauacaggcguggucguggagaagaaaaagagagggggcaaagaggaaaucacaccccacugcgcccucauggacuguauuauguuugaugccgcuguuuccggaggccugaacaucccugugcugcgggccguccucccgcgcgacaugguguuccggaccucuagccccaagguugugcuguga

SEQ ID NO: 2556 - RNA, 1710 nt, Artificial Sequence
  derived and/or modified CDS sequence (opt5) from Lassa virus__AIT17539__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauggagaccugaagcgccucagagaucugaaccaagcggucaauaaccugguggaacucaagucuacacagcagaaaagcguucugcgggugggcacgcuuaccuccgacgaucugcucauucuggcugccgaccuugagaagcugaaaagcaaggucauccgcacagaaagaccccucucuuccgggguguauaugggaaaucugagcacccagcaacuggagcagcggaaagcccuccugucuaugauuggcaugguugggggagcucagggcacacagccuggccgcgaugggguggucagagugugggacgugaagaacccggaucuucugaauaaccaauucggaaccaugcccucccucacacuggccugucuuaccaagcagggccaggucgaccugaaugaugcuguucucgcccugacggaccuggggcucaucuacaccgcgaaauauccuaacagcucugaccuggaucggcuuucccaaagccaucccauucugaauaugguggacacaaagaaauccucucucaacaucagcggauacaauuuuucccugggcgccgcugugaaggccggggcuugcaugcuugauggaggcaacaugcuggagaccaucaaagucacaccucagaccauggacggcauucucaagagcauccugaaagugaagcgcucucuggggauguucguuuccgauacgcccggagaaagaaauccuuaugagaacauucucuacaagaucugucugagcggcgacggguggccguauauugccucucggacaagcaucgugggacgcgcgugggaaaacaccacagucgaucuugaguccgacggcaaaccccagaagguggggucugccggaagcaauaaaucccugcagagcgcuggcuuuccuaccggccucaccuacucucaacugaugacacugaaggauuccaugaugcagcuugaccccagcgccaaaacguggauugauaucgaggggagaccugaagaccccguugagaucgcucucuaccagccgaugucuggaugcuauauucacuucuuucgggaaccuaccgaccugaagcaguucaagcaagaugccaaauacucccauggcaucgacgugacagaucuguuuagcgcccagcccgggcucaccuccgcugucauugaggcgcugccuagaaacauggugcuuacaugucagggaucugacgauaucaagaaacugcucgacagccagggccgccgggauauuaagcugaucgacaucucccuggggaaagccgauucuagacgcuucgaaaaugcugucugggaccaaugcaaggaucuuugucacaugcauaccggcgugguuguggagaagaaaaagcggggaggcaaagaggaaauuacgccccacugcgcccucauggacuguaucauguuugaugccgcugucagcgggggacugaacauucccauccugagagccgugcucccucgcgacaugguuuuccggacauccagcccgaaggugguccuguga

SEQ ID NO: 2557 - RNA, 1710 nt, Artificial Sequence
  derived and/or modified CDS sequence (opt5) from Lassa virus__AIT17541__NP
augagcgccuccaaggaggugaaaucuuuccuguggacccagagccucagacgggaacuguccggcuacugcucuaacaucaaacuucaagucguuaaagacgcucaggcccugcuccacgggcuggauuuuagcgagguguccaaugugcagcgccuuaugagaaagcagaaacgggacgauggagaccugaagcgccucagagaucugaaccaagcggucaauaaccugguggaacucaagucuacacagcagaaaagcguucugcgggugggcacgcuuuccagcgacgaucugcucacccuggcugccgaccuugagaagcugaaaucuaaggucauucgcacagaaagaccccucuccagcgggguguauaugggaaaucugucuucccagcaacuggaucagcggcgcgcccuccugaacaugaucggcaugaccagcgacagacagggggcuucuacaggacgggauggcauuguucgcgugugggacgucaaaaaugccgagcuucugaacaaucaguucggcaccgugccuucccucacacuggcuugucuuaccaagcaaggacagguggaucugaacgacgccguccaggcgcucacggaccuggggcugaucuacaccgccaaguauccgaauagcuccgaucucgacagacugucucaaagccaucccauucuuaacaugaucgauacaaagaaguccagccugaauaucucuggcuacaacuuuucccucggggcugccguuaaagcuggagccugcaugcuggacggcgggaauaugcuugagaccauuaaggugagcccucagacaauggauggaauccugaaaucuauucucaaggugaaacggagccugggcauguucgucuccgacauccccggcgaacgcaacccuuaugagaacauucuguacaagaucugucucucuggggauggauggcccuauauugcgagcagaaccuccaucacgggccgggccugggaaaauacaaucguggaccuggagagcgauucuaagccucagaaaccggggaacuccggaagcaauagaucucuucaguccgcuggcuuucccgccgggcugaccuacagccaacucaugacacugaaggacuccaugcugcagcuugauccuaacgcuaaaaccuggauggacauugagggacgccccgacgauccuguugaaaucgcccucuaccagcccucuagcggcugcuauauucacuucuuucgggagccgaccgaccugaagcaguucaaacaagaugccaaguacucccauggcaucgacgugggggaucuguuugcugcgcagccuggacucacaucugccgucauugaagcucugcccagaaauauggugaucacgugucagggcagcgaggacaucaagaaacuucuggaaucccaggggcgcaaggauauuaaacucguugacaucagcaugucuaagccugauucccggaaauucgagaacgccgugugggaccaauauaaggaucugugccacaugcauaccggaauugucguggagaagaaaaagagaggcgggaaagaagagaucacaccccacugugcccugauggacugcauuauguuugaugcugccgucgugggcggacuugacgcgcgcauccuccgggcuguucugcccagagacaugguguuccgcaccagcacaccuaaggucgugcuguga

SEQ ID NO: 2558 - RNA, 1710 nt, Artificial Sequence
  derived and/or modified CDS sequence (opt5) from Lassa virus__AIT17545__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccguucugcgggugggaacgcuuaccagcgacgaucugcucacacuggcugccgaccuugagaagcugaaaucuaaggucauucgcaccgaaagaccccucuccagcggcguguauauggggaaucugucuacacagcaacuggagcagcggcgcgcccuccugaacaugaucggaaugguuggcggggcucagggaacccagccuggcagagauggcgugguccgggugugggacgugaaaaauccggaucuucugaacaaucaauucgggacaaugcccucccucacccuggccugucuuacgaagcagggacaggucgaccugaacgaugcuguucucgcccugaccgaccugggccucauuuacacagcgaaguauccuaauagcucugaccuggaucgccuuucccaaagccaucccauccugaacaugguggacaccaaaaaguccucucucaauauuagcggguacaacuuuucccugggagccgcugugaaagccggcgcuugcaugcuugaugggggaaauaugcuggagacaaucaaggucaccccucagacgauggacggcauccucaaaagcauucugaaggugaaaaagucucugggcauguucguuuccgauacacccggggaaagaaacccuuaugagaacauccucuacaagauuugucugagcggagacggcuggccguauaucgccucucggaccagcauuguggggcgcgcgugggaaaauacaaccgucgaucuugaguccgacggaaaaccccagaaggugggcaucgccgggucuaacaaaagccugcaguccgcuggauuuccuaccggccucacauacagccaacugaugacgcugaaggauucuaugaugcagcuugaccccuccgccaaaaccuggauugauaucgagggcagaccugaagaccccguugagaucgcucucuaccagccgaugagcgggugcuauauucacuucuuucgggaaccuacagaccugaagcaguucaagcaagaugccaaauacucucauggaaucgacguggccgaucuguuuuccgcucagcccggccucaccagcgcggucauugaggcccugccuagaaauauggugcuuacaugucagggguccgacgauaucaagcgccugcucgacucucagggacggagagauauuaaacugaucgacaucgcucugagcaaggccgauucccgcaaauucgaaaacgccgucugggaccaaugcaaggaucuuugucacaugcauaccggcgugguuguggagaagaaaaagagagggggcaaagaggaaauuacgccccacugcgcucucauggacuguaucauguaugaugccgcggucucuggaggccuggacauucccgugcugcgggcuguucucccucgcgacaugguguuucggacaagcuccccgaaggucgugcuguga

SEQ ID NO: 2559 - RNA, 1710 nt, Artificial Sequence
  derived and/or modified CDS sequence (opt5) from Lassa virus__AIT17549__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaacaugauuggaauggugggcggggcucagggaacccagccuggcagagauggcguugugcgggucugggacgugaaaaauccggaucuucugaacaaucaauucgggacaaugcccucccucacccuggccugucuuacgaagcagggacagguggaccugaacgaugucguucucgcucugaccgaccugggccucaucuacacagccaaguauccuaauagcucugaccuggaucgccuuucccaaagccaucccauucugaacaugguggacaccaaaaaguccucucucaauaucagcggguacaacuuuucccugggagcggccgugaaagcuggcgccugcaugcuugaugggggaaauaugcuggagacaaucaaggucaccccucagacgauggacggcauucucaaaagcauccugaaggugaaaaagucucugggcauguucguuuccgauacacccggggaaagaaacccuuaugagaacauucucuacaagaucugucugagcggagacggcuggccguauauugcuucucggaccagcaucguggggcgcgccugggaaaauacaaccgucgaucuugaguccgacggaaaaccccagaaggugggcaccguugggucuaacaaaagccugcaguccgcgggauuuccuacaggccucacguacagccaacugaugacccugaaggauucuaugaugcagcuugaccccuccgccaaaacauggauugauaucgagggcagaccugaagaccccguggagaucgcucucuaccagccgaugagcgggugcuauauucacuucuuucgggaaccuaccgaccugaagcaguucaagcaagaugccaaauacucucauggaaucgacgucgcugaucuguuucccgcccagccuggccucacauccgccgugauugaggcucugcccagaaauaugguccuuaccugucaggggagcgacgauaucaagaaacugcucgacucccagggacgccgggauauuaagcugaucgacaucgcgcugucuaaagccgauagcagaaaguucgaaaacgcugugugggaccaaugcaaggaucuuugucacaugcauacgggcguuguggucgagaaaaagaaacgcgggggcaaggaggaaauuacaccccacugcgcccucauggacuguaucauguaugaugccgcuguguccggaggccugaauauuccuguucugcgggccgugcucccgagagacauggucuuucgcaccucuagccccaaaguggugcuguga

SEQ ID NO: 2560 - RNA, 1710 nt, Artificial Sequence
  derived and/or modified CDS sequence (opt5) from Lassa virus__AIT17553__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugggcggggcucagggaacccagccuggcagagauggcguugugcgggucugggacgugaaaaacccggaucuucugaauaaccaauucgggacaaugcccagccucacccuggccugucuuacgaagcagggacagguggaccugaaugaugcuguccucgcccugaccgaccugggccucaucuacacagcgaaguauccuaacucuuccgaccuggaucgccuuagccaaucccaucccauucugaauaugguugacaccaaaaagucuagccucaacaucuccggguacaauuuuagccugggagccgcugugaaagccggcgcuugcaugcuugaugggggaaacaugcuggagacaaucaaggugaccccucagacgauggacggcauucucaaaucuauccugaaggucaaaagaucccugggcauguucgugagcgauacacccggggaacggaauccuuaugagaacauucucuacaagaucugucugucuggagacggcuggccguauauugccagccgcaccuccaucguugggagagcgugggaaaacacaaccguggaucuugagucugacggaaagccccagaaaaugggcaccgccgggagcaauaagucccugcagagcgcuggauuuccuacaggccucacguacucucaacugaugacccugaaagauuccaugaugcagcuugaccccagcgccaagacauggauugauaucgagggccggccugaagaccccgucgagaucgcucucuaccagccgaugucugggugcuauauucacuucuuuagagaaccuaccgaccugaaacaguucaagcaagaugccaaguacucccauggaaucgacguggccgaucuguuucccgcucagccuggccucacaagcgcgguuauugaggcccugccccgcaacauggugcuuaccugucagggguccgacgauaucaaaaagcugcucgacucucagggacggagagauauuaaacugaucgacaucgcucugagcaaggccgauucccgccgguucgaaaaugccgucugggaccaaugcaaagaucuuugucacaugcauacgggcguggucguggagaagaagaaaagagggggcaaggaggaaauuacaccccacugcgcucucauggacuguaucauguaugaugccgcgguuucuggaggccugaacauuccugugcugcgcgcuguccucccgcgggacaugguguuuagaaccagcucccccaaaguugugcuguga

SEQ ID NO: 2561 - RNA, 1710 nt, Artificial Sequence
  derived and/or modified CDS sequence (opt5) from Lassa virus__AIT17561__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaacaugauuggaauggugggcggggcucagggaacccagccuggcagagauggcguugugcgggucugggacgugaaaaauccggaucuucugaacaaucaauucgggacaaugcccucccucacccuggccugucuuacgaagcagggacagguggaccugaacgaugcuguccucgcccugaccgaccugggccucaucuacacagcgaaguauccuaauagcucugaccuggaucgccuuucccaaagccaucccauucugaacaugguugacaccaaaaaguccucucucaauaucagcggguacaacuuuucccugggagccgcugugaaagccggcgcuugcaugcuugaugggggaaauaugcuggagacaaucaaggugaccccucagacgauugacggcauccucaaaagcauucugaaggucaaaaagucucugggcauguucguguccgauacacccggggaaagaaacccuuaugagaacauccucuacaagauuugucugagcggagacggcuggccguauaucgccucucggaccagcauuguugggcgcgcgugggaaaauacaaccguggaucuugaguccgacggaaaaccccagaaggucggcaccguggggucuaacaaaagccugcaguccgccggauuuccuacaggccucacguacagccaacugaugacccugaaggauucuaugaugcagcuugaccccuccgcuaaaacauggaucgauaucgagggcagaccugaagaccccguugagauugcccucuaccagccgaugagcgggugcuauauccacuucuuucgggaaccuaccgaccugaagcaguucaagcaagaugcuaaauacucucauggaauugacguggccgaucuguuucccgcccagccuggccucacauccgcugucaucgaggcgcugcccagaaauauggugcuuaccugucaggggagcgacgauauuaagcgccugcucgacucccagggacggagagauaucaaacugaucgacauugcccugucuaaggcugauagccgccgguucgaaaacgccgucugggaccaaugcaaagaucuuugucacaugcauacgggcgugguuguggagaagaagagacgcgggggcaaagaggaaaucacaccccacugcgcccucauggacuguauuauguaugaugcugccgucuccggaggccugaauaucccugugcugcgggcgguucucccgagagacaugguguuucgcaccucuagccccaaggucgugcuguga

SEQ ID NO: 2562 - RNA, 1710 nt, Artificial Sequence
  derived and/or modified CDS sequence (opt5) from Lassa virus__AIT17565__NP
augagcgccuccaaggagaucaaaucuuuccuguggacccagagccucagacgggaacuguccggcuacugcucuagcauuaaacuucaaguggucaaggacgcucaggcccugcuccacgggcuggauuuuuccgagguuucuaacgugcagcgccuuaugagaaagcagaaacgggacgauagcgaccugaagcgccucagagaucugaaucaagcggugaacaaucuggucgaacucaaguccacacagcagaaaagcauccugcgggugggaacgcuuaccucugacgaucugcucacacuggcugccgaccuugagaagcugaaauccaagguuauucgcaccgaaagaccccucagcucuggcguguauauggggaaccuguccacacagcaacuggagcagcggcgcgcccuccugaauaugaucggaauggucggcggggcucagggaacccagccuggcagagauggcgugguucgggugugggacgucaaaaacccggaucuucugaauaaccaauucgggacaaugcccagccucacccuggccugucuuacgaagcagggacagguggaccugaaugaugcugugcucgcccugaccgaccugggccucauuuacacagcgaaguauccuaacucuuccgaccuggaucgccuuagccaaucccaucccauccugaauauggucgacaccaaaaagucuagccucaacaucuccggguacaauuuuagccugggagccgcuguuaaagccggcgcuugcaugcuugaugggggaaacaugcuggagacaauuaaggugaccccucagacgauggacggcauccucaaaucuauucugaaggugaaaagaucccugggcauguucgucagcgaugcccccggggaacggaauccuuaugagaacauccucuacaagauuugucugucuggagacggcuggccguauaucgcgagccgcacauccauuguggggagagccugggaaaacaccacaguugaucuugagucugacggaaagccccagaaagugggcaccgcugggagcaauaagucccugcagagcgccggauuuccuaccggccucacauacucucaacugaugacgcugaaagauuccaugaugcagcuugaccccagcgcuaagaccuggaucgauaucgagggccggccugaagaccccgucgagauugcccucuaccagccgaugucugggugcuauauccacuucuuuagagaaccuacagaccugaaacaguucaagcaagaugccaaguacucccauggaauugacguggcugaucuguuucccgcgcagccuggccucaccagcgccguuaucgaggcucugccccgcaacauggugcuuacaugucagggguccgacgauauuaaacggcugcucgacucucagggaagacgcgauaucaagcugaucgacauugcccugagcaaagccgauucccggaaguucgaaaaugcugucugggaccaaugcaaagaucuuugucacaugcauaccggcguggucguggagaagaagaaaagagggggcaaggaggaaaucacgccccacugcgcccucauggacuguauuauguaugaugcggcuguuucuggaggccugaacaucccugugcugcgcgccguccucccgcgggacaugguguuuagaacaagcucccccaaaguugugcuguga

SEQ ID NO: 2563 - RNA, 1710 nt, Artificial Sequence
  derived and/or modified CDS sequence (opt5) from Lassa virus__AIT17569__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacccagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaacaugauuggaauggugggcggggcucagggaacccagccuggcagagauggcguugugcgggucugggacgugaaaaauccggaucuucugaacaaucaauucgggacaaugcccucccucacccuggccugucuuacgaagcagggacagguggaccugaacgaugcuguccucgcccugaccgaccugggccucaucuacacagcgaaguuuccuaauagcucugaccuggaucgccuuucccaaagccaucccauucugaacaugguugacaccaaaaaguccucucucaauaucagcggguauaacuucucccugggagccgcugugaaagccggcgcuugcaugcuugaugggggaaauaugcuggagacaaucaaggugaccccucagacgauggacggcauucucaaaagcauccugaaggucaaaaagucucugggcauguuuguguccgauacacccggggaaagaaacccuuacgagaacauucucuauaagaucugucugagcggagacggcuggccguacauugccucucggaccagcaucguugggcgcgcgugggaaaauacaaccguggaucuugaguccgacggaaaaccccagaaggucggcaccacagggucuaacaaaagccugcaguccgccggauucccuacgggccucaccuauagccaacugaugacacugaaggauucuaugaugcagcuugaccccuccgcuaaaaccuggauugauaucgagggcagaccugaagaccccguggagaucgcccucuaccagccgaugagcgggugcuacauucacuuuuuccgggaaccuacagaccugaagcaguuuaagcaagaugcuaaauauucucauggaaucgacguugccgaucuguuccccgcccagccuggccucaccuccgcugugauugaggcgcugcccagaaauaugguccuuacgugucaggggagcgacgauaucaagcgccugcucgacucccagggacggagagauauuaaacugaucgacaucgcccugucuaaggcugauagccgccgguuugaaaacgccgugugggaccaaugcaaagaucuuugucacaugcauacaggcgucgugguugagaagaagaaaagagggggcaaggaggaaauuacaccccacugcgcccucauggacuguaucauguacgaugcugccguguccggaggccugaaucugccuguccuccgcgcggugcugccgcgggacaugguuuucagaaccucuagccccaaagugguccuuuga

SEQ ID NO: 2564 - RNA, 1710 nt, Artificial Sequence
  derived and/or modified CDS sequence (opt5) from Lassa virus__AIT17573__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaacaugauuggaauggugggcggggcucagggaacccagccuggcagagauggcguugugcgggucugggacgugaaaaauccggaucuucugaacaaucaauucgggacaaugcccucccucacccuggccugucuuacgaagcagggacagguggaccugaacgaugcuguccucgcccugaccgaccugggccucaucuacacagcgaaguauccuaauagcucugaccuggaucgccuuucccaaagccaucccauucugaacaugguugacaccaaaaaguccucucucaauaucagcggguacaacuuuucccugggagccgcugugaaagccggcgcuugcaugcuugaugggggaaauaugcuggagacaaucaaggugaccccucagacgauggacggcauucucaaaagcauccugaaggucaaaaagucucugggcauguucguguccgauacacccggggaaagaaacccuuaugagaacauucucuacaagaucugucugagcggagacggcuggccguauauugccucucggaccagcaucguugggcgcgcgugggaaaauacaaccguggaucuugaguccgacggaaaaccccagaaggucggcaccgccgggucuaacaaaagccugcaguccgcuggauuuccuacaggccucacguacagccaacugaugacccugaaggauucuaugaugcagcuugaccccuccgccaaaacauggauugauaucgagggcagaccugaagaccccguggagaucgcucucuaccagccgaugagcgggugcuauauucacuucuuucgggaaccuaccgaccugaagcaguucaagcaagaugccaaauacucucauggaaucgacauugccgaucuguuucccgcucagccuggccucacauccgcgguuaucgaggcccugcccagaaauauggugcuuaccugucaggggagcgacgauauuaagcgccugcucgacucccagggacggagagauaucaaacugaucgacauugcucugucuaaggccgauagccgccgguucgaaaacgccgucugggaccaaugcaaagaucuuugucacaugcauacgggcguggucguggagaagaagaaaagagggggcaaggaggaaaucacaccccacugcgcucucauggacuguauuauguaugaugccgcgguuuccggaggccugaauaucccugugcugcgcgcuguccucccgcgggacaugguguuuagaaccucuagccccaaaguugugcuguga

SEQ ID NO: 2565 - RNA, 1710 nt, Artificial Sequence
  derived and/or modified CDS sequence (opt5) from Lassa virus__AIT17577__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugggcggggcucagggaacccagccuggcagagauggcguugugcgggucugggacgugaaaaacccggaucuucugaauaaccaauucgggacaaugcccagccucacccuggccugucuuacgaagcagggacagguggaccugaaugaugcuguccucgcccugaccgaccugggccucaucuacacagcgaaguauccuaacucuuccgaccuggaucgccuuagccaaucccaucccauucugaauaugguugacaccaaaaagucuagccucaacaucuccggguacaauuuuagccugggagccgcugugaaagccggcgcuugcaugcuugaugggggaaacaugcuggagacaaucaaggugaccccucagacgauggacggcauucucaaaucuauccugaaggucaaaagaucccugggcauguucgugagcgauacacccggggaacggaauccuuaugagaacauucucuacaagaucugucugucuggagacggcuggccguauauugccagccgcaccuccaucgcggggagagccugggaaaacacaaccguugaucuugagucugacggaaagccccagaaagugggcgcugccgggagcaauaagucccugcagagcgcuggauuuccuaccggccucacauacucucaacugaugacgcugaaagauuccaugaugcagcuugaccccagcgccaagaccuggauugauaucgagggccggccugaagaccccgucgagaucgcccucuaccagccgaugucugggugcuauauucacuucuuuagagaaccuacagaccugaaacaguucaagcaagaugcuaaguacucccauggaaucgacguggcggaucuguuucccgcccagccuggccucaccagcgcuguuauugaggcccugccccgcaacauggugcuuacaugucagggguccgacgauaucaaacggcugcucgacucucagggaagacgcgauauuaagcugaucgacaucgcccugagcaaagcugauucccggagauucgaaaaugccgucugggaccaaugccgcgaucuuugucacaugcauaccggcguggucguggagaagaaaaagagagggggcaaggaggaaauuacgccccacugcgcgcucauggacuguaucauguaugaugcugccguuucuggaggccugaacauuccugugcugcgggccguccucccgcgcgacaugguguuucggacaagcucccccaaaguugugcuguga

SEQ ID NO: 2566 - RNA, 1710 nt, Artificial Sequence
  derived and/or modified CDS sequence (opt5) from Lassa virus__AIT17581__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacccagcagaaaagcguucugcgggugggaacgcuuaccucugacgaucugcucacacuggcugccgaccuugagaagcugaaauccaaggucauucgcaccgaaagaccccucagcucuggcguguauauggggaaccuguccgcccagcaacuggagcagcggcgcacacuccugaauaugaucggaaugguuggcggggcucagggaacccagccuggcagagauggcgugguccgggugugggacgugaaaaacccggaucuucugaauaaccaauucgggacaaugcccagccucacccuggccugucuuacgaagcagggacaggucgaccugaaugauguugugcucgcucugaccgaccugggccucauuuacacagccaaguauccuaacucuuccgaccuggaucgccuuagccaaucccaucccauccugucuaugguggacaccaaaaagagcucccucaauauuagcggguacaacuuuucucugggagcggccgucaaagcuggcgccugcaugcuugaugggggaaauaugcuggagacaaucaaggugaccccucagacgauggacggcauccucaaauccauucugaagguuaaaaagagccugggcauguucgugucugauacacccggggaaagaaacccuuaugagaauauccucuacaagauuugucugagcggagacggcuggccguauaucgcuucccggaccucuauugucgggcgcgccugggaaaacacaaccguggaucuugagagcgacggaaaaccccagaagguuggcaccgcgggguccaacaaaagccugcagucugccggauuuccuacaggccucacguacucccaacugaugacccugaaggauagcaugaugcagcuugaccccucugcuaaaacauggaucgauauugagggcagaccugaagaccccguggagaucgcccucuaccagccgauguccgggugcuauauccacuucuuucgggaaccuaccgaccugaagcaguucaagcaagaugcuaaauacagccauggaauugacgucacagaucuguuucccgcccagccuggccucaccuccgccgugaucgaggcucugcccagaaauaugguccuuacgugucaggggucugacgauauuaagcgccugcucgacagccagggacggagagauaucaaacugauugacaucgcgcuguccaaggccgauucucgccgguucgaaaacgcugugugggaccaaugcaaagaucuuugucacaugcauacaggcguuguggucgagaagaagaaaagagggggcaaggaggaaaucacaccccacugcgcccucauggacuguauuauguaugaugccgcugugagcggaggccugaauaucccuguucugcgcgccgugcucccgcgggacauggucuuuagaaccuccagccccaaaguggugcuguga

SEQ ID NO: 2567 - RNA, 1710 nt, Artificial Sequence
  derived and/or modified CDS sequence (opt5) from Lassa virus__AIT17589__NP
augagcgccuccaaggaggugaaaucuuuccuguggacccagagccucagacgggaacuguccggcuacugcucuagcaucaaacuucaagucguuaaagacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccgcccagcaacuggagcagcggcgcgcucuccugaauaugauuggaauggugggcggggcccagggaacacagccuggcagagauggcguugugcgggucugggacgugaaaaacccggaucuucugaauaaccaauucgggaccaugcccagccucacacuggcuugucuuaccaagcagggacagguggaccugaaugaugccguccucgcgcugacggaccugggccucaucuacaccgccaaguauccuaacucuuccgaccuggaucgccuuagccaaucccaucccauucugaauaugguugacacaaagaagucuagccucaacaucuccggguacaauuuuagccugggagcugccgugaaagcuggcgccugcaugcuugaugggggaaacaugcuggagaccaucaaggugacaccucagaccauggacggcauucucaaaucuauccugaaggucaaaagaucccugggcauguucgugagcgauacgcccggggaacggaauccuuaugagaacauucucuacaagaucugucugucuggagacggcuggccguauauugcgagccgcacauccaucguugggagagccugggaaaacaccacaguggaucuugagucugacggaaagccccagaaagucggcaccaccgggagcaauaagucccugcagagcgcuggauuuccuacaggccucacguacucucaacugaugacccugaaagauuccaugaugcagcuugaccccagcgccaagacauggauugauaucgagggccggccugaagaccccguggagaucgcucucuaccagccgaugucugggugcuauauucacuucuuuagagaaccuaccgaccugaaacaguucaagcaagaugccaaguacucccauggaaucgacguugccgaucuguuucccgcucagccuggccucacaagcgcggugauugaggcccugccccgcaacaugguccuuaccugucagggguccgacgauaucaaaaagcugcucgacucucagggacggagagauauuaaacugaucgacaucgcucugagcaaggccgauucccgcaaauucgaaaaugccgugugggaccaaugcaaggaucuuugucacaugcauacgggcgucgugguugagaagaaaaagagagggggcaaagaggaaauuacaccccacugcgcucucauggacuguaucauguaugaugccgcggugucuggaggccugaacauuccuguccugcgggcugugcucccgcgcgacaugguuuuucggaccagcucccccaaggugguccuguga

SEQ ID NO: 2568 - RNA, 1710 nt, Artificial Sequence
  derived and/or modified CDS sequence (opt5) from Lassa virus__AIT17593__NP
augagcgccuccaaggaggugaaaucuuuccuguggacccagagccucagacgggaacuguccggcuacugcucuagcaucaaacuucaagucguuaaagacgcucaggcccugcuccacgggcuggauuuuuccgaggugucuaacgugcagcgccuuaugagaaagcagaaacgggacgauggagaccugaagcgccucagagaucugaaucaagcggucaacaaucugguggaacucaagagcacacagcagaaauccauucugcggguuggcacgcuuaccagcgacgaucugcucacacuggcugccgaccuugagaagcugaaaucuaaggugauccgcaccgaaagaccccucuccagcggggucuauaugggaaaccugucuucccagcaacuggagcagcggcgcgcccuccugaauaugauuggcauggugggaggagcucagggcacacagccuggcagagaugggguugugcgggucugggacgugaaaaacccggaucuucugaauaaccaauucggaaccaugcccagccucacacuggccugucuuaccaagcagggccagguggaccugaaugaugcuguccucgcccugacggaccuggggcucaucuacaccgcgaaguauccuaacucuuccgaccuggaucgccuuagccaaucccaucccauucugaauaugguugacacaaagaagucuagccucaacaucuccggauacaauuuuagccugggcgccgcugugaaagccggggcuugcaugcuugauggaggcaacaugcuggagaccaucaaggugacaccucagaccauggacggcauucucaaaucuauccugaaggucaaaagaucccuggggauguucgugagcgauacgcccggagaacggaauccuuaugagaacauucucuacaagaucugucugucuggcgacggguggccguauauugccagccgcacauccaucguugggagagcgugggaaaacaccacaguggaucuugagucugacggcaagccccagaaagucggggccgcuggaagcaccaagucccugcagagcgccggcuuuccuaccggccucacauacucucaacugaugacgcugaaagauuccaugaugcagcuugaccccagcgcuaagaccuggauugauaucgaggggcggccugaagaccccguggagaucgcccucuaccagccgaugucuggaugcuauauucacuucuuuagagaaccuacagaccugaaacaguucaagcaagaugccaaguacucccauggcaucgacguugcugaucuguuucccgcgcagccugggcucaccagcgccgugauugaggcucugccccgcaauaugguccuuacaugucagggauccgacgauaucaaacggcugcucgacucucagggcagacgcgauauuaagcugaucgacaucgcccugagcaaaguggauucccggagauucgaaaacgccgucugggaccaaugcaaggaucuuugucacaugcauaccggggugguuguggagaaaaagaagcgcggcggaaaagaggaaauuacgccccacugcgcucucauggacuguaucauguaugaugccgcggucucuggcgggcugaauauuccugugcugcgggcuguucucccgagagacaugguguuucgcacaagcucccccaaggucgugcuguga

SEQ ID NO: 2569 - RNA, 1710 nt, Artificial Sequence
  derived and/or modified CDS sequence (opt5) from Lassa virus__AIT17605__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggcuggcggggcccagggaacccagccuggcagagauggcgugguucgggugugggacgucaaaaacccggaucuucugaauaaccaauucgggacaaugcccagccucacccuggcuugucuuacgaagcagggacagguggaccugaaugaugccgugcucgcgcugaccgaccugggccucaucuacacagccaaguauccuaacucuuccgaccuggaucgccuuagccaaucccaucccauucugaauauggucgacaccaaaaagucuagccucaacaucuccggguacaauuuuagccugggagcugccguuaaagcuggcgccugcaugcuugaugggggaaacaugcuggagacaaucaaggugaccccucagacgauggacggcauucucaaaucuauccugaaggugaaaaagucccugggcauguucgucagcgauacacccggggaaagaaauccuuaugagaacauucucuacaagaucugucugucuggagacggcuggccguauauugcgagccggaccuccaucguggggcgcgccugggaaaacacaaccguugaucuugagucugacggaaaaccccagaaggugggcaccgcugggagcaauaaaucccugcagagcgccggauuuccuacaggccucacguacucucaacugaugacccugaaggauuccaugaugcagcuugaccccagcgcuaaaacauggauugauaucgagggcagaccugaagaccccgucgagaucgcccucuaccagccgaugucugggugcuauauucacuucuuucgggaaccuaccgaccugaagcaguucaagcaagaugccaaauacucccauggaaucgacguggcugaucuguuuagcgcgcagcccggccucacauccgccguuauugaggcucugccuagaaacauggugcuuaccugucaggggucugacgauaucaagcgccugcucgacagccagggacggagagauauuaaacugaucgacaucgcccuguccaaggccgauucucgccgguucgaaaaugcugucugggaccaaugcaaagaucuuugucacaugcauacgggcguggucguggagaagaagaaaagagggggcaaggaggaaauuacaccccacugcgcccucauggacuguaucauguaugaugcggcuguuagcggaggccugaacauucccgugcugcgcgccguccucccucgggacaugguguuuagaaccuccagcccgaaaguugugcuguga

SEQ ID NO: 2570 - RNA, 1710 nt, Artificial Sequence
  derived and/or modified CDS sequence (opt5) from Lassa virus__AIT17609__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggcuggcggggcccagggaacccagccuggcagagauggcgugguucgggugugggacgucaaaaacccggaucuucugaauaaccaauucgggacaaugcccagccucacccuggcuugucuuacgaagcagggacagguggaccugaaugaugccgugcucgcgcugaccgaccugggccucaucuacacagccaaguauccuaacucuuccgaccuggaucgccuuagccaaucccaucccauucugaauauggucgacaccaaaaagucuagccucaacaucuccggguacaauuuuagccugggagcugccguuaaagcuggcgccugcaugcuugaugggggaaacaugcuggagacaaucaaggugaccccucagacgauggacggcauucucaaaucuauccugaaggugaaaagaucccugggcauguucgucagcgauacacccggggaacggaauccuuaugagaacauucucuacaagaucugucugucuggagacggcuggccguauauugcgagccgcaccuccaucguggggagagccugggaaaacacaaccguugaucuugagucugacggaaagccccagaaagugggcgcugccgggagcaauaagucccugcagagcgcuggauuuccuaccggccucacauacucucaacugaugacgcugaaagauuccaugaugcagcuugaccccagcgccaagaccuggauugauaucgagggccggccugaagaccccgucgagaucgcccucuaccagccgaugucugggugcuauauucacuucuuuagagaaccuacagaccugaaacaguucaagcaagaugcuaaguacucccauggaaucgacguggcggaucuguuucccgcccagccuggccucaccagcgcuguuauugaggcccugccccgcaacauggugcuuacaugucagggguccgacgauaucaaacggcugcucgacucucagggaagacgcgauauuaagcugaucgacaucgcccugagcaaagcugauucccggagauucgaaaaugccgucugggaccaaugcaaggaucuuugucacaugcauaccggcguggucguggagaaaaagaagcgcgggggcaaagaggaaauuacgccccacugcgcgcucauggacuguaucauguaugaugcugccguuucuggaggccugaacauuccugugcugcgggccguccucccgagagacaugguguuucgcacaagcucccccaagguugugcuguga

SEQ ID NO: 2571 - RNA, 1710 nt, Artificial Sequence
  derived and/or modified CDS sequence (opt5) from Lassa virus__AIT17613__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacccagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaacaugauuggaauggugggcggggcucagggaacccagccuggcagagauggcguugugcgggucugggacgugaaaaauccggaucuucugaacaaucaauucgggacaaugcccucccucacccuggccugucuuacgaagcagggacagguggaccugaacgaugcuguccucgcccugaccgaccugggccucaucuacacagcgaaguauccuaauagcucugaccuggaucgccuuucccaaagccaucccauucugaacaugguugacaccaaaaaguccucucucaauaucagcggguacaacuuuucccugggagccgcugugaaagccggcgcuugcaugcuugaugggggaaauaugcuggagacaaucaaggugaccccucagacgauggacggcauucucaaaagcauccugaaggucaaaagaucucugggcauguucguguccgauacacccggggaacggaacccuuaugagaacauucucuacaagaucugucugagcggagacggcuggccguauauugccucucgcaccagcaucguugggagagcgugggaaaauacaaccguggaucuugaguccgacggaaagccccagaaagucggcaccgccgggucuaacaagagccugcaguccgcuggauuuccuacaggccucacguacagccaacugaugacccugaaagauucuaugaugcagcuugaccccuccgccaagacauggauugauaucgagggccggccugaagaccccguggagaucgcucucuaccagccgaugagcgggugcuauauucacuucuuuagagaaccuaccgaccugaaacaguucaagcaagaugccaaguacucucauggaaucgacguugccgaucuguuucccgcucagccuggccucacauccgcggugauugaggcccugccccgcaauaugguccuuaccugucaggggagcgacgauaucaaacggcugcucgacucccagggaagacgcgauauuaagcugaucgacaucgcucugucuaaaacggauagccggagauucgaaaacgccgugugggaccaaugcaaggaucuuugucacaugcauacaggcgucgugguugagaaaaagaagcgcgggggcaaagaggaaauuacaccccacugcgcccucauggacuguaucauguaugaugcugccguguccggaggccugaauauuccuguccugcgggcggugcucccgagagacaugguuuuucgcaccucuagccccaaggugguccuguga

SEQ ID NO: 2572 - RNA, 1710 nt, Artificial Sequence
  derived and/or modified CDS sequence (opt5) from Lassa virus__AIT17617__NP
augagcgccuccaaggaggugaaaucuuuccuguggacccagagccucagacgggaacuguccggcuacugcucuagcaucaaacuucaagucguuaaagacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccgcccagcaacuggagcagcggcgcgcucuccugaauaugauuggaauggugggcggggcccagggaacacagccuggcagagauggcguugugcgggucugggacgugaaaaacccggaucuucugaauaaccaauucgggaccaugcccagccucacacuggcuugucuuaccaagcagggacagguggaccugaaugaugccguccucgcgcugacggaccugggccucaucuacaccgccaaguauccuaacucuuccgaccuggaucgccuuagccaaucccaucccauucugaauaugguugacacaaagaagucuagccucaacaucuccggguuuaauuucagccugggagcugccgugaaagcuggcgccugcaugcuugaugggggaaacaugcuggagaccaucaaggugacaccucagaccauggacggcauucucaaaucuauccugaaggucaaaagaucccugggcauguuugugagcgauacgcccggggaacggaauccuuacgagaacauucucuauaagaucugucugucuggagacggcuggccguacauugcgagccgcacauccaucguugggagagccugggaaaacaccacaguggaucuugagucugacggaaagccccagaaagucggcaccgcugggagcaauaagucccugcagagcgccggauucccuaccggccucacauauucucaacugaugacgcugaaagauuccaugaugcagcuugaccccagcgcuaagaccuggauugauaucgagggccggccugaagaccccguggagaucgcccucuaccagccgaugucugggugcuacauucacuuuuucagagaaccuacagaccugaaacaguuuaagcaagaugccaaguauucccauggaaucgacguugcugaucuguuccccgcgcagccuggccucaccagcgccgugauugaggcucugccccgcaacaugguccuuacaugucagggguccgacgauaucaaacggcugcucgacucucagggaagacgcgauauuaagcugaucgacaucgcccugagcaaagccgauucccggagauuugaaaaugcugugugggaccaaugcaaggaucuuugucacaugcauaccggcgucgugguugagaaaaagaagcgcgggggcaaagaggaaauuacgccccacugcgcccucauggacuguaucauguacgaugcggcugugucuggaggccugaacauuccuguccugcgggccgugcucccgagagacaugguuuuccgcacaagcucccccaaggugguccuguga

SEQ ID NO: 2573 - RNA, 1710 nt, Artificial Sequence
  derived and/or modified CDS sequence (opt5) from Lassa virus__AIT17621__NP
augagcgccuccaaggaggugaaaucuuuccuguggacccagagccucagacgggaacuguccggcuacugcucuagcaucaaacuucaagucguuaaagacgcucaggcccugcuccacgggcuggauuuuuccgaggugacaaacgugcagcgccuuaugagaaagcagaaacgggacgauucugaccugaagcgccucagagaucugaaucaagcggucaacaaucugguggaacucaagagcacgcagcagaaauccauucugcggguuggaacccuuacaagcgacgaucugcucacccuggcugccgaccuugagaagcugaaaucuaaggugauccgcacagaaagaccccucuccagcggcgucuauauggggaaccugucuacccagcaacuggagcagcggcgcgcccuccugaauaugauuggaauggugggcggggcucagggaacacagccuggcagagauggcguugugcgggucugggacgugaaaaacccggaucuucugaauaaccaauucgggaccaugcccucccucacgcuggccugucuuaccaagcagggacagguggaccugaaugaugcuguccucgcccugacagaccugggccucaucuacaccgcgaaguauccuaacagcucugaccuggaucgccuuucccaaagccaucccauucugaauaugguugacacaaagaaguccucucucaacaucagcggguacaauuuuucccugggagccgcugugaaagccggcgcuugcaugcuugaugggggaaacaugcuggagaccaucaaggugacgccucagacaauggacggcauucucaaaagcauccugaaggucaaaagaucucugggcauguucguguccgauacccccggggaacggaauccuuaugagaacauucucuacaagaucugucugagcggagacggcuggccguauauugccucucgcacaagcaucguugggagagcgugggaaaacaccaccguggaucuugaguccgacggaaagccccagaaagucggcauugccgggucuaauaagagccugcaguccgcuggauuuccuacaggccucacguacagccaacugaugacccugaaagauucuaugaugcagcuugaccccuccgccaagacauggaucgauaucgagggccggccugaagaccccguggagauugcucucuaccagccgaugagcgggugcuauauccacuucuuuagagaaccuaccgaccugaaacaguucaagcaagaugccaaguacucucauggaauugacguugccgaucuguuucccgcucagccuggccucacauccgcggugaucgaggcccugccccgcaacaugguccuuaccugucaggggagcgacgauauuaaacggcugcucgacucccagggaagacgcgauaucaagcugaucgacauugcucugucuaaagccgauagccggaaguucgaaaaugccgugugggaccaaugcaaagaucuuugucacaugcauacgggcgucgugguugagaagaagaaaagagggggcaaggaggaaaucacaccccacugcgcucucauggacuguauuauguaugaugccgcgguguccggaggccugaacaucccuguccugcgcgcugugcucccgcgggacaugguuuuuagaaccucuagccccaaagugguccuguga

SEQ ID NO: 2574 - RNA, 1710 nt, Artificial Sequence
  derived and/or modified CDS sequence (opt5) from Lassa virus__AIT17625__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagcggcgcgacgauagcgaccugaaaagacuccgggaucugaaucaagcggucaacaaucugguggaacucaaguccacacagcaaaagagcauucugcgcguuggaacgcuuaccucugacgaucugcucacacuggcugccgaccuugagaaacugaaguccaaagugaucagaaccgaacggccccucagcucuggcgucuauauggggaaccuguccacacagcagcuggagcagcgcagagcccuccugaauaugauuggaauggugggcggggcucagggaacccagccuggccgggauggcguugugcgcgucugggacgugaagaacccggaucuucugaauaaccaauucgggacaaugcccagccucacccuggccugucuuacgaaacagggacagguggaccugaaugaugcuguccucgcccugaccgaccugggccucaucuacacagcgaaguauccuaacucuuccgaccuggauagacuuagccaaucccaucccauucugaauaugguugacaccaagaaaucuagccucaacaucuccggguacaauuuuagccugggagccgcugugaaggccggcgcuugcaugcuugaugggggaaacaugcuggagacaaucaaagugaccccucagacggucgacggcauucucaagucuauccugaaagugaagcggucccugggcauguucguuagcgauacacccggggaacgcaauccuuaugagaacauucucuacaaaaucugucugucuggagacggcuggccguauauugccagcagaaccuccaucguggggcgggcgugggaaaacacaaccgucgaucuugagucugacggaaagccccagaaggugggcaccgccgggagcaauaaaucccugcagagcgcuggauuuccuacaggccucacguacucucaacugaugacccugaaggauuccaugaugcagcuugaccccagcgccaaaacauggauugauaucgagggcagaccugaagaccccguugagaucgcucucuaccagccgaugucugggugcuauauucacuucuuucgcgaaccuaccgaccugaagcaguucaaacaagaugccaaguacucccauggaaucgacguggccgaucuguuucccgcucagccuggccucacaagcgcggucauugaggcccugccccggaacauggugcuuaccugucagggguccgacgauaucaagagacugcucgacucucagggacgccgggauauuaaacugaucgacaucgcucugagcaaggccgauuccagaaaauucgaaaaugccgucugggaccaaugcaaggaucuuugucacaugcauacgggcgugguuguggagaaaaagaagcgcgggggcaaagaggaaauuacaccccacugcgcucucauggacuguaucauguaugaugccgcggucucuggaggccugaacauuccugugcugcgggcuguucucccgagagacaugguguuucgcaccagcucccccaaggucgugcuguga

SEQ ID NO: 2575 - RNA, 1710 nt, Artificial Sequence
  derived and/or modified CDS sequence (opt5) from Lassa virus__AIT17627__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccagccagcaacuggagcagcggcgcgcccuccugaauaugauuggaauggugggcggggcucagggaacacagccuggcagagauggcguugugcgggucugggacgugaaaaacccggaucuucugaauaaccaauucgggaccaugcccucucucacacuggccugucuuaccaagcagggacagguggaccugaaugaugcuguccucgcccugacggaccugggccucaucuacaccgcgaaguauccuaacuccagcgaccuggaucgccuuucccaaucucaucccauucugaauaugguugacaccaaaaagagcucccucaacaucagcggguacaauuuuucucugggagccgcugugaaagccggcgcuugcaugcuugaugggggaaacaugcuggagaccaucaaggugacaccucagaccauggacggcauucucaaauccauccugaaggucaaaagaagccugggcauguucgugucugauacgcccggggaacggaauccuuaugagaacauucucuacaagaucugucugagcggagacggcuggccguauauugccucccgcacaucuaucguugggagagcgugggaaaacaccacaguggaucuugagagcgacggaaagccccagaaagucggcuccgccgggagcaauaagucucugcaguccgcuggauuuccuaccggccucaccuacagccaacugaugacacugaaagauucuaugaugcagcuugaccccuccgccaagacguggauugauaucgagggccggccugaagaccccguggagaucgcucucuaccagccgaugagcgggugcuauauucacuucuuuagagaaccuaccgaccugaaacaguucaagcaagaugccaaguacucccauggaaucgacguugccgaucuguuucccgcucagccuggccucacaucugcggugauugaggcccugccccgcaacaugguccuuaccugucaggggagcgacgauaucaaacggcugcucgacucccagggaagacgcgauauuaagcugaucgacaucgcucugucuaaagccgauagccggagauucgaaaaugccgugugggaccaaugcaaggaucuuugucacaugcauacaggcgucgugguugagaaaaagaagcgcgggggcaaagaggaaauuacaccccacugcgcucucauggacuguaucauguaugaugccgcgguguccggaggccugaacauuccuguccugcgggcugugcucccgagagacaugguuuuucgcacgagcucucccaaggugguccuguga

SEQ ID NO: 2576 - RNA, 1710 nt, Artificial Sequence
  derived and/or modified CDS sequence (opt5) from Lassa virus__AIT17631__NP
augagcgccuccaaggagaucaaaucuuuccuguggacccagagccucagacgggaacuguccggcuacugcucuagcauuaaacuucaaguggucaaggacgcucaggcccugcuccacgggcuggauuuuuccgagguuucuaacgugcagcgccuuaugagaaagcagaaacgggacgauagcgaccugaagcgccucagagaucugaaucaagcggugaacaaucuggucgaacucaaguccacacagcagaaaagcauccugcgggugggaacgcuuaccucugacgaucugcucacacuggcugccgaccuugagaagcugaaauccaagguuauucgcaccgaaagaccccucagcucuggcguguauauggggaaccuguccacacagcaacuggagcagcggcgcgcccuccugaauaugaucggaauggucggcggggcucagggaacccagccuggcagagauggcgugguucgggugugggacgucaaaaacccggaucuucugaauaaccaauucgggacaaugcccagccucacccuggccugucuuacgaagcagggacagguggaccugaaugaugcugugcucgcccugaccgaccugggccucauuuacacagcgaaguauccuaacucuuccgaccuggaucgccuuagccaaucccaucccauccugaauauggucgacaccaaaaagucuagccucaacaucuccggguacaauuuuagccugggagccgcuguuaaagccggcgcuugcaugcuugaugggggaaacaugcuggagacaauuaaggugaccccucagacgauggacggcauccucaaaucuauucugaaggugaaaagaucccugggcauguucgucagcgaugcccccggggaacggaauccuuaugagaacauccucuacaagauuugucugucuggagacggcuggccguauaucgcgagccgcacauccauuguggggagagccugggaaaacaccacaguugaucuugagucugacggaaagccccagaaagugggcaccgcugggagcaauaagucccugcagagcgccggauuuccuaccggccucacauacucucaacugaugacgcugaaagauuccaugaugcagcuugaccccagcgcuaagaccuggaucgauaucgagggccggccugaagaccccgucgagauugcccucuaccagccgaugucugggugcuauauccacuucuuuagagaaccuacagaccugaaacaguucaagcaagaugccaaguacucccauggaauugacguggcugaucuguuucccgcgcagccuggccucaccagcgccguuaucgaggcucugccccgcaacauggugcuuacaugucagggguccgacgauauuaaacggcugcucgacucucagggaagacgcgauaucaagcugaucgacauugcccugagcaaagccgauucccggagauucgaaaaugcugucugggaccaaugcaaggaucuuugucacaugcauaccggcguggucguggagaaaaagaagcgcgggggcaaagaggaaaucacgccccacugcgcccucauggacuguauuauguaugaugcggcuguuucuggaggccugaacaucccugugcugcgggccguccucccgagagacaugguguuucgcacaagcucccccaagguugugcuguga

SEQ ID NO: 2577 - RNA, 1710 nt, Artificial Sequence
  derived and/or modified CDS sequence (opt5) from Lassa virus__AIT17635__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauaacgaccugaagcgccucagagaucugaaucaagcggucaacaaucugguggaacucaagucuacacagcagaaaagcauucugcggguuggaacgcuuaccuccgacgaucugcucacacuggcugccgaccuugagaagcugaaaagcaaggugauccgcaccgaaagaccccucucuuccggcgucuauauggggaaccugaauacacagcaacuggagcagcggcgcgcccuccugaacaugauuggaauggugggcggggcucagggaacccagccuggcagagauggcguugugcgggucugggacgugaaaaauccggaucuucugaacaaucaauucgggacaaugcccagccucacccuggccugucuuacgaagcagggacagguggaccugaacgaugcuguccucgcccugaccgaccugggccucaucuacacagcgaaguauccuaauucuuccgaccuggaucgccuuagccaaucucaucccauucugaacaugguugacaccaaaaaguccagccucaauaucuccggguacaacuuuucucugggagccgcugugaaagccggcgcuugcaugcuugaugggggaaacaugcuggagacaaucaaggugaccccucagacgauggacggcauucucaaaagcauccugaaggucaaaaagucccugggcauguucgugagcgauacacccggggaaagaaauccuuaugagaacauucucuacaagaucugucugucuggagacggcuggccguauauugccucccggaccagcaucguugggcgcgcgugggaaaauacaaccguggaucuugagucugacggaaaaccccagaaggucggcaccgccgggagcaacaaaucccugcagucugcuggauuuccuacaggccucacguacagccaacugaugacccugaaggauuccaugaugcagcuugaccccagcgccaaaacauggauugauaucgagggcagaccugaagaccccguggagaucgcucucuaccagccgaugucugggugcuauauucacuucuuucgggaaccuaccgaccugaagcaguucaagcaagaugccaaauacucccauggaaucgacguugccgaucuguuucccgcucagccuggccucacaagcgcggugauugaggcccugcccagaaauaugguccuuaccugucaggggucugacgauaucaagcgccugcucgacucccagggacggagagauauuaaacugaucgacaucgcucugagcaaggccgauucccgccgguucgaaaacgccgugugggaccaaugcaaagaucuuugucacaugcauacgggcgucgugguugagaagaagaaaagagggggcaaggaggaaauuacaccccacugcgcucucauggacuguaucauguaugaugccgcggugucuggaggccugaauauuccuguccugcgcgcugugcucccgcgggacaugguuuuuagaaccagcucccccaaagugguccuguga

SEQ ID NO: 2578 - RNA, 1710 nt, Artificial Sequence
  derived and/or modified CDS sequence (opt5) from Lassa virus__AIT17639__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaacaugauuggaauggugggcggggcucagggaacccagccuggcagagauggcguugugcgggucugggacgugaaaaauccggaucuucugaacaaucaauucgggacaaugcccucccucacccuggccugucuuacgaagcagggacagguggaccugaacgaugcuguccucgcccugaccgaccugggccucaucuacacagcgaaguauccuaauagcucugaccuggaucgccuuucccaaagccaucccauucugaacaugguugacaucaaaaaguccucucucaauaucagcggguacaacuuuucccugggagccgcugugaaagccggcgcuugcaugcuugaugggggaaauaugcuggagaccauuaaggugacaccucagaccauggacggcauccucaaaagcauucugaaggucaaaagaucucugggcauguucguguccgauacgcccggggaacggaacccuuaugagaacauccucuacaagauuugucugagcggagacggcuggccguauaucgccucucgcacaagcauuguugggagagcgugggaaaauaccacaguggaucuugaguccgacggaaagccccagaaagucggcucugccgggagcaacaagucccugcagagcgcuggauuuccuaccggccucaccuacucucaacugaugacacugaaagauuccaugaugcagcuugaccccagcgccaagacguggaucgauaucgagggccggccugaagaccccguggagauugcucucuaccagccgaugucugggugcuauauccacuucuuuagagaaccuaccgaccugaaacaguucaagcaagaugccaaguacucccauggaauugacguugccgaucuguuucccgcucagccuggccucacaagcgcggugaucgaggcccugccccgcaauaugguccuuaccugucagggguccgacgauauuaaacggcugcucgacucucagggaagacgcgauaucaagcugaucgacauugcucugagcaaagccgauucccggagauucgaaaacgccgugugggaccaaugcaaggaucuuugucacaugcauacaggcgucgugguugagaaaaagaagcgcgggggcaaagaggaaaucacgccccacugcgcucucauggacuguauuauguaugaugccgcggugucuggaggccugaauaucccuguccugcgggcugugcucccgagagacaugguuuuucgcaccagcucccccaaggugguccuguga

SEQ ID NO: 2579 - RNA, 1710 nt, Artificial Sequence
  derived and/or modified CDS sequence (opt5) from Lassa virus__AIT17643__NP
augagcgccuccaaggaggugaaaucuuuccuguggacccagagccucagacgggaacuguccggcuacugcucuaacaucaaacuucaagucguuaaagacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucugcccagcaacuggagcagcggcgcgcucuccugaacaugauuggaauggugggcggggcccagggaacacagccuggcagagauggcguugugcgggucugggacgugaaaaauccggaucuucugaacaaucaauucgggaccaugcccucccucacacuggcuugucuuaccaagcagggacagguggaccugaacgaugccguccucgcgcugacggaccugggccucaucuacaccgccaaguauccuaauagcucugaccuggaucgccuuucccaaagccaucccauucugaacaugguugacacaaagaaguccucucucaauaucagcggguacaacuuuucccugggagcugccgugaaagcuggcgccugcaugcuugaugggggaaauaugcuggagaccaucaaggugacaccucagaccauggacggcauucucaaaagcauccugaaggucaaaaagucucugggcauguucguguccgauacgcccggggaaagaaacccuuaugagaacauucucuacaagaucugucugagcggagacggcuggccguauauugcgucucggacaagcaucguugggcgcgccugggaaaauaccacaguggaucuugaguccgacggaaaaccccagaaggucggcaccgcugggucuaacaaaagccugcaguccgccggauuuccuaccggccucacauacagccaacugaugacgcugaaggauucuaugaugcagcuugaccccuccgcuaaaaccuggauugauaucgagggcagaccugaagaccccguggagaucgcccucuaccagccgaugagcgggugcuauauucacuucuuucgggaaccuacagaccugaagcaguucaagcaagaugccaaauacucucauggaaucgacguugcugaucuguuucccgcgcagccuggccucaccuccgccgugauugaggcucugcccagaaauaugguccuuacaugucaggggagcgacgauaucaagcgccugcucgacucccagggacggagagauauuaaacugaucgacaucgcccugucuaaggccgauagccgccgguucgaaaacgcugugugggaccaaugcaaagaucuuugucacaugcauaccggcgucgugguugagaagaagaaaagagggggcaaggaggaaauuacgccccacugcgcccucauggacuguaucauguaugaugcggcuguguccggaggccugaauauuccuguccugcgcgccgugcucccgcgggacaugguuuuuagaacaucuagccccaaagugguccuguga

SEQ ID NO: 2580 - RNA, 1710 nt, Artificial Sequence
  derived and/or modified CDS sequence (opt5) from Lassa virus__AIT17651__NP
augagcgccuccaaggaggugaaaucuuuccuguggacccagagccucagacgggaacuguccggcuacugcucuagcaucaaacuucaagucguuaaagacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcguucugcgggugggaacgcuuaccucugacgaucugcucacacuggcugccgaccuugagaagcugaaauccaaggucauucgcaccgaaagaccccucagcucuggcguguauauggggaaccuguccgcccagcaacuggagcagcggcgcgcucuccugaauaugaucggaaugguuggcggggcccagggaacacagccuggcagagauggcgugguccgggugugggacgugaaaaacccggaucuucugaauaaccaauucgggaccaugcccagccucacacuggcuugucuuaccaagcagggacaggucgaccugaaugauguugugcucgcccugacggaccugggccucauuuacaccgcgaaguauccuaacucuuccgaccuggaucgccuuagccaaucccaucccauccugaauaugguggacacaaagaagucuagccucaacauuuccggguacaauuuuagccugggagccgcugucaaagccggcgcuugcaugcuugaugggggaaacaugcuggagaccaucaaggugacaccucagaccauggacggcauccucaaaucuauucugaagguuaaaaagucccugggcauguucgugagcgauacgcccggggaaagaaauccuuaugagaacauccucuacaagauuugucugucuggagacggcuggccguauaucgccagccggacauccauugucgggcgcgcgugggaaaacaccacaguggaucuugagucugacggaaaaccccagaagguuggcaccgccgggagcaauaaaucccugcagagcgcuggauuuccuaccggccucacauacucucaacugaugacgcugaaggauuccaugaugcagcuugaccccagcgccaaaaccuggaucgauauugagggcagaccugaagaccccguggagaucgcucucuaccagccgaugucugggugcuauauccacuucuuucgggaaccuacagaccugaagcaguucaagcaagaugccaaauacucccauggaauugacgucaccgaucuguuuagcgcccagcccggccucacauccgcugugaucgaggcgcugccuagaaacaugguccuuaccugucaggggucugacgauauuaagcgccugcucgacagccagggacggagagauaucaaacugauugacaucgcccuguccaaggcugauucucgccgguucgaaaaugccgugugggaccaaugcaaagaucuuugucacaugcauacgggcguuguggucgagaagaagaaaagagggggcaaggaggaaaucacaccccacugcgcccucauggacuguauuauguaugaugcugccgugagcggaggccugaacauccccguucugcgcgcggugcucccucgggacauggucuuuagaaccuccagcccgaaaguggugcuguga

SEQ ID NO: 2581 - RNA, 1710 nt, Artificial Sequence
  derived and/or modified CDS sequence (opt5) from Lassa virus__AIT17655__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacccagcagaaauccauucugcggguuggaacgcuuaccagcgacgaucugcucacacuggcugccgaccuugagaagcugaaaucuaaggugauccgcaccgaaaaaccccucuccagcggcgucuauauggggaaucugucuacacagcaacuggagcagagacgggcccuccugaacaugauuggaauggugggcggggcucagggaacccagccuggccgcgauggcguugugagagucugggacgugaagaauccggaucuucugaacaaucaauucgggacaaugcccucccucacccuggccugucuuacgaagcagggacagguggaccugaacgaugcuguccucgcccugaccgaccugggccucaucuacacagcgaaauuuccuaauagcucugaccuggaucggcuuucccaaagccaucccauucugaacaugguugacaccaagaaauccucucucaauaucagcggguauaacuucucccugggagccgcugugaaggccggcgcuugcaugcuugaugggggaaauaugcuggagacaaucaaagugaccccucagacgauggacggcauucucaagagcauccugaaagucaagaagucucugggcauguuuguguccgauacacccggggaacgcaacccuuacgagaacauucucuauaaaaucugucugagcggagacggcuggccguacauugccucuagaaccagcaucguugggcgggcgugggaaaauacaaccguggaucuugaguccgacggaaagccccagaaagucggcaccacagggucuaacaagagccugcaguccgccggauucccuacgggccucaccuauagccaacugaugacacugaaagauucuaugaugcagcuugaccccuccgcuaagaccuggauugauaucgagggccgcccugaagaccccguggagaucgcccucuaccagccgaugagcgggugcuacauucacuuuuucagagaaccuacagaccugaagcaguuuaaacaagaugcuaaguauucucauggaaucgacguugccgaucuguuccccgcccagccuggccucaccuccgcugugauugaggcgcugccccggaauaugguccuuacgugucaggggagcgacgauaucaaaagacugcucgacucccagggacgccgggauauuaagcugaucgacaucgcccugucuaaagcugauagcagacgcuuugaaaacgccgugugggaccaaugcaaggaucuuugucacaugcauacaggcgucgugguugagaagaaaaagagagggggcaaagaggaaauuacaccccacugcgcccucauggacuguaucauguacgaugcugccguguccggaggccugaauauuccuguccugcgggcggugcucccgcgcgacaugguuuuccggaccucuagccccaaggugguccuguga

SEQ ID NO: 2582 - RNA, 1710 nt, Artificial Sequence
  derived and/or modified CDS sequence (opt5) from Lassa virus__AIT17659__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcguucugcgggugggaacgcuuaccucugacgaucugcucacacuggcugccgaccuugagaagcugaaauccaaggucauucgcaccgaaagaccccucagcucuggcguguauauggggaaccuguccacacagcaacuggagcagcggcgcgcccuccugagcaugaucggaaugguuggcggggcucagggaacccagccuggcagagauggcgugguccgggugugggacgugaaaaauccggaucuucugaacaaucaauucgggacaaugcccucucucacccuggccugucuuacgaagcagggacaggucgaccugaacgaugcuguucucgcccugaccgaccugggccucauuuacacagcgaaguauccuaauuccagcgaccuggaucgccuuucccaaucucaucccauccugaacaugguggacaccaaaaagagcucccucaauauuagcggguacaacuuuucucugggagccgcugugaaagccggcgcuugcaugcuugaugggggaaauaugcuggagacaaucaaggucaccccucagacgauggacggcauccucaaauccauucugaaggugaaaagaagccugggcauguucguuucugauacacccggggaacggaacccuuaugagaauauccucuacaagauuugucugagcggagacggcuggccguauaucgccucccgcaccucuauuguggggagagcgugggaaaacacaaccgucgaucuugagagcgacggaaagccccagaaagugggcaccgccggguccaacaagagccugcagucugcuggauuuccuacaggccucacguacucccaacugaugacccugaaagauagcaugaugcagcuugaccccucugccaagacauggaucgauauugagggccggccugaagaccccguugagaucgcucucuaccagccgauguccgggugcuauauccacuucuuuagagaaccuaccgaccugaaacaguucaagcaagaugccaaguacagccauggaauugacguggccgaucuguuucccgcucagccuggccucacauccgcggucaucgaggcccugccccgcaauauggugcuuaccugucaggggucugacgauauuaaacggcugcucgacagccagggaagacgcgauaucaagcugauugacaucgcucugaacaaagccgauucccggagauucgaaaaugccgucugggaccaaugcaaggaucuuugucacaugcauacgggcgugguuguggagaaaaagaagcgcgggggcaaagaggaaaucacaccccacugcgcucucauggacuguauuauguaugaugccgcggucucuggaggccugaacaucccugugcugcgggcuguucucccgagagacaugguguuucgcaccagcucccccaaggucgugcuguga

SEQ ID NO: 2583 - RNA, 1710 nt, Artificial Sequence
  derived and/or modified CDS sequence (opt5) from Lassa virus__AIT17663__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugggcggggcucagggaacccagccuggcagagauggcguugugcgggucugggacgugaaaaacccggaucuucugaauaaccaauucgggacaaugcccagccucacccuggccugucuuacgaagcagggacagguggaccugaaugaugcuguccucgcccugaccgaccugggccucaucuacacagcgaaguauccuaacucuuccgaccuggaucgccuuagccaaucccaucccauucugaauaugguugacaccaaaaagucuagccucaacaucuccggguacaauuuuagccugggagccgcugugaaagccggcgcuugcaugcuugaugggggaaacaugcuggagacaaucaaggugaccccucagacgauggacggcauucucaaaucuauccugaaggucaaaagaucccugggcauguucgugagcgauacacccggggaacggaauccuuaugagaacauucucuacaagaucugucugucuggagacggcuggccguauauugccagccgcaccuccaucguugggagagcgugggaaaacacaaccguggaucuugagucugacggaaagccccagaaagucggcaccgccgggagcaauaagucccugcagagcgcuggauuuccuacaggccucacguacucucaacugaugacccugaaagauuccaugaugcagcuugaccccagcgccaagacauggauugauaucgagggccggccugaagaccccguggagaucgcucucuaccagccgaugucugggugcuauauucacuucuuuagagaaccuaccgaccugaaacaguucaagcaagaugccaaguacucccauggaaucgacguugccgaucuguuucccgcucagccuggccucacaagcgcggugauugaggcccugccccgcaacaugguccuuaccugucagggguccgacgauaucaaaaagcugcucgacucucagggacggagagauauuaaacugaucgacaucgcucugagcaaggccgauucccgccgguucgaaaaugccgugugggaccaaugcaaagaucuuugucacaugcauacgggcgucgugguugagaagaagaaaagagggggcaaggaggaaauuacaccccacugcgcucucauggacuguaucauguaugaugccgcggugucuggaggccugaacauuccuguccugcgcgcugugcucccgcgggacaugguuuuuagaaccagcucccccaaagugguccuguga

SEQ ID NO: 2584 - RNA, 1710 nt, Artificial Sequence
  derived and/or modified CDS sequence (opt5) from Lassa virus__AIT17667__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugggcggggcucagggaacccagccuggcagagauggcguugugcgggucugggacgugaaaaacccggaucuucugaauaaccaauucgggacaaugcccagccucacccuggccugucuuacgaagcagggacagguggaccugaaugaugcuguccucgcccugaccgaccugggccucaucuacacagcgaaguauccuaacucuuccgaccuggaucgccuuagccaaucccaucccauucugaauaugguugacaccaaaaagucuagccucaacaucuccggguacaauuuuagccugggagccgcugugaaagccggcgcuugcaugcuugaugggggaaacaugcuggagacaaucaaggugaccccucagacgauugacggcauccucaaaucuauucugaaggucaaaaagucccugggcauguucgugagcgauacacccggggaaagaaauccuuaugagaacauccucuacaagauuugucugucuggagacggcuggccguauaucgccagccggaccuccauuguugggcgcgcgugggaaaacacaaccguggaucuugagucugacggaaaaccccagaaggucggcaccacagggagcaauaaaucccugcagagcgccggauuuccuacgggccucaccuacucucaacugaugacacugaaggauuccaugaugcagcuugaccccagcgcuaaaaccuggaucgauaucgagggcagaccugaagaccccguggagauugcccucuaccagccgaugucugggugcuauauccacuucuuucgggaaccuacagaccugaagcaguucaagcaagaugcuaaauacucccauggaauugacguuaccgaucuguuucccgcccagccuggccucacgagcgccgugaucgaggcucugcccagaaacaugguccuuacaugucagggguccgaagacauuaagcgccugcucgauucucagggacggagagacaucaaacugaucgauauugcgcugagcaaggccgacucccgccgguucgagaaugcugugugggaucaaugcaaagaccuuugucacaugcauaccggcgucgugguugagaagaagaaaagagggggcaaggaagagaucacaccccacugcgcccucauggauuguauuauguaugacgccgcugugucuggaggccugaacaucccuguccugcgcgccgugcucccgcgggauaugguuuuuagaaccagcucccccaaagugguccuguga

SEQ ID NO: 2585 - RNA, 1710 nt, Artificial Sequence
  derived and/or modified CDS sequence (opt5) from Lassa virus__AIT17671__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacccagcagaaaagcguucugcgggugggaacgcuuaccucugacgaucugcucacacuggcugccgaccuugagaagcugaaauccaaggucauucgcaccgaaagaccccucagcucuggcguguauauggggaaccuguccacacagcaacuggagcagcggcgcgcccuccugaauaugaucggaaugguuggcggggcucagggaacccagccuggcagagauggcgugguccgggugugggacgugaaaaacccggaucuucugaauaaccaauucgggacaaugcccagccucacccuggccugucuuacgaagcagggacaggucgaccugaaugauguugugcucgcucugaccgaccugggccucauuuacacagccaaguauccuaacucuuccgaccuggaucgccuuagccaaucccaucccauccugaauaugguggacaccaaaaagucuagccucaacauuuccggguacaauuuuagccugggagcggccgucaaagcuggcgccugcaugcuugaugggggaaacaugcuggagacaaucaaggugaccccucagacgauggacggcauccucaaaucuauucugaagguuaaaaagucccugggcauguucgugagcgauacacccggggaaagaaauccuuaugagaacauccucuacaagauuugucugucuggagacggcuggccguauaucgcuagccggaccuccauugucgggcgcgccugggaaaacacaaccguggaucuugagucugacggaaaaccccagaagguuggcaccgcggggagcaauaaaucccugcagagcgccggauuuccuacaggccucacguacucucaacugaugacccugaaggauuccaugaugcagcuugaccccagcgcuaaaacauggaucgauauugagggcagaccugaagaccccguggagaucgcccucuaccagccgaugucugggugcuauauccacuucuuucgggaaccuaccgaccugaagcaguucaagcaagaugcuaaauacucccauggaauugacgucacagaucuguuucccgcccagccuggccucaccagcgccgugaucgaggcucugcccagaaacaugguccuuacgugucagggguccgacgauauuaagcgccugcucgacucucagggacggagagauaucaaacugauugacaucgcgcugagcaaggccgauucccgccgguucgaaaaugcugugugggaccaaugcaaagaucuuugucacaugcauacaggcguuguggucgagaagaagaaaagagggggcaaggaggaaaucacaccccacugcgcccucauggacuguauuauguaugaugccgcugugucuggaggccugaacaucccuguucugcgcgccgugcucccgcgggacauggucuuuagaaccagcucccccaaaguggugcuguga

SEQ ID NO: 2586 - RNA, 1710 nt, Artificial Sequence
  derived and/or modified CDS sequence (opt5) from Lassa virus__AIT17675__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcguucugcgggugggaacgcuuaccucugacgaucugcucacacuggcugccgaccuugagaagcugaaauccaaggucauucgcaccgaaagaccccucagcucuggcguguauauggggaaccuguccacacagcaacuggagcagcggcgcgcccuccugaauaugaucggaaugguuggcggggcucagggaacccagccuggcagagauggcgugguccgggugugggacgugaaaaacccggaucuucugaauaaccaauucgggacaaugcccagccucacccuggccugucuuacgaagcagggacaggucgaccugaaugaugcuguucucgcccugaccgaccugggccucauuuacacagcgaaguauccuaacucuuccgaccuggaucgccuuagccaaucccaucccauccugaauaugguggacaccaaaaagucuagccucaacauuuccggguacaauuuuagccugggagccgcugugaaagccggcgcuugcaugcuugaugggggaaacaugcuggagacaaucaaggucaccccucagacgauggacggcauccucaaaucuauucugaaggugaaaaagucccugggcauguucguuagcgauacacccggggaaagaaauccuuaugagaacauccucuacaagauuugucugucuggagacggcuggccguauaucgccagccggaccuccauuguggggcgcgcgugggaaaacacaaucgucgaucuugagucugacggaaaaccccagaaggugggcaccgccgggagcaauaaaucccugcagagcgcuggauuuccuaccggccucacauacucucaacugaugacgcugaaggauuccaugaugcagcuugaccccagcgccaaaaccuggauugauaucgagggcagaccugaagaccccguugagaucgcucucuaccagccgaugucugggugcuauauucacuucuuucgggaaccuacagaccugaagcaguucaagcaagaugccaaauacucccauggaaucgacguggccgaucuguuucccgcucagccuggccucaccagcgcggucauugaggcccugcccagaaacauggugcuuacaugucagggguccgacgauaucaagcgccugcucgacucucagggacggagagauauuaaacugaucgacaucgcucugagcaaggccgauucccgccgguucgaaaaugccgucugggaccaaugcaaagaucuuugucacaugcauaccggcgugguuguggagaagaagaaaagagggggcaaggaggaaauuacgccccacugcgcucucauggacuguaucauguaugaugccgcggucucuggaggccugaacauuccugugcugcgcgcuguucucccgcgggacaugguguuuagaacaagcucccccaaagucgugcuguga

SEQ ID NO: 2587 - RNA, 1710 nt, Artificial Sequence
  derived and/or modified CDS sequence (opt5) from Lassa virus__AIT17679__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugggcggggcucagagcacccagccuggaagagauggcguugugcgggucugggacgugaaaaacccggaucuucugaauaaccaauucggcacaaugcccucucucacccuggccugucuuacgaagcagggacagguggaccugaaugaugcuguccucgcccugaccgaccugggacucaucuacacagcgaaguauccuaacuccagcgaccuggaucgccuuucccaaucucaucccauucugaauaugguugacaccaaaaagagcucccucaacaucagcggcuacaauuuuucucugggggccgcugugaaagccggagcuugcaugcuugauggcgggaacaugcuggagacaaucaaggugaccccucagacgauggacgggauucucaaauccauccugaaggucaaaagaagccugggcauguucgugucugauacacccggcgaacggaauccuuaugagaacauucucuacaagaucugucugagcggggacggauggccguauauugccucccgcaccucuaucguuggcagagcgugggaaaacacaaccguggaucuugagagcgacgggaagccccagaaagucggaaccgccggcuccaauaagagccugcagucugcuggguuuccuacaggacucacguacucccaacugaugacccugaaagauagcaugaugcagcuugaccccucugccaagacauggauugauaucgagggccggccugaagaccccguggagaucgcucucuaccagccgauguccggcugcuauauucacuucuuuagagaaccuaccgaccugaaacaguucaagcaagaugccaaguacagccaugggaucgacguugccgaucuguuucccgcucagccuggacucacauccgcggugauugaggcccugccccgcaacaugguccuuaccugucagggcucugacgauaucaaacggcugcucgacagccaggggagacgcgauauuaagcugaucgacaucgcucuguccaaagccgauucucggagauucgaaaaugccgugugggaccaaugcaaggaucuuugucacaugcauacgggagucgugguugagaaaaagaagcgcggcgggaaagaggaaauuacaccccacugcgcucucauggacuguaucauguaugaugccgcggugagcggcggacugaacauuccuguccugcgggcugugcucccgagagacaugguuuuucgcaccuccagccccaaggugguccuguga

SEQ ID NO: 2588 - RNA, 1710 nt, Artificial Sequence
  derived and/or modified CDS sequence (opt5) from Lassa virus__AIT17683__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaacaugauuggaauggugggcggggcucagggaacccagccuggcagagauggcguugugcgggucugggacgugaaaaauccggaucuucugaacaaucaauucgggacaaugcccucccucacccuggccugucuuacgaagcagggacagguggaccugaacgaugcuguccucgcccugaccgaccugggccucaucuacacagcgaaguauccuaauagcucugaccuggaucgccuuucccaaagccaucccauucugaacaugguugacaccaaaaaguccucucucaauaucagcggguuuaacuucucccugggagccgcugugaaagccggcgcuugcaugcuugaugggggaaauaugcuggagacaaucaaggugaccccucagacgauggacggcauucucaaaagcauccugaaggucaaaaagucucugggcauguuuguguccgauacacccggggaaagaaacccuuacgagaacauucucuauaagaucugucugagcggagacggcuggccguacauugccucucggaccagcaucguugggcgcgcgugggaaaauacaaccguggaucuugaguccgacggaaaaccccagaaggucggcaccgccgggucuaacaaaagccugcaguccgcuggauucccuacaggccucacguauagccaacugaugacccugaaggauucuaugaugcagcuugaccccuccgccaaaacauggauugauaucgagggcagaccugaagaccccguggagaucgcucucuaccagccgaugagcgggugcuacauucacuuuuuccgggaaccuaccgaccugaagcaguuuaagcaagaugccaaauauucucauggaaucgacguugccgaucuguuccccgcucagccuggccucacauccgcggugauugaggcccugcccagaaauaugguccuuaccugucaggggagcgacgauaucaagcgccugcucgacucccagggacggagagauauuaaacugaucgacaucgcucugucuaaggccgauagccgccgguuugaaaacgccgugugggaccaaugcaaagaucuuugucacaugcauacgggcgucgugguugagaagaagaaaagagggggcaaggaggaaauuacaccccacugcgcucucauggacuguaucauguacgaugccgcgguguccggaggccugaauauuccuguccugcgcgcugugcucccgcgggacaugguuuucagaaccucuagccccaaagugguccuguga

SEQ ID NO: 2589 - RNA, 1710 nt, Artificial Sequence
  derived and/or modified CDS sequence (opt5) from Lassa virus__AIT17687__NP
augagcgccuccaaggaggugaaaucuuuccuguggacccagagccucagacgggaacuguccggcuacugcucuagcaucaaacuucaagucguuaaagacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccgcccagcaacuggagcagcggcgcgcucuccugaauaugauuggaauggugggcggggcccagggaacacagccuggcagagauggcguugugcgggucugggacgugaaaaacccggaucuucugaauaaccaauucgggaccaugcccagccucacacuggcuugucuuaccaagcagggacagguggaccugaaugaugccguccucgcgcugacggaccugggccucaucuacaccgccaaguauccuaacucuuccgaccuggaucgccuuagccaaucccaucccauucugaauaugguugacacaaagaagucuagccucaacaucuccggguacaauuuuagccugggagcugccgugaaagcuggcgccugcaugcuugaugggggaaacaugcuggagaccaucaaggugacaccucagaccauggacggcauucucaaaucuauccugaaggucaaaagaucccugggcauguucgugagcgauacgcccggggaacggaauccuuaugagaacauucucuacaagaucugucugucuggagacggcuggccguauauugcgagccgcacauccaucguugggagagccugggaaaacaccacaguggaucuugagucugacggaaagccccagaaagucggcaccgcugggagcaauaagucccugcagagcgccggauuuccuaccggccucacauacucucaacugaugacgcugaaagauuccaugaugcagcuugaccccagcgcuaagaccuggauugauaucgagggccggccugaagaccccguggagaucgcccucuaccagccgaugucugggugcuauauucacuucuuuagagaaccuacagaccugaaacaguucaagcaagaugccaaguacucccauggaaucgacguugcugaucuguuucccgcgcagccuggccucaccagcgccgugauugaggcucugccccgcaacaugguccuuacaugucagggguccgacgauaucaaacggcugcucgacucucagggaagacgcgauauuaagcugaucgacaucgcccugagcaaagccgauucccggagauucgaaaaugcugugugggaccaaugcaaggaucuuugucacaugcauaccggcgucgugguugagaaaaagaagcgcgggggcaaagaggaaauuacgccccacugcgcccucauggacuguaucauguaugaugcggcugugucuggaggccugaacauuccuguccugcgggccgugcucccgagagacaugguuuuucgcacaagcucccccaaggugguccuguga

SEQ ID NO: 2590 - RNA, 1710 nt, Artificial Sequence
  derived and/or modified CDS sequence (opt5) from Lassa virus__AIT17695__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaaccuuauuggaauggugggcggggcucagggaacccagccuggcagagauggcguugugcgggucugggacgugaaaaauccggaucugcucaacaaucaauucgggacaaugcccucccugacccuugccugucugacgaagcagggacagguggaccucaacgaugucguucuggcucugaccgaccucggccugaucuacacagccaaguauccuaauagcucugaccuugaucgccugucccaaagccaucccauucucaacaugguggacaccaaaaaguccucucugaauaucagcggguuuaacuucucccuuggagcggccgugaaagcuggcgccugcaugcuggaugggggaaauaugcucgagacaaucaaggucaccccucacacgauggacggcauucugaaaagcauccugaaggugaaaaagucucucggcauguuuguuuccgauacacccggggaaagaaacccuuacgagaacauucuguauaagaucugucuuagcggagacggcuggccguacauugcuucucggaccagcaucguggggcgcgccugggaaaauacaaccgucgaucuggaguccgacggaaaaccccauaaggugggcaccgcggggucuaacaaaagccuccaguccgccggauucccuacaggccugacguauagccagcugaugacccuuaaggauucuaugaugcagcucgaccccuccgcuaaaacauggauugauaucgagggcagaccugaagaccccguugagaucgcccuguaccaaccgaugagcgggugcuacauucacuuuuuccgggaaccuaccgaccugaagcaguuuaagcaggaugcuaaauauucucauggaaucgacguggccgaucucuuccccgcccagccuggccugacauccgcugucauugaggcgcuucccagaaauauggugcugaccugucaagggagcgacgauaucaagcgccuccuggacucccagggacggagagauauuaaacugaucgacaucgcccuuucuaaggcugauagccgccgguuugaaaacgccgucugggaccagugcaaagaucucugucacaugcacacgggcgugguuguggagaagaagaaaagagggggcaaggaggaaauuacaccccauugcgcccugauggacuguaucauguacgaugcugccgucuccggaggccugaauauuccugugcuccgcgcgguucugccgcgggacaugguguucagaaccucuagccccaaagucgugcuuuga

SEQ ID NO: 2591 - RNA, 1710 nt, Artificial Sequence
  derived and/or modified CDS sequence (opt5) from Lassa virus__AIT17705__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaaccuuauuggaauggugggcggggcucagggaacccagccuggcagagauggcguugugcgggucugggacgugaaaaauccggaucugcucaacaaucaauucgggacaaugcccucccugacccuugccugucugacgaagcagggacagguggaccucaacgaugcuguccuggcccugaccgaccucggccugaucuacacagcgaaguauccuaauagcucugaccuugaucgccugucccaaagccaucccauucucaacaugguugacaccaaaaaguccucucugaauaucagcggguuuaacuucucccuuggagccgcugugaaagccggcgcuugcaugcuggaugggggaaauaugcucgagacaaucaaggugaccccucagacgauggacggcauucugaaaagcauccugaaggucaaaaagucucucggcauguuuguguccgauacacccggggaaagaaacccuuacgagaacauucuguauaagaucugucuuagcggagacggcuggccguacauugccucucggaccagcaucguugggcgcgcgugggaaaauacaaccguggaucuggaguccgacggaaaaccccacaaggucggcaccgccgggucuaacagaagccuccaguccgcuggauucccuacaggccugacguauagccagcugaugacccuuaaagauucuaugaugcaacucgaccccuccgccaagacauggauugauaucgagggccggccugaagaccccguggagaucgcucuguaccagccgaugagcgggugcuacauucacuuuuucagagaaccuaccgaccugaaacaguuuaagcaggaugccaaguauucucauggaaucgacguugccgaucucuuccccgcucaaccuggccugacauccgcggugauugaggcccuuccccgcaauaugguccugaccugucaggggagcgacgauaucaaacggcuccuggacucccagggaagacgcgauauuaagcugaucgacaucgcucuuucuaaagccgauagccggagauuugaaaacgccgugugggaccagugcaaggaucucugucauaugcacacgggcgucgugguugagaaaaagaagcgcgggggcaaagaggaaauuacaccccacugcgcucugauggacuguaucauguacgaugccgcgguguccggaggccugaauauuccuguccuccgggcugugcugccgagagacaugguuuuccgcaccucuagccccaaggugguccuuuga

SEQ ID NO: 2592 - RNA, 1710 nt, Artificial Sequence
  derived and/or modified CDS sequence (opt5) from Lassa virus__AIT17711__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaaccuuauuggaauggugggcggggcucagggaacccagccuggcagagauggcguugugcgggucugggacgugaaaaauccggaucugcucaacaaucaauucgggacaaugcccucccugacccuugccugucugacgaagcagggacagguggaccucaacgaugcuguccuggcccugaccgaccucggccugaucuacacagcgaaguauccuaauagcucugaccuugaucgccugucccaaagccaucccauucucaacaugguugacaccaaaaaguccucucugaauaucagcggguuuaacuucucccuuggagccgcugugaaagccggcgcuugcaugcuggaugggggaaauaugcucgagacaaucaaggugaccccucagacgauggacggcauucugaaaagcauccugaaggucaaaaagucucucggcauguuuguguccgauacacccggggaaagaaacccuuacgagaacauucuguauaagaucugucuuagcggagacggcuggccguacauugccucucggaccagcaucguugggcgcgcgugggaaaauacaaccguggaucuggaguccgacggaaaaccccacaaggucggcaccgccgggucuagcaaaucccuccagagcgcuggauucccuacaggccugacguauucucagcugaugacccuuaaggauuccaugaugcaacucgaccccagcgccaaaacauggauugauaucgagggcagaccugaagaccccguggagaucgcucuguaccagccgaugucugggugcuacauucacuuuuuccgggaaccuaccgaccugaagcaguuuaagcaggaugccaaauauucccauggaaucgacguugccgaucucuuccccgcucaaccuggccugacaagcgcggugauugaggcccuucccagaaacaugguccugaccugucagggguccgacgauaucaagcgccuccuggacucucagggacggagagauauuaaacugaucgacaucgcucuuagcaaggccgauucccgccgguuugaaaaugccgugugggaccagugcaaagaucucugucauaugcacacgggcgucgugguugagaagaagaaaagagggggcaaggaggaaauuacaccccacugcgcucugauggacuguaucauguacgaugccgcggugucuggaggccugaacauuccuguccuccgcgcugugcugccgcgggacaugguuuucagaaccagcucccccaaagugguccuuuga

SEQ ID NO: 2593 - RNA, 1710 nt, Artificial Sequence
  derived and/or modified CDS sequence (opt5) from Lassa virus__AIT17713__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaacaugauuggaauggugggcggggcucagggaacccagccuggcagagauggcguugugcgggucugggacgugaaaaauccggaucuucugaacaaucaauucgggacaaugcccucccucacccuggccugucuuacgaagcagggacagguggaccugaacgaugcuguccucgcccugaccgaccugggccucaucuacacagcgaaguauccuaauagcucugaccuggaucgccuuucccaaagccaucccauucugaacaugguugacaucaaaaaguccucucucaauaucagcggguacaacuuuucccugggagccgcugugaaagccggcgcuugcaugcuugaugggggaaauaugcuggagaccauuaaggugacaccucagaccauggacggcauccucaaaagcauucugaaggucaaaaagucucugggcauguucguguccgauacgcccggggaaagaaacccuuaugagaacauccucuacaagauuugucugagcggagacggcuggccguauaucgccucucggacaagcauuguugggcgcgcgugggaaaauaccacaguggaucuugaguccgacggaaaaccccagaaggucggcaccgccgggucuaacaaaagccugcaguccgcuggauuuccuaccggccucacauacagccaacugaugacgcugaaggauucuaugaugcagcuugaccccuccgccaaaaccuggaucgauaucgagggcagaccugaagaccccguggagauugcucucuaccagccgaugagcgggugcuauauccacuucuuucgggaaccuacagaccugaagcaguucaagcaagaugccaaauacucucauggaauugacguugccgaucuguuucccgcucagccuggccucaccuccgcggugaucgaggcccugcccagaaauaugguccuuacaugucaggggagcgacgauauuaagcgccugcucgacucccagggacggagagauaucaaacugaucgacauugcucugaacaaggccgauucucgccgguucgaaaaugccgugugggaccaaugcaaagaucuuugucacaugcauaccggcgucgugguugagaagaagaaaagagggggcaaggaggaaaucacgccccacugcgcucucauggacuguauuauguaugaugccgcggugagcggaggccugaacaucccuguccugcgcgcugugcucccgcgggacaugguuuuuagaacauccucucccaaagugguccuguga

SEQ ID NO: 2594 - RNA, 1710 nt, Artificial Sequence
  derived and/or modified CDS sequence (opt5) from Lassa virus__AIT17719__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugagcggcgcucaggggacccagccuggaagagauggcguugugcgggucugggacgugaaaaacccggagcuucugaauaaccaauucggcacaaugcccucucucacccuggccugucuuacgaagcagggacagguggaucugaaugacgcuguccucgcccugaccgaucugggacucaucuacacagcgaaguauccuaacuccagcgaccuggaccgccuuucccaaucucaucccauucugaauaugguugauaccaaaaagagcucccucaacaucagcggcuacaauuuuucucugggggccgcugugaaagccggagcuugcaugcuugacggcgggaacaugcuggaaacaaucaaggugaccccucagacgauggaugggauucucaaauccauccugaaggucaaaaagagccugggcauguucgugucugacacacccggcgagagaaauccuuaugaaaacauucucuacaagaucugucugagcggggauggauggccguauauugccucccggaccucuaucguuggccgcgcgugggagaacacaaccguggaccuugagagcgaugggaaaccccagaaggucggaaccgccggcuccaauaaaagccugcagucugcuggguuuccuacaggacucacguacucccaacugaugacccugaaggacagcaugaugcagcuugaucccucugccaaaacauggauugacaucgaaggcagaccugaggaucccguggaaaucgcucucuaccagccgauguccggcugcuauauucacuucuuucgggagccuaccgaccugaagcaguucaagcaagacgccaaauacagccaugggaucgauguugccgaccuguuucccgcucagccuggacucacauccgcggugauugaagcccugcccagaaacaugguccuuaccugucagggcucugaugacaucaagcgccugcucgauagccaggggcggagagacauuaaacugaucgauaucucccugucuaaggcugacagccgccgguucgagaaugccgugugggaucaaugcaaagaccuuugucacaugcauacgggagucgugguugagaagaagaaaagaggcgggaaggaagagauuacaccccacugcgcccucauggauuguaucauguaugacgcugccguguccggcggacugaacauuccuguccugcgcgcggugcucccgcgggauaugguuuuuagaaccagcucucccaaagugguccuguga

SEQ ID NO: 2595 - RNA, 1710 nt, Artificial Sequence
  derived and/or modified CDS sequence (opt5) from Lassa virus__AIT17725__NP
augagcgccuccaaggaggugaaaucuuuccuguggacccagagccucagacgggaacuguccggcuacugcucuaacaucaaacuucaagucguuaaagacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucugcccagcaacuggagcagcggcgcgcucuccugaacaugauuggaauggugggcggggcccagggaacacagcuuggcagagauggcguugugcgggucugggacgugaaaaauccugaucugcucaacaaucaauucgggaccaugccgucccugacacuugcuugucugaccaagcagggacagguggaccucaacgaugccguccuggcgcugacggaccucggccugaucuacaccgccaaguaucccaauagcucugaccuugaucgccugucccaaagccauccuauucucaacaugguugacacaaagaaguccucucugaauaucagcggguacaacuuuucccuuggagcugccgugaaagcuggcgccugcaugcuggaugggggaaauaugcucgagaccaucaaggugacaccccagaccauggacggcauucugaaaagcauccugaaggucaaaaagucucucggcauguucguguccgauacgccuggggaaagaaaccccuaugagaacauucuguacaagaucugucuuagcggagacggcuggccuuauauugcgucucggacaagcaucguugggcgcgccugggaaaauaccacaguggaucuggaguccgacggaaaaccgcagaaggucggcaccgcugggucuaacaaaagccuccaguccgccggauuucccaccggccugacauacagccaacugaugacgcuuaaggauucuaugaugcagcucgacccuuccgcuaaaaccuggauugauaucgagggcagacccgaagacccuguggagaucgcccuguaccagcccaugagcgggugcuauauucacuucuuucgggaaccgacagaccugaagcaguucaagcaagaugccaaauacucucauggaaucgacguugcugaucucuuuccugcgcagcccggccugaccuccgccgugauugaggcccuuccuagaaauaugguccugacaugucaggggagcgaagacaucaagcgccuccuggauucccagggacggagagacauuaaacugaucgauaucgcucuuucuaaggccgacagccgccgguucgagaacgcugugugggaucaaugcaaagaccucugucacaugcauaccggcgucgugguugagaagaagaaaagagggggcaaggaagagauuacgccccacugcgcccugauggauuguaucauguaugacgcggcuguguccggaggccugaauauucccguccuccgcgccgugcugccucgggauaugguuuuuagaacaucuagcccgaaagugguccuuuga

SEQ ID NO: 2596 - RNA, 1710 nt, Artificial Sequence
  derived and/or modified CDS sequence (opt5) from Lassa virus__AIT17729__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagcggcgcgacgauagcgaccugaaaagacuccgggaucugaaucaagcggucaacaaucugguggaacucaaguccacccagcaaaagagcauucugcgcguuggaacgcuuaccucugacgaucugcucacacuggcugccgaccuugagaaacugaaguccaaagugaucagaaccgaacggccccucagcucuggcgucuauauggggaaccuguccacacagcagcuggagcagcgcagagcccuccugaauaugauuggaauggugggcgggacccagggaacacagccuggccgggauggcguugugcgcgucugggacgugaagaacccggaucuucugaauaaccaauucgggaccaugcccagccucacgcuggcuugucuuaccaaacagggacagguggaccugaaugaugccguccucgcucugacagaccugggccucaucuacaccgccaaguauccuaacucuuccgaccuggauagacuuagccaaucccaucccauucugaauaugguugacacaaagaaaucuagccucaacaucuccggguacaauuuuagccugggagcggccgugaaggcuggcgccugcaugcuugaugggggaaacaugcuggagaccaucaaagugacgccucagacaauggacggcauucucaagucuauccugaaagucaagcggucccugggcauguucgugagcgauacccccggggaacgcaauccuuaugagaacauucucuacaaaaucugucugucuggagacggcuggccguauauugcuagcagaacauccaucguugggcgggccugggaaaacaccaccguggaucuugagucugacggaaagccccagaaggucggcacagcggggagcaauaaaucccugcagagcgccggauuuccuacgggccucaccuacucucaacugaugacacugaaggauuccaugaugcagcuugaccccagcgcuaaaaccuggauugauaucgagggcagaccugaagaccccguggagaucgcccucuaccagccgaugucugggugcuauauucacuucuuucgcgaaccuacagaccugaagcaguucaaacaagaugcuaaguacucccauggaaucgacguugccgaucuguuucccgcccagccuggccucaccagcgcugugauugaggcgcugccccggaacaugguccuuacgugucagggguccgacgauaucaagagacugcucgacucucagggacgccgggauauuaaacugaucgacaucgcccugagcaaggcugauuccagaaaauucgaaaaugccgugugggaccaaugcaaggaucuuugucacaugcauacaggcgucgugguugagaaaaagaagcgcgggggcaaagaggaaauuacaccccacugcgcccucauggacuguaucauguaugaugcugccgugucuggaggccugaacauuccuguccugcgggcggugcucccgagagacaugguuuuucgcaccagcucccccaaggugguccuguga

SEQ ID NO: 2597 - RNA, 1710 nt, Artificial Sequence
  derived and/or modified CDS sequence (opt5) from Lassa virus__AIT17733__NP
augagcgccuccaaggaggugaaaucuuuccuguggacccagagccucagacgggaacuguccggcuacugcucuaacaucaaacuucaagucguuaaagacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucauccuggcugccgaccuugagaagcugaaaucuaaggugauucgcacagaaagaccccucuccagcggcgucuauauggggaaucugucuacccagcaacuggagcagcggcgcgcccuccugaacaugaucggaauggugggcggggcucagggaacacagccuggcagagauggcguugugcgggucugggacgugaaaaauccggaucuucugaacaaucaauucgggaccaugcccucccucacacuggccugucuuaccaagcagggacagguggaccugaacgaugcuguccucgcccugacggaccugggccucauuuacaccgcgaaguauccuaauagcucugaccuggaucgccuuucccaaagccaucccauccugaacaugguugacacaaagaaguccucucucaauaucagcggguacaacuuuucccugggagccgcugugaaagccggcgcuugcaugcuugaugggggaaauaugcuggagaccauuaaggugacaccucagaccauggacggcauccucaaaagcauucugaaggucaaaaagucucugggcauguucguguccgauacgcccggggaaagaaacccuuaugagaacauccucuacaagauuugucugagcggagacggcuggccguauaucgccucucggacaagcauuguugggcgcgcgugggaaaauaccacaguggaucuugaguccgacggaaaaccccagaaggucggcaccgccgggucuaacaaaagccugcaguccgcuggauuuccuaccggccucacauacagccaacugaugacgcugaaggauucuaugaugcagcuugaccccuccgccaaaaccuggaucgauaucgagggcagaccugaagaccccguggagauugcucucuaccagccgaugagcgggugcuauauccacuucuuucgggaaccuacagaccugaagcaguucaagcaagaugccaaauacucucauggaauugacguugccgaucuguuucccgcucagccuggccucaccuccgcggugaucgaggcccugcccagaaauaugguccuuacaugucaggggagcgacgauauuaagcgccugcucgacucccagggacggagagauaucaaacugaucgacauugcucugucuaaggccgauagccgccgguucgaaaacgccgugugggaccaaugcaaagaucuuugucacaugcauaccggcgucgugguugagaagaagaaaagagggggcaaggaggaaaucacgccccacugcgcucucauggacuguauuauguaugaugccgcgguguccggaggccugaauaucccuguccugcgcgcugugcucccgcgggacaugguuuuuagaacaucuagccccaaagugguccuguga

SEQ ID NO: 2598 - RNA, 1710 nt, Artificial Sequence
  derived and/or modified CDS sequence (opt5) from Lassa virus__AIT17745__NP
augagcgccuccaaggagaucaaaucuuuccuguggacccagagccucagacgggaacuguccggcuacugcucuagcauuaaacuucaaguggucaaggacgcucaggcccugcuccacgggcuggauuuuuccgagguuucuaacgugcagcgccuuaugagaaagcagaaacgggacgauagcgaccugaagcgccucagagaucugaaucaagcggugaacaaucuggucgaacucaaguccacacagcagaaaagcauccugcgggugggaacgcuuaccucugacgaucugcucacacuggcugccgaccuugagaagcugaaauccaagguuauucgcaccgaaagaccccucagcucuggcguguauauggggaaccuguccacacagcaacuggagcagcggcgcgcccuccugaauaugaucggaauggucggcggggcucagggaacccagccuggcagagauggcgugguucgggugugggacgucaaaaacccggaucuucugaauaaccaauucgggacaaugcccagccucacccuggccugucuuacgaagcagggacagguggaccugaaugaugcugugcucgcccugaccgaccugggccucauuuacacagcgaaguauccuaacucuuccgaccuggaucgccuuagccaaucccaucccauccugaauauggucgacaccaaaaagucuagccucaacaucuccggguacaauuuuagccugggagccgcuguuaaagccggcgcuugcaugcuugaugggggaaacaugcuggagacaauuaaggugaccccucagacgauggacggcauccucaaaucuauucugaaggugaaaagaucccugggcauguucgucagcgaugcccccggggaacggaauccuuaugagaacauccucuacaagauuugucugucuggagacggcuggccguauaucgcgagccgcacauccauuguggggagagccugggaaaacaccacaguugaucuugagucugacggaaagccccagaaagugggcaccgcugggagcaauaagucccugcagagcgccggauuuccuaccggccucacauacucucaacugaugacgcugaaagauuccaugaugcagcuugaccccagcgcuaagaccuggaucgauaucgagggccggccugaagaccccgucgagauugcccucuaccagccgaugucugggugcuauauccacuucuuuagagaaccuacagaccugaaacaguucaagcaagaugccaaguacucccauggaauugacguggcugaucuguuucccgcgcagccuggccucaccagcgccguuaucgaggcucugccccgcaacauggugcuuacaugucagggguccgacgauauuaaacggcugcucgacucucagggaagacgcgauaucaagcugaucgacauugcccugagcaaagucgauucccggagauucgaaaaugccgugugggaccaaugcaaggaucuuugucacaugcauaccggcgucgugguugagaaaaagaagcgcgggggcaaagaggaaaucacgccccacugcgcucucauggacuguauuauguaugaugccgcggugucuggaggccugaacaucccuguccugcgggcugugcucccgagagacaugguuuuucgcacaagcucccccaaggugguccuguga

SEQ ID NO: 2599 - RNA, 1710 nt, Artificial Sequence
  derived and/or modified CDS sequence (opt5) from Lassa virus__AIT17753__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacccagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugggcggggcucagggaacccagccuggcagagauggcguugugcgggucugggacgugaaaaacccggaucuucugaauaaccaauucgggacaaugcccagccucacccuggccugucuuacgaagcagggacagguggaccugaaugaugcuguccucgcccugaccgaccugggccucaucuacacagcgaaguauccuaacucuuccgaccuggaucgccuuagccaaucccaucccauucugaauaugguugacaccaaaaagucuagccucaacaucuccggguacaauuuuagccugggagccgcugugaaagccggcgcuugcaugcuugaugggggaaacaugcuggagacaaucaaggugaccccucagacgauggacggcauucucaaaucuauccugaaggucaaaagaucccugggcauguucgugagcgauacacccggggaacggaauccuuaugagaacauucucuacaagaucugucugucuggagacggcuggccguauauugccagccgcaccuccaucguugggagagcgugggaaaacacaaccguggaucuugagucugacggaaagccccagaaagucggcaccacagggagcaauaagucccugcagagcgccggauuuccuacgggccucaccuacucucaacugaugacacugaaagauuccaugaugcagcuugaccccagcgcuaagaccuggauugauaucgagggccggccugaagaccccguggagaucgcccucuaccagccgaugucugggugcuauauucacuucuuuagagaaccuacagaccugaaacaguucaagcaagaugcuaaguacucccauggaaucgacguugccgaucuguuucccgcccagccuggccucaccagcgcugugauugaggcgcugccccgcaacaugguccuuacgugucagggguccgacgauaucaaacggcugcucgacucucagggaagacgcgauauuaagcugaucgacaucgcccugagcaaagcugauucccggagauucgaaaaugccgugugggaccaaugcaaggaucuuugucacaugcauacaggcgucgugguugagaaaaagaagcgcgggggcaaagaggaaauuacaccccacugcgcccucauggacuguaucauguaugaugcugccgugucuggaggccugaacauuccuguccugcgggcggugcucccgagagacaugguuuuucgcaccagcucccccaaggugguccuguga

SEQ ID NO: 2600 - RNA, 1710 nt, Artificial Sequence
  derived and/or modified CDS sequence (opt5) from Lassa virus__AIT17763__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugggcggggcucagggaacccagccuggcagagauggcguugugcgggucugggacgugaaaaacccggaucuucugaauaaccaauucgggacaaugcccagccucacccuggccugucuuacgaagcagggacagguggaccugaaugaugcuguccucgcccugaccgaccugggccucaucuacacagcgaaguauccuaacucuuccgaccuggaucgccuuagccaaucccaucccauucugaauaugguugacaccaaaaagucuagccucaacaucuccggguacaauuuuagccugggagccgcugugaaagccggcgcuugcaugcuugaugggggaaacaugcuggagacaaucaaggugaccccucagacggucgacggcauucucaaaucuauccugaaggugaaaagaucccugggcauguucguuagcgauacacccggggaacggaauccuuaugagaacauucucuacaagaucugucugucuggagacggcuggccguauauugccagccgcaccuccaucguggggagagcgugggaaaacacaaccgucgaucuugagucugacgagaagccccagaaagugggagccgcuggcagcaauaagucccugcagagcgccggguuuccuaccggacucacauacucucaacugaugacgcugaaagauuccaugaugcagcuugaccccagcgcuaagaccuggauugauaucgaaggccggccugaggaccccguugaaaucgcccucuaccagccgaugucuggcugcuauauucacuucuuuagagagccuacagaccugaaacaguucaagcaagaugccaaguacucccaugggaucgacgugaccgaucuguuucccgcucagccuggacucacaagcgcggucauugaagcccugccccgcaacauggugcuuaccugucagggcuccgacgauaucaaacggcugcucgacucucaggggagacgcgauauuaagcugaucgacaucgcucugagcaaagccgauucccggagauucgagaaugccgucugggaccaaugcaaggaucuuugucacaugcauacgggagugguuguggagaaaaagaagcgcggcgggaaagaagagauuacaccccacugcgcucucauggacuguaucauguaugaugccgcggucucuggcggacugaacauuccugugcugcgggcuguucucccgagagacaugguguuucgcaccagcucccccaaggucgugcuguga

SEQ ID NO: 2601 - RNA, 1710 nt, Artificial Sequence
  derived and/or modified CDS sequence (opt5) from Lassa virus__AIT17771__NP
augagcgccuccaaggaggugaaaucuuuccuguggacccagagccucagacgggaacuguccggcuacugcucuagcaucaaacuucaagucguuaaggacgcucaggcccugcuccacgggcuggauuuuuccgaggugucuaacgugcagcgccuuaugagaaagcagaaacgggacgauagcgaccugaagcgccucagagaucugaaucaagcggucaacaaucugguggaacucaaguccacacagcagaaaagcauucugcggguuggaacgcuuaccucugacgaucugcucacacuggcugccgaccuugagaagcugaaauccaaggugauccgcaccgaaagaccccucagcucuggcgucuauauggggaaccuguccacacagcaacuggagcagcggcgcgcccuccugaauaugauuggaauggugggcggggcucagggaacccagccuggcagagauggcguugugcgggucugggacgugaaaaacccggaucuucugaauaaccaauucgggacaaugcccagccucacccuggccugucuuacgaagcagggacagguggaccugaaugaugcuguccucgcccugaccgaccugggccucaucuacacagcgaaguauccuaacucuuccgaccuggaucgccuuagccaaucccaucccauucugaauaugguugacaccaaaaagucuagccucaacaucuccggguacaauuuuagccugggagccgcugugaaagccggcgcuugcaugcuugaugggggaaacaugcuggagacaaucaaggugaccccucagacgauggacggcauucucaaaucuauccugaaggucaaaagaucccugggcauguucgugagcgauacacccggggaacggaauccuuaugagaacauucucuacaagaucugucugucuggagacggcuggccguauauugccagccgcaccuccaucguugggagagcgugggaaaacacaaccguggaucuugagucugacggaaagacccagaaagucagcacagccggcuccaauaagagccugcagucugcuggguuucccacgggacucaccuacucccaacugaugacacugaaagauagcaugaugcagcuugacccuucugccaagaccuggauugauaucgagggccggcccgaagacccuguggagaucgcucucuaccagcccauguccggcugcuauauucacuucuuuagagaaccgacagaccugaaacaguucaagcaagaugccaaguacagccaugggaucgacguuaccgaucuguuuccugcccagcccggacucacguccgcugugauugaggcgcugccucgcaacaugguccuuacaugucagggcucugacgauaucaaacggcugcucgacagccaggggagacgcgauauuaagcugaucgacaucgcccuguccaaagcugauucucggagauucgaaaaugccgugugggaccaaugcaaggaucuuugucacaugcauaccggagucgugguugagaaaaagaagcgcggcgggaaagaggaaauuacaccccacugcgcccucauggacuguaucauguaugaugcugccgugagcggcggacugaacauucccguccugcgggcggugcucccuagagacaugguuuuucgcaccuccagcccgaaggugguccuguga

SEQ ID NO: 2602 - RNA, 1710 nt, Artificial Sequence
  derived and/or modified CDS sequence (opt5) from Lassa virus__AIT17779__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauggagaccugaagcgccucagagaucugaaccaagcggucaauaaccugguggaacucaagucuacacagcagaaaagcauucugcggguuggcacgcuuaccuccgacgaucugcucacacuggcugccgaccuugagaagcugaaaagcaaggugauccgcaccgaaagaccccucucuuccggggucuauaugggaaaucugagcacacagcaacuggagcagcggcgcgcccuccugaacaugauuggcaugguugggggagcucagggcacccagccuggcagagaugggguggugcgggucugggacgugaaaaauccggaucuucugaacaaucaauucggaacaaugcccucucucacccuggccugucuuacgaagcagggccagguggaccugaacgaugcuguccucgcccugaccgaccuggggcucaucuacacagcgaaguauccuaauuccagcgaccuggaucgccuuucucaaucccaucccauucugaacaugguugacaccaaaaagagcucccucaauaucucuggauacaacuuuagccugggcgccgcugugaaagccggggcuugcaugcuugauggaggcaauaugcuggagacaaucaaggugaccccucagacgauggacggcauucucaaauccauccugaaggucaaaaagagccuggggauguucgugucugauacacccggagaaagaaacccuuaugagaacauucucuacaagaucugucuguccggcgacggguggccguauauugccagccggaccucuaucguuggacgcgcgugggaaaauacaaccguggaucuugagagcgacggcaaaccccagaaggucgggaccgccggauccaacaaaucucugcagagcgcuggcuuuccuacaggccucacguacucccaacugaugacccugaaggauagcaugaugcagcuugaccccucugccaaaacauggauugauaucgaggggagaccugaagaccccguggagaucgcucucuaccagccgauguccggaugcuauauucacuucuuucgggaaccuaccgaccugaagcaguucaagcaagaugccaaauacagccauggcaucgacguuacagaucuguuuucugcccagcccgggcucaccuccgcugugauugaggcgcugccuagaaauaugguccuuacgugucagggaagcgacgauaucaagcgccugcucgacucccagggccggagagauauuaaacugaucgacaucgcccugucuaagacagauagccgccgguucgaaaacgcugugugggaccaaugcaaagaucuuugucacaugcauaccggggucgugguugagaagaagaaaagaggcggaaaggaggaaauuacaccccacugcgcccucauggacuguaucauguaugaugccgcuguguccggcgggcugaauauucccguccugcgcgccgugcucccucgggacaugguuuuuagaaccucuagcccgaaagugguccuguga

SEQ ID NO: 2603 - RNA, 1710 nt, Artificial Sequence
  derived and/or modified CDS sequence (opt5) from Lassa virus__AIT17783__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauucugaccugaagcgccucagagaucugaaccaagcggucaauaaccugguggaacucaagagcacacagcagaaauccauucugcggguuggaacgcuuaccagcgacgaucugcucacacuggcugccgaccuugagaagcugaaaucuaaggugauccgcaccgaaagaccccucuccagcggcgucuauauggggaaucugucuacacagcaacuggagcagcggcgcgcccuccugaacaugauuggaauggugggcggggcucagggaacccagccuggcagagauggcguugugcgggucugggacgugaaaaauccggaucuucugaacaaucaauucgggacaaugcccucccucacccuggccugucuuacgaagcagggacagguggaccugaacgaugucguucucgcucugaccgaccugggccucaucuacacagccaaguauccuaauagcucugaccuggaucgccuuucccaaagccaucccauucugaacaugguggacaccaaaaaguccucucucaauaucagcggguacaacuuuucccugggagcggccgugaaagcuggcgccugcaugcuugaugggggaaauaugcuggagacaaucaaggucaccccucagacgauggacggcauucucaaaagcauccugaaggugaaaaagucucugggcauguucguuuccgauacacccggggaaagaaacccuuaugagaacauucucuacaagaucugucugagcggagacggcuggccguauauugcuucucggaccagcaucguggggcgcgccugggaaaauacaaccgucgaucuugaguccgacggaaaaccccagaaggugggcaccgcggggucuaacaaaagccugcaguccgccggauuuccuacaggccucacguacagccaacugaugacccugaaggauucuaugaugcagcuugaccccuccgcuaaaacauggauugauaucgagggcagaccugaagaccccguugagaucgcccucuaccagccggugagcgggugcuauauucacuucuuucgggaaccuaccgaccugaagcaguucaagcaagaugcuaaauacucucauggaaucgacgucgccgaucuguuucccgcccagccuggccucacauccgcugugauugaggcgcugcccagaaauaugguccuuaccugucaggggagcgacgauaucaagcgccugcucgacucccagggacggagagauauuaaacugaucgacaucgcccugucuaaggcugauagccgccgguucgaaaacgccgugugggaccaaugcaaagaucuuugucacaugcauacgggcguuguggucgagaagaagaaaagagggggcaaggaggaaauuacaccccacugcgcccucauggacuguaucauguaugaugcugccguguccggaggccugaauauuccuguucugcgcgcggugcucccgcgggacauggucuuuagaaccucuagccccaaaguggugcuguga

SEQ ID NO: 2604 - RNA, 1710 nt, Artificial Sequence
  derived and/or modified CDS sequence (opt5) from Lassa virus__AIT17787__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagaaacgggacgauggagaccugaagcgccucagagaucugaaccaagcggucaauaaccugguggaacucaagucuacccagcagaaaagcauucugcggguuggcacgcuuaccuccgacgaucugcucacacuggcugccgaccuugagaagcugaaaagcaaggugauccgcaccgaaagaccccucucuuccggggucuauaugggaaaucugagcacacagcaacuggagcagcggcgcgcccuccugaacaugauuggcaugguugggggagcucagggcacccagccuggcagagaugggguggugcgggucugggacgugaaaaauccggaucuucugaacaaucaauucggaacaaugcccucucucacccuggccugucuuacgaagcagggccagguggaccugaacgaugcuguccucgcccugaccgaccuggggcucaucuacacagcgaaguauccuaauuccagcgaccuggaucgccuuucucaaucccaucccauucugaacaugguugacaccaaaaagagcucccucaauaucucuggauacaacuuuagccugggcgccgcugugaaagccggggcuugcaugcuugauggaggcaauaugcuggagacaaucaaggugaccccucagacgauggacggcauucucaaauccauccugaaggucaaaaagagccuggggauguucgugucugauacacccggagaaagaaacccuuaugagaacauucucuacaagaucugucuguccggcgacggguggccguauauugccagccggaccucuaucguuggacgcgcgugggaaaauacaaccguggaucuugagagcgacggcaaaccccagaaggucgggaccgccggauccaacaaaucucugcagagcgcuggcuuuccuacaggccucacguacucccaacugaugacccugaaggauagcaugaugcagcuugaccccucugccaaaacauggauugauaucgaggggagaccugaagaccccguggagaucgcucucuaccagccgauguccggaugcuauauucacuucuuucgggaaccuaccgaccugaagcaguucaagcaagaugccaaauacagccauggcaucgacguuacagaucuguuuucugcccagcccgggcucaccuccgcugugauugaggcgcugccuagaaauaugguccuuacgugucagggaagcgacgauaucaagcgccugcucgacucccagggccggagagauauuaaacugaucgacaucgcccugucuaagguggauagccgccgguucgaaaacgcugucugggaccaaugcaaagaucuuugucacaugcauacaggggugguuguggagaagaagaaaagaggcggaaaggaggaaauuacaccccacugcgcccucauggacuguaucauguaugaugccgcugucuccggcgggcugaauauucccgugcugcgcgccguucucccucgggacaugguguuuagaaccucuagcccgaaagucgugcuguga

SEQ ID NO: 2605 - RNA, 1710 nt, Artificial Sequence
  derived and/or modified CDS sequence (opt5) from Lassa virus__AIT17803__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuaucagaacagagcggccccucucugccggcguguauauggggaaccuguccagccagcagcuggaucagcgcagagcucuccugucuaugauuggaauguccggcgggagccaggaggcccgggcuggacgcgacggcgucgugagaguuugggaugugaagaaugccgaacuucugaacaaucaguucggcaccaugccuucucucacacuggcgugucuuaccaaacaggggcaagucgaccugaacgaugccgugcaggcucucacagaccugggacugaucuacaccgccaaguauccgaauacguccgaccucgaucggcugacccagagccaucccauccuuaacaugauugacacaaagaaauccucucugaauaucagcggcuacaacuuuucccucggggcugccgugaaggcgggagccugcaugcuggauggcgggaauaugcuugagaccauuaaagucagcccucaaacaguugacggaauccugaagucuauucucaaagugaagaaagcucugggcauguucaucuccgauacccccggcgaacgcaacccuuaugagaacauucuguacaagaucugucucagcggggacggauggcccuauaucgccucuagaacgagcauuacaggccgggcuugggagaauaccguggucgaucuggaauccgacgggaagccucagaaagccggaucuaacaauagcaacaagucccuucagagcgccggcuuuacagcugggcugaccuacucucagcucaugacccugaaagaugcgaugcugcaacuugacccgaaugccaagacauggauggauaucgagggaagacccgaagacccuguggagauugcucucuaccagcccuccagcggcugcuauauccacuucuuucgcgaaccuacggaccugaaacaguucaagcaggaugccaaguacucucauggcauugacguuaccgaucuguuugccgcucaacccgggcucacauccgccgugaucgacgcgcugccgcggaacauggucaucaccugucagggaagcgaugacauuagaaaacuucuggagucccagggccgcaaggauaucaaacucauugacaucgcucugucuaagacagauagccggaaauaugagaaugccgugugggaccaguacaaggaucugugccacaugcauaccgggguuguggucgaaaagaaaaagaaaggaggcaaggaggaaauuacgccucacugugcccuuauggacugcaucauguucgaugcugccguguccgggggccucaacacaucuguccugagagcugugcugccccgcgacaugguuuuucggaccagcaccccuagagugguccucuga

SEQ ID NO: 2606 - RNA, 1710 nt, Artificial Sequence
  derived and/or modified CDS sequence (opt5) from Lassa virus__AIT17811__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugaauaugaucggaaugucuggcuccaaccagggggcccgggcuggacgcgacggcgucgugagaguuugggaugugaagaaugccgagcuucugaacaaucaguucggcacaaugccuagccucacccuggcgugucuuacaaaacaggggcaagucgaccugaacgaugccgugcaggcucucaccgaccugggacugauuuacacggccaaguauccgaauaccucugaccucgaucggcugacacagucccaucccauccuuaacaugaucgacaccaagaaaagcucccugaauauuucuggcuacaacuuuagccucggggcugccgugaaggcgggagccugcaugcuggauggcgggaacaugcuugaaacaaucaaagucuccccucaaaccauggacggcauucucaagagcauccugaaaguuaagaaagcucugggaauguucauuucugauacgcccggcgagcgcaauccuuaugaaaacauccuguacaagauuugucucuccggggacggauggcccuauaucgccagcagaacaucuaucaccggccgggcuugggagaauacagugguggaucuggagagcgacgggaagccucagaaagccggauccaacggcucuaauaagagccuucaguccgccggguuuaccgcuggacugaccuacagccagcucaugacacugaaagaugcgaugcugcaacuugacccgaacgccaagacguggauggauauugaaggcagacccgaggacccugucgaaaucgcuuucuaccagcccucuuccggcugcuauauucacuuuuuccgcgagccuaccgaccucaaacaguuuaagcaggaugccaaguacagccaugggaucgacgugacagaucuguucgccgcucaacccggacugaccucugccguuauugacgcgcucccgcggaaucuggugaucacaugucagggcuccgaugacaucagaaaacuuuuugaaagccaggggcgcaaggauauuaaacugaucgacauugcucucuccaagaccgauucucggaaauaugagaacgccgucugggaccaguacaaggaucugugccacaugcauacgggaaucgugguugagaagaaaaagagaggcgggaaagaagagauuacaccucacugugcccugauggacugcaucauguucgaugcugccgugagcggcggacuuaaugcuuccguccuccgcgccgugcugccccgggacauggucuuuagaaccucuaccccucgcgugguucuguga

SEQ ID NO: 2607 - RNA, 1710 nt, Artificial Sequence
  derived and/or modified CDS sequence (opt5) from Lassa virus__AIT17815__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccuggacaugaucggaaugucuggcuccaaucagggggcccgggcuggacgcgauggcgucgugagaguuugggacgugaagaacgccgagcuucugaauaaccaguucggcacaaugccuagccucacccuggcgugucuuacaaaacaggggcaagucgaucugaaugacgccgugcaggcucucaccgaccugggacugauuuacacggccaaguauccgaacaccucugaucucgaccggcugacacagucccaucccauccuuaauaugaucgauaccaagaaaagcucccugaacauuucuggcuacaauuuuagccucggggcugccgugaaggcgggagccugcaugcuggacggcgggaacaugcuugaaacaaucaaagucuccccucaaaccauggauggcauucucaagagcauccugaaaguuaagaaagcucugggaauguucauuucugacgcccccggcgagcgcaacccuuaugaaaauauccuguacaagauuugucucuccggggauggauggcccuauaucgcuagcagaacgucuaucacaggccgggccugggagaacaccgugguggaccuggagagcgaugggaagccucagaaagccggauccaauggcucuaacaagagccuucaguccgcuggguuuacagcgggacugaccuacagccagcucaugacccugaaagacgccaugcugcaacuugauccgaaugcuaagacauggauggacauugaaggcagacccgaggacccugucgaaaucgcccucuaccagcccucuuccggcugcuauauucacuucuuucgcgagccuacggaucugaaacaguucaagcaggacgccaaguacagccaugggaucgaugugaccgaccuguuugcugcccaacccggacucacaucugcgguuauugaugcucugccgcggaacauggugaucaccugucagggcuccgacgauaucagaaaacuuuucgaaagccaggggcgcaaggacauuaaacugaucgauauugcccucuccaagacagacucucggaaauaugagaaugccgucugggaucaguacaaggaccugugccacaugcauaccggaaucgugguugagaagaaaaagagaggcgggaaagaagagauuacgccucacugugcucugauggauugcaucauguuugacgccgcugugagcggcggacuuaacacauccguccuccgcgccgugcugccccgggacauggucuucagaaccucuaccccucgcgugguucuguga

SEQ ID NO: 2608 - RNA, 1710 nt, Artificial Sequence
  derived and/or modified CDS sequence (opt5) from Lassa virus__AIT17821__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuaucagaacagagcggccccucucugccggcguguauauggggaaccuguccagccagcagcuggaucagcgcagagcucuccugucuaugauuggaauguccggcgggaaucagggagcccgggcuggccgcgacggcgucgugagaguuugggaugugaagaacgccgagcuucugaauaaccaguucgggaccaugccuagccucacacuggcgugucuuaccaaacagggacaagucgaccugaaugaugccgugcaggcucucacagaccugggccugaucuacaccgccaaguauccgaacacgucugaccucgaucggcugacccagucccaucccauccuuaauaugauugacacaaagaaaagcucccugaacaucucuggguacaauuuuagccucggagcugccgugaaggcgggcgccugcaugcuggaugggggaaacaugcuugaaaccauuaaagucuccccucaaacaguugacggcauccucaagagcauucugaaagugaagaaagcucugggcauguucaucucugauacccccggggagcgcaacccuuaugaaaauauucuguacaagaucugucucuccggagacggcuggcccuauaucgccagcagaacgucuauuacagggcgggcuugggagaacaccguggucgaucuggagagcgacggaaagccucagaaaacaggcuccaauaacucuaauaagagccuucaguccgccggguuuaccgccggacugaccuacagccagcucaugacacugaaagaugcuaugcugcaacuugacccgaacgcgaagacguggauggauaucgaaggcagacccgaggacccuguggaaguugcccucuaccagcccucuuccggcugcuauauucacuucuuucgcgagccuaccgaccugaaacaguucaagcaggaugcuaaguacagccaugggaucgacgugacagaucuguuugccgcccaacccggacucaccucugcugucauugacgcccugccgcggaauauggugaucacaugucagggcuccgaugacaucagaaaacuucuggaaagccaggggcgcaaggauauuaaacucaucgacauugcgcuguccaagaccgauucucggaaauaugagaacgcuguuugggaccaguacaaggaucugugccacaugcauacgggaguggucguggagaagaaaaagagaggcgggaaagaagagaucacaccucacugugcccuuauggacugcauuauguucgaugccgcugucagcggcggacucaauaccuccgugcugcgcgccguucugccccgggacaugguguuuagaaccucuacaccucgcgucgugcucuga

SEQ ID NO: 2609 - RNA, 1710 nt, Artificial Sequence
  derived and/or modified CDS sequence (opt5) from Lassa virus__AIT17837__NP
augagcaacuccaaggagaucaaaucuuuccuguggacccagagccucagacgggaacuguccggcuacugcucuaauauuaagcuccaaguggucaaagacgcccaggcucugcuccacgggcuggauuuuagcgagguuuccaacgugcagcgccuuaugagaaagcagaaacgggacgaugccgaccugaagcgccucagagaucugaaucaagcggugaacaaucuggucgaacucaagucuacacagcagaaaaacgugcugcggguuggaacgcuuagcuccgacgaucugaucacccucgcugccgaccuggagaaacuuaaaagcaaggugauucgcacagaaagaccccugucuuccggcgucuauauggggaaucucagcucucagcaacuggaucagcggcgcgcccugcucuccaugaucggaaugagcggcgggccucagggaaacagaaccggcggcgacggggugguucgggugugggaugucaaaaaugcugagcugcuuaacaaucaguucggaacaaugccgucucugacccucgccugucugacaaagcaaggccagguggaccuuaacgaugcugugcaggcccugaccgaccucgggcugauuuacacggcgaaguaucccaauuccagcgaccuggauaugcucacccaaucccauccuauccugggaauggucgacacaaagaagucuagccuuaacaucuccggcuacaauuuuagccugggggccgcuguuaaagccggagcuugcaugcucgauggcggcaacaugcuggagaccauuaaggugucuccccagacaauggacgggauccuuaaauccauucugaaggugaaacgcagccucggaauguucaucucugauaccccuggcgaaagaaaccccuaugagaauauucuguacaagaucugucugagcggggaaggauggccuuauauugccucccggacgucuaucacaggccgcgcgugggagaacacccucgucgaccuggagagcgauaauaagccgcccaaacuuaacuccgccgggagcaauaagucucugcaggcugccggacucaacgcuggccugacauacucccagcugaugacccuuaaagacugcaugcuccaacuggauccuagcucuaagaccuggaucgacauugaaggcagacccgaggauccuguggaaaucgcccuguuucagcccuccagcggguguuacauucacuucuuucgggagccgacagaccucaaacaguucaagcaggacgccaaguauucccauggaaucgauguuacggaccuguuuucuacccaaccuggccuuacaagcgcugugauugaagcgcugcccagaaauaugguccuuaccugccagggguccgaugacaucaaaaagcugcuggagucucagggacgccgggauaucaaacuuauugacaucagccucuccaaggccgauagcagaaaauucgagaacgcugugugggaccaguacaaggaucugugucacaugcauacaggcguuguggucgaaaagaaaaagcgcgggggcaaagaggaaauuaccccucacugcgcccugcucgacuguaucauguuugaugccgcuacgacaggaucucugaauauuaccacccuucgggccgugcugcccagagacauggucuuccgcacauccacccccaaggugguucucuga

SEQ ID NO: 2610 - RNA, 1710 nt, Artificial Sequence
  derived and/or modified CDS sequence (opt5) from Lassa virus__AIT17841__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugaauaugaucggaaugucuggcuccaaccagggggcccggacaggacgcgacggcgucgugagaguuugggaugugaagaaugcugagcuucugaacaaucaguucggcaccaugccuagccucacacuggccugucuuaccaaacaggggcaagucgaccugaacgaugcggugcaggcccucacggaccugggacugauuuacaccgcuaaguauccgaauacaucugaccucgaucggcugacccagucccaucccauccuuaacaugaucgacacaaagaaaagcucccugaauauuucuggcuacaacuuuagccucggggccgcugugaaggccggagcgugcaugcuggauggcgggaacaugcuugaaaccaucaaagucuccccucaaacgauggacggcauucucaagagcauccugaaaguuaagaaagcccugggaauguucauuucugaugcucccggcgagcgcaauccuuaugaaaacauccuguacaagauuugucucuccggggacggauggcccuauaucgccagcagaacaucuaucaccggccgggcuugggagaauacagugguggaucuggagagcgacgggaagccucagaaagccggauccaacggcucuaauaagagccuucaguccgccggguuuaccgcuggacugaccuacagccagcucaugacacugaaagaugcgaugcugcaacuugacccgaacgccaagacguggauggauauugaaggcagacccgaggacccugucgaaaucgcucucuaccagcccucuuccggcugcuauauucacuucuuucgcgagccuaccgaccugaaacaguucaagcaggaugccaaguacagccaugggaucgacgugacagaucuguuugccgcucaacccggacucaccucugccguuauugacgcgcugccgcggaauauggugaucacaugucagggcuccgaugacaucagaaaacuuuucgaaagccaggggcgcaaggauauuaaacugaucgacauugcucucuccaagaccgauucucggaaauaugagaacgccgucugggaccaguacaaggaucugugccacaugcauacgggaaucgugguugagaagaaaaagagaggcgggaaagaagagauuacaccucacugugcccugauggacugcaucauguuugaugcugccgugagcggcggacuuaauaccuccguccuccgcgcugugcugccccgggacauggucuucagaaccucuacaccucgcgugguucuguga

SEQ ID NO: 2611 - RNA, 1710 nt, Artificial Sequence
  derived and/or modified CDS sequence (opt5) from Lassa virus__AIT17845__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuacaagaaccgagcggccccucucugccggcguguauauggggaaccuguccagccagcagcuggaucagcgcagagcucuccugaauaugaucggaaugucuggcuccaaccagggggcccagacaggacgggacggcgucgugcgcguuugggaugugaagaaugcugagcuucugaacaaucaguucggcaccaugccuagccucacacuggccugucuuaccaaacaagggcaggucgaccugaacgaugcggugcaggcccucacggaccugggacugauuuacaccgcuaaguauccgaauacaucugaccucgauagacugacccaaucccaucccauccuuaacaugaucgacacaaagaaaagcucccugaauauuucuggcuacaacuuuagccucggggccgcugugaaggccggagcgugcaugcuggauggcgggaacaugcuugaaaccaucaaagucuccccucagacgauggacggcauucucaagagcauccugaaaguuaagaaagcccugggaauguucauuucugaugcucccggcgagcggaauccuuaugaaaacauccuguacaagauuugucucuccggggacggauggcccuauaucgccagccgcacaucuaucaccggcagagcuugggagaauacagugguggaucuggagagcgacgggaagccucagaaagccggauccaacggcucuaauaagagccuucaguccgccggguuuaccgcuggacugaccuacagccaacucaugacacugaaagaugcgaugcugcagcuugacccgaacgccaagacguggauggauauugaaggccggcccgaggacccugucgaaaucgcucucuaccagcccucuuccggcugcuauauucacuucuuuagagagccuaccgaccugaaacaguucaagcaagaugccaaguacagccaugggaucgacgugacagaucuguuugccgcucagcccggacucaccucugccguuauugacgcgcugccgcgcaauauggugaucacaugucagggcuccgaugacauccggaaacuuuucgaaagccaggggagaaaggauauuaaacugaucgacauugcucucuccaagaccgauucucgcaaauaugagaacgccgucugggaccaauacaaggaucugugccacaugcauacgggaaucgugguugagaagaaaaagcggggcgggaaagaagagauuacaccucacugugcccugauggacugcaucauguuugaugcugccgugagcggcggacuuaauaccuccguccucagagcugugcugccccgcgacauggucuuccggaccucuacaccuagagugguucuguga

SEQ ID NO: 2612 - RNA, 1710 nt, Artificial Sequence
  derived and/or modified CDS sequence (opt5) from Lassa virus__ANH09723__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaagcagcggcgcgacgauaacgaccugaaaagacuccgggaucugaaucaagcggugaacaaucuggucgaacucaagucuacacagcaaaagagcgugcugcgcguuggaacgcuuaccuccgacgaucugcucacacuggcugccgaccuugagaaacuuaagagcaaagugaccagaacagaacggccccucaccgccggcgucuauauggggaaccugucuucccagcagcuggaucagcgcagagcucuccugaauaugaucggaaugagcggcgggaaccagggagcccggacaggccgcgacggcgugguuagagugugggaugucaagaaugcugagcuucugaacaaucaguucgggaccaugccuucucucacgcuggccugucuuaccaaacaaggacagguggaccugaacgaugugguccaggcgcucacagaccugggccugauuuacaccgccaaguauccgaauacauccgaccucgaucggcugacccaaagccaucccauccuuaacaugauugacacgaauaagucuucccugaacaucagcggguacaacuuuucccucggagcugccguuaaagcuggcgccugcaugcuggaugggggaaauaugcuugagacaaucaaggugucuccucagaccauggacggcauucugaaaagcauccucaaggugaaaaagucccugggcauguucauuagcgauacacccggggaacgcaacccuuaugagaauauccuguacaaaauuugucucucuggagacggcuggcccuauaucgcguccagaaccagcauuaccgggcgggccugggaaaacacagucguggaucuggagucuggaggcaagccucagaaggcugggagcaauaacuccaauaaaucucuucagagcgccggauuugcugccggccugacguacucccaacucaugacccugaaggacgccaugcugcagcuugauccgaacgcuaaaacauggauggacaucgagggcagacccgaagauccuguugagaucgcgcucuaccagcccauuagcgggugcuauauccacuucuuucgcgaaccuaccgaccugaagcaguucaaacaagacgccaaguacucucauggaauugaugugacagaccuguuugcugcccagcccggccucaccuccgccgucaucgaggcucugccgcggaauauggugauuacgugucaggggagcgaugacaucagaaaacuuuucgaaucucagggacgcaaggauaucaagcugauugacaucgcccucuccaaaacagauagccggaaguaugagaacgcgguuugggaccaauacaaagaucugugccacaugcauaccggcguggucguggagaagaagaaaaagggcgggaaagaagagauuaccccucacugugcucugauggacugcaucauguuugaugccgccgucuccggaggccuuaauacacucgugcugagagcuguucugccccgcgacaugguguuccggaccucuacaccuaaggucgugcucuga

SEQ ID NO: 2613 - RNA, 1710 nt, Artificial Sequence
  derived and/or modified CDS sequence (opt5) from Lassa virus__ANH09725__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaagcagcggcgcgacgauaacgaccugaaaagacuccgggaucugaaucaagcggugaacaaucuggucgaacucaagucuacacagcaaaagagcgugcugcgcguuggaacgcuuaccuccgacgaucugcucauccuggcugccgaccuugagaaacuuaagagcaaagugacaagaaccgaacggccccucucugccggcgucuauauggggaaccuguccagccagcagcuggaucagcgcagagcucuccugaauaugauuggaaugucuggcgggaaccagggagcccgggcuggccgcgacggcgugguuagagugugggaugucaagaaugccgaccuucugaacaaucaguucgggacaaugccuucccucacccuggcgugucuuacaaaacaaggacagguggaucugaacgacgugguccaggcccucaccgaccugggccugaucuacacggcuaaguauccgaauaccagcgaucucgaccggcugacacaaucucaucccauucuuaacaugaucgauaccaauaaguccagccugaacaucuccggguacaacuuuucucucggagccgcuguuaaagccggcgcgugcaugcuggacgggggaaauaugcuugagacaauuaaggugagcccucagaccauggauggcauccugaaauccauucucaaggugaaaaagagccugggcauguucaucucugacacgcccggggagcgcaacccuuaugaaaauauucuguacaaaaucugucucuccggagauggcuggcccuauauugccagcagaacaucuaucaccgggcgggcuugggagaacacagucguggaccuggaaagcggaggcaagccucagaaggccggguccaauaacucuaauaaaagccuucaguccgcuggauuugccgccggccugaccuacagccaacucaugacccugaaggaugcuaugcugcagcuugacccgaacgcgaaaacauggauggauaucgagggcagacccgaggacccuguugaaauugcccucuaccagcccaucucugggugcuauauucacuucuuucgcgagccuacggaccugaagcaguucaaacaagaugcuaaguacucccauggaaucgacgugaccgaucuguuugccgcccagcccggccucacaagcgcugucauugaagcccugccgcggaauauggugaucaccugucaggggucugacgauaucagaaaacuucuggagucccagggacgcaaggacauuaagcucaucgauauugcgcugagcaaaacagacucccggaaguaugaaaacgcuguuugggaucaauacaaagaccugugccacaugcauaccggcguggucguggagaagaagaaaagagggggcaaggaggaaaucacgccucacugugcccuuauggauugcauuauguucgacgccgcugucucuggaggccucaauacacuggugcugcgcgccguucucccccgggauaugguguuuagaaccagcaccccuaaagucgugcuguga

SEQ ID NO: 2614 - RNA, 1710 nt, Artificial Sequence
  derived and/or modified CDS sequence (opt5) from Lassa virus__ANH09729__NP
augagcgccuccaaggagaucaaaucuuuccuguggacccagagccucagacgggaacuguccggcuacugcucuaacauuaaacuucaaguggucaaggacgcucaggcccugcuccacgggcuggauuuuagcgagguuuccaaugugcagcgccuuaugagaaagcagcggcgcgacgauucugaccugaaaagacuccgggaucugaaccaagcggugaauaaccuggucgaacucaagagcacacagcagaaguccgugcugcgcguuggaacgcuuaccagcgacgaucugcucacacuggcugccgaccuugagaaacugaagucuaaagugaccagaacagaacggccccucuccgccggcgucuauauggggaaucugagcucucagcaacuggaucagcgcagagcucuccugaacaugaucggaauguccggcgggaaucagggagcccggaccggccgcgacggcgugguuagagugugggaugucaagaacgcugaccuucugaauaaccaguucgggacaaugccuagccucacccuggccugucuuacgaaacaaggacagguggaucugaaugacgugguccaggcgcucaccgaccugggccugauuuacacagccaaguauccgaacaccucugaucucgaccggcugacacaaucccaucccauccuuaauaugauugauaccaacaagagcucccugaauaucucuggguacaacuuuagccucggagcugccguuaaagcuggcgccugcaugcuggacgggggaaacaugcuugagacgaucaagguguccccucagacaauggauggcauucugaaaagcauccucaaggugaaaaagucucugggcauguucauuuccgacacccccggggagcgcaauccuuaugaaaacauccuguacaaaauuugucucagcggagauggcuggcccuauaucgcgucuagaacaagcauuaccgggcgggccugggagaauaccgucguggaccuggaauccggaggcaagccucagagagcugggucuaacaauagcaacaagucccuucagagcgccggauuugcugccggccugacauacucucaacucaugacgcugaaagaugccaugcugcagcuugacccgaaugcuaagaccuggauggauaucgagggccgccccgaggacccuguugaaaucgcgcucuaccagcccacauccgggugcuauauucacuucuuucgggagccuaccgaccugaaacaguucaagcaagaugccaaauacagccauggaaucgacgugacagaucuguuugcugcccagcccggccucaccucugccgucauugaagcucugccgagaaacauggugaucacgugucagggguccgacgauauucgcaaacuucuggagagccagggacggaaggacaucaagcucaucgauauugcccuguccaagacagacucuagaaaauaugaaaaugcgguuugggaucaauacaaggaccugugccacaugcauaccggcguggucguggagaaaaagaagaaagggggcaaggaggaaaucaccccucacugugcucuuauggauugcauuauguucgacgccgccgucagcggaggccucaacacacuggugcugcgcgcuguucucccccgggauaugguguuuagaaccuccacaccuaaagucgugcuguga

SEQ ID NO: 2615 - RNA, 1710 nt, Artificial Sequence
  derived and/or modified CDS sequence (opt5) from Lassa virus__ANH09731__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaagcagcggcgcgacgauaacgaccugaaaagacuccgggaucugaaucaagcggugaacaaucuggucgaacucaagucuacacagcaaaagagcgugcugcgcguuggaacgcuuaccuccgacgaucugcucacacuggcugccgaccuugagaaacuuaagagcaaagugaccagaacagaacggccccucucugccggcgucuauauggggaaccuguccagccagcagcuggaucagcgcagagcucuccugaauaugaucggaaugaccggcgggaaccagggagcccggacaggccgcgacggcgugguuagagugugggaugucaagaaugcugaccuucugaacaaucaguucgggaccaugccuucucucacgcuggccugucuuaccaaacaaggacagguggaucugaacgacgugguccaggcgcucacagaccugggccugauuuacaccgccaaguauccgaauacauccgaucucgaccggcugacccaaagccaucccauccuuaacaugauugauacgaauaagucuucccugaacaucagcggguacaacuuuucccucggagcugccguuaaagcuggcgccugcaugcuggacgggggaaauaugcuugagacaaucaaggugucuccucagaccauggauggcauucugaaaagcauccucaaggugaaaaagucccugggcauguucauuagcgacacacccggggagcgcaacccuuaugaaaauauccuguacaaaauuugucucucuggagauggcuggcccuauaucgcguccagaaccagcauuaccgggcgggccugggagaacacagucguggaccuggaaucuggaggcaagccucagagagcugggagcaauaacuccaauaagucucuucagagcgccggacuggcugccggccucacguacucccaacugaugacccugaaagaugccaugcuucagcucgacccgaacgcuaagacauggauggauaucgagggccgccccgaggacccuguugaaaucgcgcuguaccagcccaccagcgggugcuauauucacuuuuuccgggagccuacagaccugaaacaguuuaagcaagaugccaaauacucucauggaaucgacgugaccgaucucuucgcugcccagcccggccugacguccgccgucauugaagcccuuccgagaaauauggugaucacaugucaggggagcgacgauauucgcaagcugcucgagucucagggacggaaggacaucaaacugaucgauauugcucuguccaagaccgacagcagaaaauaugaaaacgcgguuugggaucaauacaaggaccuuugccacaugcauaccggcguggucguggagaaaaagaagaaagggggcaaggaggaaaucacaccucacugugcucucauggauugcauuauguuugacgccgccgucuccggaggccugaauacccuggugcuccgcgcuguucugccccgggauaugguguucagaacaucuacgccuaaagucgugcuuuga

SEQ ID NO: 2616 - RNA, 1710 nt, Artificial Sequence
  derived and/or modified CDS sequence (opt5) from Lassa virus__ANH09733__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaagcagcggcgcgacgauaacgaccugaaaagacuccgggaucugaaucaagcggugaacaaucuggucgaacucaagucuacacagcaaaagagcgugcugcgcguuggaacgcuuaccuccgacgaucugcucacacuggcugccgaccuugagaaacuuaagagcaaagugaccagaacagaacggccccucucugccggcgucuauauggggaaccuguccagccagcagcuggaucagcgcagagcucuccugaauaugaucggaaugucuggcgggaaccagggagcccggaccggccgcgacggcgugguuagagugugggaugucaagaaugcugaccuucugaacaaucaguucgggacaaugccuucccucacccuggccugucuuacgaaacaaggacagguggaucugaacgacgugguccaggcgcucaccgaccugggccugauuuacacagccaaguauccgaauaccagcgaucucgaccggcugacacaaucucaucccauccuuaacaugauugauaccaauaaguccagccugaacaucuccggguacaacuuuucucucggagcugccguuaaagcuggcgccugcaugcuggacgggggaaauaugcuugagacgaucaaggugagcccucagacaauggauggcauucugaaauccauccucaaggugaaaaagagccugggcauguucauuucugacacccccggggagcgcaacccuuaugaaaauauccuguacaaaauuugucucuccggagauggcuggcccuauaucgcgagcagaacaucuauuaccgggcgggccugggagaacaccgucguggaccuggaaagcggaggcaagccucagagagcuggguccaauaacucuaauaagagccuucaguccgccggauuugcugccggccugacauacagccaacucaugacgcugaaagaugccaugcugcagcuugacccgaacgcuaagaccuggauggauaucgagggccgccccgaggacccuguugaaaucgcguucuaccagcccauuucugggugcuauauccacuuuuuccgggagccuacagaccucaaacaguuuaagcaagaugccaaauacucccauggaauugacgugaccgaucuguucgcugcccagcccggccugacaagcgccgucaucgaagcucucccgagaaauauggugauuaccugucaggggucugacgauauccgcaagcugcuugagucccagggacggaaggacaucaaacugauugauaucgcccucagcaagacggacuccagaaaauaugaaaacgcgguuugggaucaauacaaggaccugugccacaugcauacaggcguggucguggagaaaaagaagaaagggggcaaggaggaaauuaccccucacugugcucugauggauugcaucauguuugacgccgccgucucuggaggccuuaauacccucgugcugcgcgcuguucugccccgggauaugguguucagaacaagcaccccuaaagucgugcucuga

SEQ ID NO: 2617 - RNA, 1710 nt, Artificial Sequence
  derived and/or modified CDS sequence (opt5) from Lassa virus__ANH09735__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaauauucagcgccuuaugagaaaggaacggcgcgacgauucugaccugaaaagacuccgggaucugaaccaggcggugaauaaccuggucgagcucaagagcacacaacagaaguccgugcugcgcguuggaacgcuuagcucugacgaucugcucacccuggcugccgaccuugaaaaacugaaguccaaagugaucagaacagagcggccccucagcucuggcgucuauauggggaaucuguccacccagcagcuggaucaacgcagagcccuccugaacaugauuggaaugacaaauggcgggcagggagcuaacgccggccgggacggcaucgugcgcguuugggaugugaagaaugcugagcuucugaacaaucaguucgggaccaugccuagccucacacuggccugucuuaccaaacagggacaagucgaccugaacgaugcggugcaggcccucacggaccugggccugauuuacaccgcuaaguaucccaauucuuccgaccucgauagacugagccagaaccaucccauccuuaauaugaucgacacaaagaaauccucucugaacauuagcggguacaacuuuucccucggagccgcugugaaggccggcgcgugcaugcuggaugggggaaauaugcuugaaaccaucaaagucagcccucaaacaauggacggcauucugaagucuauccucaaaguuaagcggucccugggcauguucgugagcgauacccccggggagcgcaacccuuaugaaaauauucuguacaaaaucugucucucuggagacggcuggcccuauguggccagcagaacguccauuaucgggcgggcuugggagaacacagucguggaucuggagucugacagcaagccucagagaccgggauccaaggaaagcaaucgcucucuucagaccgccggcuuucccgcugggcugacauacucccagcucaugacccugaaagauagcaugcugcaacuugacccuaacgccaagaccuggauggauaucgagggacggcccgacgacccuguugaaauugcccucuaccagcccucuuccggcugcuauauccacuucuuuagagagccgacagaucugaaacaguucaagcaggacgcuaaauacagccauggcauugauaucggggaccuguuugcggcccaaccuggacucacguccgcugugauugaagcccugccccgcaauauggucaucaccugucagggcucugaggauaucaagcggcuucuggagagccaggggagaaaggacauucgccucguggauaucucccugucuaaagccgacagccggaaguucgaaaacgcuguuugggaucaguuuaaagaccugugcaauaugcacacaggaguggucguggagaagaaaaagaagggcgggaaagaagagauuaccccucauugugcccuuauggauugcaucauguucgacgcggcugucaugggcggacucgaugccaaggugcugagagccguucugcccaaagacaugguguuucgcacauccaccccgcgggucgugcucuga

SEQ ID NO: 2618 - RNA, 1710 nt, Artificial Sequence
  derived and/or modified CDS sequence (opt5) from Lassa virus__ANH09737__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaauauucagcgccuuaugagaaaggaacggcgcgacgauucugaccugaaaagacuccgggaucugaaccaggcggugaauaaccuggucgagcucaagagcacacaacagaaguccgugcugcgcguuggaacgcuuagcucugacgaucugcucacccuggcugccgaccuugaaaaacugaaguccaaagugaucagaacagagcggccccucagcucuggcgucuauauggggaaucuguccacccagcagcuggaucaacgcagagcccuccugaacaugauuggaaugacaaauggcgggcagggagcuaacgccggccgggacggcaucgugcgcguuugggaugugaagaaugcugagcuucugaacaaucaguucgggaccaugccuagccucacacuggccugucuuaccaaacagggacaagucgaccugaacgaugcggugcaggcccucacggaccugggccugauuuacaccgcuaaguaucccaauucuuccgaccucgauagacugagccagaaccauccgauccuuaauaugaucgacacaaagaaauccucucugaacauuagcggguacaacuuuucccucggagccgcugugaaggccggcgcgugcaugcuggaugggggaaauaugcuugaaaccaucaaagucagcccucaaacaauggacggcauucugaagucuauccucaaaguuaagcggucccugggcauguucgugagcgauacccccggggagcgcaacccuuaugaaaauauucuguacaaaaucugucucucuggagacggcuggcccuauguggccagcagaacguccauuaucgggcgggcuugggagaacacagucguggaucuggagucugacagcaagccucagagaccgggauccaaggaaagcaaucgcucucuucagaccgccggcuuucccgcugggcugacauacucccagcucaugacccugaaagauagcaugcugcaacuugacccuaacgccaagaccuggauggauaucgagggacggcccgacgacccuguugaaauugcccucuaccagcccucuuccggcugcuauauccacuucuuuagagagccgacagaucugaaacaguucaagcaggacgcuaaauacagccauggcauugauaugggggaccuguuugcggcccaaccuggacucacguccgcugugaucgaagcccugccccgcaauauggucauuaccugucagggcucugaggauaucaagcggcuucuggagagccaggggagacgcgacauccggcucguggauauuucccugucuaaggccgacagcagaaaauucgaaaacgcuguuugggaucaguuuaaggaccugugcaauaugcacacaggaguggucguggagaaaaagaaaaagggcgggaaggaagagaucaccccucauugugcccuuauggauugcauuauguucgacgcggcugucaugggcggacucgaugccaaagugcugcgcgccguucugcccaaggacaugguguuucggacauccacccccagagucgugcucuga

SEQ ID NO: 2619 - RNA, 1710 nt, Artificial Sequence
  derived and/or modified CDS sequence (opt5) from Lassa virus__ANH09739__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaauauucagcgccuuaugagaaaggaacggcgcgacgauucugaccugaaaagacuccgggaucugaaccaggcggugaauaaccuggucgagcucaagagcacacaacagaaguccgugcugcgcguuggaacgcuuagcucugacgaucugcucacccuggcugccgaccuugaaaaacugaaguccaaagugaucagaacagagcggccccucagcucuggcgucuauauggggaaucuguccacccagcagcuggaucaacgcagagcccuccugaacaugauuggaaugacaagcggcgggcagggagcuaaugccggccgggacggcaucgugcgcguuugggaugugaagaacgcugagcuucugaauaaccaguucgggaccaugccuucucucacacuggccugucuuaccaaacagggacaagucgaccugaaugaugcggugcaggcccucacggaccugggccugauuuacaccgcuaaguauccgaacuccagcgaccucgauagacugucccagaaucaucccauccuuaacaugaucgacacaaagaaaucuagccugaauauuuccggguacaacuuuagccucggagccgcugugaaggccggcgcgugcaugcuggaugggggaaacaugcuugaaaccaucaaagucucuccucaaacaauggacggcauucugaaguccauccucaaaguuaagcggagccugggcauguucgugucugauacccccggggagcgcaauccuuaugaaaacauucuguacaaaaucugucucagcggagacggcuggcccuauguggccuccagaacgucuauuaucgggcgggcuugggagaauacagucguggaucuggagagcgacuccaagccucagagaccgggaagcaaggaaucuaaccgcucccuucagaccgccggcuuucccgcugggcugacauacagccagcucaugacccugaaagauucuaugcugcaacuugacccuaaugccaagaccuggauggauaucgagggacggcccgacgacccuguugaaauugcccucuaccagcccuccagcggcugcuauauccacuucuuuagagagccgacagaucugaaacaguucaagcaggacgcuaaauacucccauggcauugauaucggggaccuguuugcggcccaaccuggacucacgucugcugugauugaagcccugccccgcaacauggucaucaccugucagggcagcgaggauaucaagcggcuucuggagucccaggggagacgcgacauucggcucguggauaucucucugagcaaggccgacuccagaaaauucgaaaaugcuguuugggaucaguuuaaggaccugugcaacaugcacacaggaguggucguggagaaaaagaaaaagggcgggaaggaagagauuaccccucauugugcccuuauggauugcaucauguucgacgcggcugucaugggcggacucgaugccaaagugcugcgcgccguucugcccaaggacaugguguuucggacaagcacccccagagucgugcucuga

SEQ ID NO: 2620 - RNA, 1710 nt, Artificial Sequence
  derived and/or modified CDS sequence (opt5) from Lassa virus__ANH09741__NP
augagcaacuccaaggaggugaaaucuuuccuguggacccagagccucagacgggaacuguccggcuacugcacaaauaucaaacuucaagucguuaaggacgcccaggcucugcuccacgggcuggauuuuucugaggugagcaacgugcagcgccuuaugagaaagcagaaacgggacgauaaugaccugaagcgccucagagaucugaaccaagccgucaauaaccugguggaacucaaguccguucagcagaaaucugugcugaaggucggaacgcuuaauagcgacgaucugcucacccuggcggcugaccuugagaaacugaaguccaaagugguucggacagaacgcccccucagcucuggcguguauauggggaaccuguccagccagcaacuggaucagagacgggcccuccugaauaugauuggaauggccggcgggucucagggaaaccagccuucccgcgacggcgucgugagagugugggaugucaagaaugcugaccuucugaacaaucaauucggcaccaugccgagccucacacuggccugucuuaccaagcaggggcagguugaucugaacgacguggugcucgcucugacagaccugggacucaucuacaccgccaaauaucccaauucuuccgaucuggaccggcuuagccaaaaccauccuguccugaacaugauugaugugaauaaguccucucucaacaucagcggcuacaauuuuucccugggggcggccguuaaagcuggagccugcaugcuugacggcgggaacaugcuggagacgauuaagaucagcccccagaccguggauggaauccucaaaucuauucugaaggucaaacgcgcucugggcauguucguguccgacacaccuggcgagagaaaucccuaugaaaacauccucuacaagguuugucugagcgggaauggauggccuuauauugccucucggaccagcaucgugggccgcgcgugggagaacacagucguggaucuugaauccaauaagaaccagccgaaagucgggaauaacggaucuaauaagaugcugcagagcuccggcuuugccaccgggcucacguacagccaacugaugacacugagagacucuaugcuucagcucgaucccaccgcuaaaacauggauugacaucgagggacggccugaggaucccguggaacuggcccuguuccagccuuccagcggcugcuacauucacuuuuucagagagcccaccgaccucaagcaguuuaaacaagacgcuaaguauucucauggcaucgauguuaacgaccuguucuccgcccagccggggcuuaccagcgccgugcuggaagcucucccucgcaauaugguccugacaugucagggauccgaugacauccggaagcugcuugauucucaggacagaaaagauauuaagcucaucgacauuagccuguccaaagcggaugcccgcaaguuugagaacgacgugugggaucaauucaaagaccugugccacaugcauacgggcaucguuguggaaaagaagaaaaagggagggaaacaggagaugacaccccacugugcucuccuggauugcauuauguuugacgccgccgucucuggcgggcuuaacgugccuacccugcgggcugugcuccccaccgacaugguuuucagaacaaucaccacgaaggucgugcuguga

SEQ ID NO: 2621 - RNA, 1713 nt, Artificial Sequence
  derived and/or modified CDS sequence (opt5) from Lassa virus__CAA36646__NP
augagcgccuccaaggaggugagaucuuuccuguggacccagagccuccggcgcgaacuguccggcuacugcucuaacaucaaacuucaagucguuaaggacgcucaggcccugcuccacgggcuggauuuuagcgagguguccaaugugcagagacuuaugcggaaacagaagcgcgacgauggagaccugaaaagacuccgggaucugaaccaagcggucaauaaccugguggaacucaagucuacacagcagaaaagcguucugcgcgugggcacgcuuuccagcgacgaucugcucauucuggcugccgaccuugagaaacugaagucuaaagucaccagaacagaacggccccucuccagcgggguguauaugggaaaucugucuucccagcaacuggaucagcgcagagcccuccugaacaugaucggcaugaccgggguuagcggaggcggcaagggggcuucugacggaauugugcgggucugggaugugaaaaaugccgagcuucugaacaaucaguucggcacaaugccuucccucacccuggcuugucuuacaaagcaggggcaaguggaccugaacgaugccguccaggcgcucaccgaccugggacugaucuacacggccaaguauccgaauagcuccgaccucgaucgccugucucagagccaucccauucuuaacaugaucgacaccaaaaaguccagccugaauaucucuggcuacaacuuuucccucggggcugccguuaaagcuggagccugcaugcuggauggcggcaauaugcuugagacaauuaaggugagcccucaaaccauggacgggauccugaaaucuauucucaaggugaaaaagagccugggaauguucgucuccgauacacccggcgaaagaaacccuuaugagaacauccuguacaagauuugucucucuggggacggauggcccuauaucgcgagccggaccuccauugugggccgcgccugggaaaauacgguuguggaucuggagcaggacaacaaaccucagaagaucgggaauggaggcagcaacaaaucucuucaguccgcuggcuuugccgcugggcugacauacagccaacucaugacccugaaggauuucaaaugcuuuaaucugaucccgaacgccaagacauggauggacauugagggaagacccgaagauccugucgagaucgcccuuuaccagcccucuuccggcuguuaugugcacuucuuucgggaaccuaccgaccucaagcaguucaaacaggacgcuaaguacagccaugggauugauguuaccgaccuguuugcggcccaacccggacugacauccgcugugaucgaggcccucccgagaaauauggucauuacgugccagggcucugaagauauccgcaaacugcuugagagccaggggcggagagacaucaagcugauugauaucacccucuccaaagccgacucucgcaaguucgagaacgcugugugggaucaguuuaaggaccugugucacaugcauacaggcgucgugguugaaaagaagaaacggggaggcaaggaggaaauuaccccucacugcgcccugauggauuguaucauguucgacgcggcugugagcgggggacuugaugccaaaguccucagagugguucugccccgcgacaugguguuccggacauccaccccuaaggucgugcuguga

SEQ ID NO: 2622 - RNA, 1710 nt, Artificial Sequence
  derived and/or modified CDS sequence (opt5) from Lassa virus__CCA30315__NP
augagcgccuccaaggaggugaaaucuuuccuguggacccagagccucagacgggaacuguccggcuacugcucuaacaucaaacuucaagucguuaaggacgcucaggcccugcuccacgggcuggauuuuagcgagguguccaaugugcagcgccuuaugagaaagcagcggcgcgacgauucugaccugaaaagacuccgggaucugaaccaagcggucaauaaccugguggaacucaagagcacacagcagaaguccguucugcgcgugggaacgcuuagcucugacgaucugcucacccuggcugccgaccuugagaaacugaaguccaaagucacaagaaccgaacggccccucagcucuggcguguauauggggaaucuguccagccagcaacuggaucagcgcagagcccuccugaaccuuauuggaaugacaaauggcucucaggggucccaggcuggacgggacggcguugugcgcgucugggaugugaagaacgccgagcugcucaauaaccaauucggcaccaugccuagccugacacuugcuugucugaccaaacagggacagguggaccucaaugaugucguucaagcccugacggaccuggggcucaucuacaccgcgaaguauccgaacacauccgaccuggauagacuuacccagucucaucccauucugaauaugaucgacacaaagaaaagcucccucaacauuagcggcuacaauuuuucucugggggccgcugugaaggccggagcuugcaugcuugauggcgggaacaugcuggagaccaucaaaguguccccucagagcauggacggaauccucaagucuauucugaaagucaagcgggcccugggcauguucgugagcgauacgcccggcgaacgcaacccuuaugagaauauccucuacaaaauuugucuguccggggacggauggcccuauaucgcgucuagaacaagcauuguuggccgggccugggaaaacaccguggucgaucuugagacagacgggaagccucagaagaucggauccggcaauagcaacaaaucucugcaauccgcuggguuuagcgccggacucaccuacucucagcugaugacccugaaggaugcuaugcuucagcucgacccgaaugccaaaacauggauggauauugagggcagacccgaagacccuguggagguugcccuguaccagcccaucuccggcugcuauauccacuucuuucgcgaaccuacggaccugaagcaauucaaacaggaugcuaaguacagccaugggauugacaucgcggaucucuuugccgcucagcccggacugaccuccgccgugauugaggcccuuccgcggaacauggucaucacaugucagggcucugaagacauuaagaaacugcucgagagccaagggagaaaggauaucaaacugaucgacauugcucuguccaagaucgauucucgcaaauucgagaaugccgugugggaccaguauaaggaucuuugccacaugcauaccggagucgugguugaaaagaaaaagcggggcgggaaagaggaaauuacaccucacugugcgcucauggacugcaucauguuugaugcugccgugagcggcggacugaacacccugguccucagagccgugcugccccgcgacaugguuuuccggacguccacaccuagagugguccuuuga

SEQ ID NO: 2623 - RNA, 1710 nt, Artificial Sequence
  derived and/or modified CDS sequence (opt5) from Lassa virus__JX985061__NP
augagcgccuccaaggagaucaaaucuuuccuguggacccagagccucagacgggaacuguccggcuacugcucuaacauuaaacuucaaguggucaaggacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacugagaagcaagguuauccggacagagcgcccccucucugccggcguguauauggggaaccuguccagccagcagcuggaucagagacgggcucuccugaauaugauuggaaugucuggcgggaaccagggagcccgcgcuggcagagacggcgucgugcggguuugggaugugaaaaaugccgagcuucuguccaaccaguucgggaccaucccuagccucacacuggcgugucuuaccaagcagggacaagucgaccugaaugaugccgugcaggcucucacagaccugggccugaucuacaccgccaaauauccgaacacgucugaccucgaucgccugacccagucccaucccauucuuaauaugaucgacacaaagaaaagcucccugaacauuucuggguacaauuuuagccucggagcugccgugaaggcgggcgccugcaugcuggaugggggaaacaugcuugaaaccaucaaggucuccccucaaacaauggacggcauucugaaaagcauccucaagguuaaaaaggcucugggcauguucauuucugauacccccggggagagaaacccuuaugaaaauauccuguacaaaaucugucucuccggagacggcuggcccuauauugccagccggacgucuaucacagggagagcuugggagaacaccgugguggaucuggagagcgacggaaagccucagaaggccgauuccaauaacucuagcaaaucccuucagagcgccggcuuuacagcugggcugaccuacucucagcucaugacccugaaggacgcgaugcugcaacuugauccgaaugccaaaacauggauggacauugaaggacgccccgaggacccugucgaaaucgcucucuaccagcccuccagcggcugcuauauucacuucuuucgggagccuacggaucugaagcaguucaaacaggacgccaaguacucucauggcaucgaugugaccgaccuguuugccacacaacccgggcucaccuccgcuguuaucgaugcccugccgagaaacauggugauuacaugucagggaagcgacgauauccgcaaacuucuggaaucccagggccggaaggacauuaagcucaucgauauugaccugucuaaaaccgauagcagaaaguaugagaaugcggucugggaccaguacaaagaucugugccacaugcauacgggggugguuguggagaagaagaaacgcggaggcaaggaagagaucacaccucacugugcucuuauggacugcaucauguucgacgccgccgucuccgggggccucaacaccucugugcugcgggcuguccugcccagagauaugguguuucgcaccagcacaccucggguugugcucuga

SEQ ID NO: 2624 - RNA, 1710 nt, Artificial Sequence
  derived and/or modified CDS sequence (opt5) from Lassa virus__NP_694869__NP
augagcgccuccaaggagaucaaaucuuuccuguggacccagagccucagacgggaacuguccggcuacugcucuaacauuaagcugcaaguggucaaagacgcucaggcccugcuccacgggcuggauuuuagcgagguuuccaaugugcagcgccuuaugagaaaggaacggcgcgacgauaacgaccugaaaagacuccgggaucugaaucaggcggugaacaaucuggucgagcucaagucuacacaacaaaagagcauccugcgcgugggaacgcuuaccuccgacgaucugcucauucuggcugccgaccuugaaaaacuuaagagcaaaguuaucagaacagagcggccccucucugccggcguguauauggggaaccuguccagccagcagcuggaucagcgcagagcucuccugaauaugauuggaaugucuggcgggaaccagggagcccgggcuggccgcgacggcgucgugagaguuugggaugugaagaaugccgagcuucugaacaaucaguucgggaccaugccuucccucacacuggcgugucuuaccaaacagggacaagucgaccugaacgaugccgugcaggcucucacagaccugggccugaucuacaccgccaaguauccgaauacgagcgaccucgaucggcugacccagucucaucccauccuuaacaugauugacacaaagaaauccagccugaauaucuccggguacaacuuuucucucggagcugccgugaaggcgggcgccugcaugcuggaugggggaaacaugcuugaaaccauuaaagucagcccucaaacaauggacggcauccugaaguccauucucaaaguuaagaaagcucugggcauguucaucagcgauacccccggggagcgcaauccuuaugaaaacauucuguacaagaucugucucucuggagacggcuggcccuauaucgccuccagaacgagcauuacagggcgggcuugggagaauaccgugguggaucuggagucugacggaaagccucagaaagccgauagcaacaauuccucuaagagccuucaguccgccggcuuuacagcugggcugaccuacagccagcucaugacccugaaagacgcgaugcugcaacuugauccgaacgccaagacauggauggacaucgaaggaagacccgaggacccugucgaaauugcucucuaccagcccucuuccggcugcuauauccacuucuuucgcgagccuacggaucugaaacaguucaagcaggacgccaaguacagccauggcauugaugugaccgaccuguuugccacacaacccgggcucaccucugcuguuaucgaugcccugccgcggaauauggugaucacaugucagggauccgacgauauuagaaaacuucuggaaagccagggccgcaaggacaucaaacucauugauaucgcgcuguccaagaccgacucucggaaauaugagaacgcugucugggaucaguacaaggaccugugccacaugcauacgggggugguuguggagaagaaaaagagaggaggcaaagaagagauuacaccucacugugcccuuauggauugcaucauguucgacgccgcugucagcgggggccucaauaccuccgugcugcgcgccguccugccccgggacaugguguuuagaaccucuacaccucgcguugugcucuga

SEQ ID NO: 2625 - RNA, 1710 nt, Artificial Sequence
  derived and/or modified CDS sequence (opt5) from Lassa virus__SCA79106__NP
augagcaacuccaaggaggugaaaucuuuccuguggacccagagccucagacgggaacuguccggcuacugcucuaauaucaaacuucaagucguuaaagacgcccaggcucugcuccacgggcuggauuuuagcgagguguccaacgugcagcgccuuaugagaaagcagaaacgggacgauggagaccugaagcgccucagagaucugaaucaagccgucaacaaucugguggaacucaagucuguucagcagaaaagcauucugcgggugggcacacuuacguccgacgaucugcucacccuggcggcugaccuugagaagcugaaaagcaaggucacacgcaccgaaagaccccucucuuccgggguguauaugggaaaccugagcucucagcaacuggaucagcggcgcgcccuccuguccaugaucggcaugagcgggggaaaucagaacucucagccuaaaggcgacggcguugugagagucugggaugugaagaaugccgaccuucugaacaaucaauucgggacaaugccgucccucacccuggcuugucuuacaaagcagggacagguggaucugaacgacgccguccaagcucucaccgaccugggccugauuuacacggccaaauaucccaauagcuccgaucucgaccggcugucucagagccauccuauccuuaacaugauugauaccaagaaauccagccugaauaucucuggguacaacuuuucccucggagcggccaucaagacaggcgcuugcaugcuggacgggggaaacaugcuugagaccauuaaaguuacaccccagaccauggauggcauccucaagagcauucugaaagugaagcgcucucugggcauguucaucagcgacacgccuggggagagaaaucccuaugaaaacauucuguacaagaucugucucuccggagauggcuggccuuauauugccucucggacagcuaucaucgggcgcgccugggagaauaccguggucgaccuggaaagcgauuccaaaccgcagaagauuggaagcaacggcucuaauaaaucccuucaaagcgcgggguuugcccccggacugacauacucucagcucaugacccugaaggacuccaugcugcagcuugauccuaacgcuaaaaccuggaucgacauugagggcagacccgaggacccuguggaaguugcccucuuccagcccaucagcggcugcuacauucacuuuuuccgggagccgacagaucugaagcaauuuaagcaggacgcuaaauauucccaugggaucgaugugacggaccuguucgccgcccagccuggacucaccucugcugucaucgaagcgcugcccagaaauauggugcuuacaugucagggcagcgaugacauuaagaaacugcucgauucccaagggcgccgggacaucaagcugauugauguuucucugaacaaaaucgacagcagaaaguuugagaaugccgugugggaucaguacaaggaccuuugccacaugcauaccggagucguggucgaaaagaagaaaaagggcgggaaagaggagauuacaccucacugugcucuccuggauugcaucauguucgacgccgccguguccggcggacugaacgcuaccguucuccgcgccgugcugccccgggacauggucuuuagaacgagcucucccaaggugguucuuuga

SEQ ID NO: 2626 - RNA, 1473 nt, Artificial Sequence
  derived and/or modified CDS sequence (opt6) from Lassa virus__AAF86703__GPC
augggacaaauaauaacauuuuuccaagaaguuccacacgucauagaagaaguaaugaauauaguacuaauagcacuaucacuucuagcaauucuaaaaggaauauacaacguagccacuugcggacucuucggcuuaauaagcuuccucuuauuaugcggaagaucuugcucugucaccuauaaaggagucuacgaauuacaaacauuagaacuaaacauggcaaaccuaaacaugacaaugccccuaucaugcacaaaaaauaacucacaucacuacaucaugguaggaaacgaaacaggacuagaauuaacucuaacaaauacaucaauaauaaaucacaaauuuugcaacuuaucagacgcucacaaaaaaaaucuauaugaucacgccuuaaugucaauaauaucaaccuuccacuuaucaauaccuaacuucaaccaauacgaagcaauguccugcgauuucaauggaggcaaaauaucaguacaauacaacuuaucacacucauucgcaguagacgcagccaaccacugcgguacaauagccaauggugucuuacaaacauucaugcgcauggccugggguggcucauacaucgcauuagacagcggaaaagguaauugggacugcauaaugaccucauaucaauacuuaauaauccaaaacacaacaugggaggaucacugccaauuuuccagacccucucccauaggauaccuaggacuccucucacaaagaaccagagacauauacaucucaagaagacuacuaggaacuuuuacauggacauuauccgacagcgaaggcaaugaagcaccaggaggauauugccuaaccagauggaugcuaaucgaagcagaacuaaaaugcuucggaaacacagcaguagccaaaugcaacgaaaaacaugacgaagaauucugcgacaugcuacgacuauucgacuucaacaaacaagccauaaaaagacuaaaaacagaagcacaaaugagcauacaacuaaucaacaaagcaguaaaugcacuaauaaacgaccaacucaucaugaaaaaccaccuaagagauauuaugggaauuccauauugcaauuauucaagauacugguaucucaaccacacagucaccggcaaaacaucccuaccaagaugcuggcuaguaucaaacggaucauaucuaaaugaaacacacuucucagaugacauagaacaacaagccgauaacaugauaacagaaaugcuacaaaaagaauacauggaccgacaaggaaaaacaccacuaggauuagucgauuuauucguauucuccacaucauuuuaucuaauaucaaucuuccuacacuuaguaaaaauaccuacacacagacacauaguagguaaaccaugcccaaaaccacacagacucaaccacauggguauauguucuugcggacuauacaaacauccaggcguaccaguaaaauggaaaagauaa

SEQ ID NO: 2627 - RNA, 1476 nt, Artificial Sequence
  derived and/or modified CDS sequence (opt6) from Lassa virus__AAG41802__GPC
augggucaaauaguuacauucuuucaagaaguaccccacguaaucgaagaaguaaugaacauaguauuaauagcacuaucaauuuuagcaguucuaaaaggacuauacaacauagcuacauguggacuaauaggacuaauaacuuuccuauuacucugcggcagauccuguuccucaaaccuuuacaaaggaguauacgaacuacaauccuuagacuuaaacauggaaacacuaaauaugacaaugccacuauccugcacaaaaaacaacucacaucacuacauaagaguaggaaaugacaccgguuuagaacuaacacuaacaaauacaucaauuuuaaaucauaaauucuguaaucucucagaugcacauaaaaaagacuuauacgaccaugcacuaaugucaauaauaucaacauuccaucucucuauaccaaauuucaaccaauaugaagcaauguccugcgacuuuaacggaggaaaaauaucaguccaauacaaccuaucacacucauacgcgauagacgcagcaaaccacugugggacaguagcaaauggaauauuacaaacauuuaugcgcauggcauggggcggaucuuacauagcucucgauucuggccgaggaaauugggauugcauaaugacaucauaucaauaucucauaauacaaaacacaacaugggaaaaucauugccaauuuucaagaccaagucccauaggauaccuaggacuacuaucacaaagaacaagagacauauacauaucuagaagacuacuaggaacauucacauggacuuuauccgacagugaagguaacgcaacaccaggaggcuacugccuaacaagauggauguuaauagaagcagaauuaaaaugcuuuggaaauacagcaguagccaaauguaacgaaaaacacgaugaagaauuuugcgacauguuaagacuauuugacuucaauaaacaagcaauaucaagacuaaaaagcgaagcacaaaugucaauccaauuaauaaacaaagcaguaaacgcacuaaucaaugaccaauuaauaaugaaaaaccaccucagagacauaaugggaauacccuauugcaauuacucuaaauacugguacuuaaaccacacaauaaccggaaaaacaucacuaccaaaauguuggcugguguccaaugguucauaccuaaacgaaacacauuucagcgacgauauagaacagcaagccgacaauaugauaacagaaauguuacaaaaagaauauauggaaagacaaggcaaaacaccacuaggacuuguagacuuauucguauuuucaacaucauucuauuuaauaucaauauucuuaagacucguaaaaaucccaacacauagacacauaguaggaaaaccauguccuaaaccccaucgauuaaaucacaugggaauaugcucauguggauuauacaaacaaccaggcguucccguccgauggaaacgauaa

SEQ ID NO: 2628 - RNA, 1473 nt, Artificial Sequence
  derived and/or modified CDS sequence (opt6) from Lassa virus__AAL13212__GPC
augggacaaaucguaacauucuuccaagaaguaccacacgucauagaagaaauaaugaauauaguacuaaucacauuaagcuuacuagccauacucaaaggcguauacaaucuugcaacaugcggacuaauaggucuaauaaccuuccucuuccuaugcggaagaucuugcucaaugacauacaaaggauccuaccaauuagaaacacucgaauuaaacauggaaacacucaacaugaccaugccccuaucaugcacaaaaaacacaucacaucauuacauuagaguuggaaaugaaacaggauuagaacuaacacuaacaaauacaucaauaauaaaccacaaauucuguaaucuauccgaugcacacaaaaaaaauuuauacgaccauucacuuaugucaauaauaagcacauuccauuuaucaaucccaaacuucaaucaauaugaagcaaugucaugcgacuuuaacggaggcaaaauaucgauacaauauaaccuaucacacacauaugcaggcgaugcagcaaaacacuguggaacacuugcuaauggaauacuccaaaccuuuaugagaauggcauggggaggaucauauauagcacuagacucaggaagaggaaauugggacuguauaaugacauccuaccaauaccucaucauacaaaauacuacaugggaagaucauugccaauucagcagaccauccccaauaggauaucuaggauuacuaucucaacgaacaagagaaaucuacauauccagaagacuacuaggaacuuucacauggacauuaucagacucagaaggaaacgaaaaucccggaggauauugccuaacacgauggaugcuaauagaagcagaacuaaaaugcuucggaaacacugcugucgcaaaauguaaugaaaaacacgacgaagaauuuugcgacauguuaagacucuuugauuucaacaaacaagccauacaaagauuaaaagcagaagcacaaaugucaauacaauuaaucaacaaagcaguaaacgcacuaauaaaugaccaacuaauaaugaaaaaccaccuacgagacauaaugggaauaccauacugcaacuacucaaaauauugguaucuaaaccacacaacaacagguagaacuagcuuaccaagaugcuggcuaguaucaaacggaucauacuuaaacgaaacaagauuuucagacgacauagaacaacaagcagacaacaugauaacagaaaugcuacaaaaagaauacauugacagacaaggaaaaacaccacucggacuaguagauuuauucguauucuccaccucuuucuaucuaauuucaauauuccuacacuuaauaaaaauaccaacacacagacacaucguaggaggaccauguccaaaaccacacagacuaaaccauaaaggaauauguuccugcggauuguauaaaagaccaggaguaucaguaagauggaaaagauaa

SEQ ID NO: 2629 - RNA, 1476 nt, Artificial Sequence
  derived and/or modified CDS sequence (opt6) from Lassa virus__AAO59512__GPC
augggacaaauaguaacauucuuccaagaagucccacacguaauagaagaaguaaugaacaucguacucauagcauuaucaauacuagcaguccuaaaaggacuuuacaacuucgcaacuugcggccuaguaggacuuguagcauucuuauuauuauguggaagaagcugcacaucaucccuauacaaaggaguauacgaacuacaaacacucgaacuaaacauggaaacacuaaacaugacaaugcccuuaucaugcacuaaaaacaacucacaccauuacauaagaguaggaaacgaaacaggacuagaacucacacuuacuaauacaucuauaauuaaccacaaauuuuguaaccuuucagacgcucacaagaaaaaccuauacgaucaugcauuaaugucaaucauuucgacauuucaccuaucaauacccaauuucaaccaauacgaagcaauguccugcgacuuuaacggaggaaaaauaucaguacaauacaaccuuucacacucauacgcaguagacgcagcuaaacauugcggaacaguugccaacggaguacuccaaacauuuaugcgcauggcauggggaggauccuacauagcauuagacucaggucauggaagaugggacugcauaaugaccucauaccaauacuuaaucauacaaaauaccacaugggaagaucacugucaauuuucaagaccaucaccaaucggcuacuuaggauuacuuucacaaagaacaagagacaucuauaucucuagacgcuuauuaggaacauucaccuggacauuauccgauucagaagguaaagauacaccaggagguuacugucuaacaagauggaugcuaauagaagcagaacucaaaugcuuugggaacacagcuguagcuaaauguaacgaaaaacacgacgaagaauuuugcgacauguuaagauuauucgauuucaauaaacaagcaauccaaagacuaaaaaccgaagcacaaaugucuauacaauuaauaaacaaagcagucaaugccuuaauaaacgaccaacuaauaaugaaaaaccauuuaagagauaucaugggaauaccauauuguaacuauucaagauauugguaucuaaaccacacaacaacaggaaaaacaucauuaccaaaauguuggcucguaaguaacgguucauacuuaaacgaaacaagauucucagacgauauagaacaacaagccgacaacaugauaacagaaaugcuacaaaaagaauacauggaaagacaaggaaaaacaccccuggguuuaguagacuuauucguauucagcacaucauucuaccuuauaucaauauuccuacaccuaguaaaaauaccuacacauagacacauaguuggaaaaucaugcccaaaaccccaccgauuaaaccacaugggcauuuguaguugcggacucuacaaacaaccuggaguuccaguaaaauggaaaagauaa

SEQ ID NO: 2630 - RNA, 1476 nt, Artificial Sequence
  derived and/or modified CDS sequence (opt6) from Lassa virus__AAT49000__GPC
augggacaaauaguaacauucuuccaagaagucccacacguaauagaagaaguaaugaacauaguacuuauagcacuaucaaucuuagccguauuaaaaggacuauacaauguagcaacaugcggacucauaggauuaguaacauuccuauuccuauguggaagaucauguucaaccucauuauacaaaggaguuuaugaacuacaaacucucgaauuaaacauggaaacauuaaacaugacaaugccacuauccugcacaaaaaauaauagucaccacuacauaaugguagggaacgaaacaggacucgaauuaacacuuacuaacaccuccauaauaaaccacaaauucugcaaccuuagcgacgcacacaaaaaaaacuuauacgaccacacacuaaugaguauaauaucaacauuccaccuaucuauaccaaacuucaaucaauacgaagcaaugagcugugacuucaaugguggcaaaauaucaguacaauacaaccucucccacucauacgcaguagaugcagcaaaccauugcggaacaguagcaaacggcguacuacaaacauucaugagaauggcauggggaggaucuuacaucgcacuagacucaggacguggaaauugggauugcaucaugacaucauaccaauaccuagucauacaaaacacaacaugggaagaccauugccaauucagccgaccauccccaauaggauaccucgguuuacucucccaaagaacaagagacaucuacauaagcagacgccuccuaggaaccuucacuuggacacuaagcgacucagaaggcaaagacacaccaggaggauacuguuuaacuagauggaugcuaauagaagcagaauuaaaaugcuucgguaauacagccguagcaaaaugcaacgaaaaacacgaugaagaauucugugauaugcuacgacuauucgacuuuaauaaacaagccauacaaagacuaaaagcagaagcacaaaugaguauacaacuaauaaauaaagcuguuaacgcacuaauaaacgaucaacuaauuaugaaaaaccaccuaagagacaucaugggaauaccguacuguaauuacuccaaauacugguaccucaaccacacaguaacaggaaaaacaucacuaccaaaauguuggcuaguaagcaauggcuccuacuuaaacgaaacacauuucucugacgacaucgaacaacaagcggacaaccuaaucacagaaaugcuacaaaaagaauauauggaaagacaagggaaaacaccacuaggacuaguugaccuauucgucuucucaacuuccuucuacuuaauaucuauauucuuacauuuagucaaaauacccacacaccgacauauaguaggaaaaccauguccaaaaccacacagauuaaaccacaugggaauauguagcuguggaguauacaaacaaccaggagucccaguuagguggaaacgcuaa

SEQ ID NO: 2631 - RNA, 1476 nt, Artificial Sequence
  derived and/or modified CDS sequence (opt6) from Lassa virus__AAT49004__GPC
augggacaaaucguaacauucuuccaagaaguaccacacgucauugaagaaguaaugaacauaguauuaauagcauuaucaguccuagcaguacuaaaaggacucuauaacuucgcaacaugcggucuaguaggccuagucacauuccuacuacuuugcggacgcucaugcacaacaucccucuauaaaggaguauaugaauuacaaacacuagaacuaaacauggaaacucuaaacaugaccaugcccuuauccugcaccaaaaauaacucacaccacuacauaauggucggaaaugaaacaggucuagaacucacacuaacaaacacaucaauaauaaaccauaaauucuguaaucuauccgaugcacacaagaaaaaucucuacgaucacgcacuaaugucaauaaucucuaccuuccaccuauccauacccaauuuuaaccaauacgaagccauguccugcgauuucaauggcggaaaaaucagcguacaauacaaccucucccauuccuacgcaggagacgcagcaaaucacugcggaacuguagcaaacggcguacuacaaacauucaugagaauggcauggggugguucauauauagcucuagauucuggaagaggaaauugggacugcauuaugacuucauaucaauauuuaauaauacaaaauacaacaugggaagaccacugccaauuuuccagaccaucaccaauaggauaccuaggacuacucucacaaagaacacgagacauauacauaucaagaagacuacuugguaccuuuaccuggacccuaucagacucagaagguaaagauacacccggaggauacugccuaacaagauggaugcucauagaagcagaacuuaaaugcuucggcaacacagcaguugcuaaauguaacgaaaaacacgacgaagaauuuugugacauguuacgauuauuugauuuuaacaaacaagcuauacaaagauuaaaagccgaagcacaaaugucaauacaacuaauaaauaaagcuguaaacgcacuaaucaaugaccaacuaauuaugaaaaaucaccuaagagacauuaugggcauaccauacugcaacuacucaaaauacugguaucucaaccacacaacaacaggacgaaccucauuaccaaaaugcuggcuuguaucaaacgguucauaccuaaaugaaacccauuucuccgacgacauugaacaacaagcagacaauaugauaacagaaauguuacaaaaagaauacauggaaagacaaggaaaaaccccauuaggucuaguagaccuauuuguuuucucuacauccuucuauuuaauaucaauauucuuacaccuaguaaaaauacccacacacagacacauaguaggaaaauccuguccaaaaccccacagacuaaaccacaugggaauaugcucuuguggacuauauaaacaaccaggaguaccaguaaaauggaaaagauaa

SEQ ID NO: 2632 - RNA, 1476 nt, Artificial Sequence
  derived and/or modified CDS sequence (opt6) from Lassa virus__AAT49008__GPC
augggacaaauaguuacauucuuucaagaagucccccacguaauagaagaaguaaugaacauaguauuaauagcacucucuauacuagcaguccuaaaaggauuauacaacguagcaacaugcggacuaauaggauuaguaacuuuccuuuuuuuaugcggaagauccugcucaaccacauuauacaaaggaguauacgaacuacaaacauuagaguuaaacauggaaacacuaaacaugacaaugccauuaucauguacaaaaaacaacucacaccacuacauuaugguaggaaacgaaaccggauuagaacuaacauuaacaaacacaucaauaauaaaucacaaauucuguaaccucuccgacgcccacaaaaaaaauuuauacgaccauaccuuaaugucaauaauaucaacauuccaccuaucaauaccaaacuuuaaccaauacgaagcaaugucaugcgacuucaacggaggaaaaauaucuguucaauauaaccuaucacacucauacgcaguugacgcagcaaaccacuguggaacaguagcaaacggaguccuacaaacuuucaugagaauggccugggguggaucauauauagcauuagacucaggacgaggaaauugggauugcauaaugacaucauaucaauaccuaauaauacaaaauacaaccugggaagaucacugccaauucucaagaccauccccaaucggauacuuaggauuacuaagccaacgaacacgagauauauauauaucaagaagacuacuaggaacauuuacuuggacucuuucugacucagaaggaaaagacacaccaggaggauauugccuaacacgauggauguuaauagaagcagaacuaaaauguuuuggcaauacagcaguagcaaaaugcaaugaaaaacacgacgaagaauucugcgauauguuacgacucuucgacuucaacaaacaagcaauacaacgacucaaagcagaagcacaaaugucuauacaacucauaaauaaagcaguaaacgcacuaaucaaugaccaacuaaucaugaaaaaucauuuaagagacaucaugggaauccccuauugcaauuacucccgauacugguaccuaaaccacacaguaaccggaaaaacaucacuaccaaaauguugguuagucuccaacgguucauaucuaaaugaaacacauuuuucagaugacauagaacaacaagcagacaaccucauaacagaaauguuacaaaaagaauacauggaaagacaaggaaaaacaccacuaggauuaguagacuuauucguauucuccacuucauuuuaucuaauaucuaucuucuuacaccuuguaaaaauuccaacacauagacauauuguuggaaaaccguguccaaaaccucacagacuaaaucacauggguauauguucuugcggaguauauaaacaacccggcguuccaguaagauggaaaagauaa

SEQ ID NO: 2633 - RNA, 1473 nt, Artificial Sequence
  derived and/or modified CDS sequence (opt6) from Lassa virus__AAT49010__GPC
augggacaaauaguaacauucuuccaagaaguaccacacguaauagaagaaguaaugaacauaguauuaauagcacuaucaguucuagcaauacuaaaaggauuauacaauuucgcaacuugcggccuaauaggacuuguuacauuuuuacucuuaucaggaagaucaugcucuaugaucuacaaaggagucuaugaacuacaaacauuagaauuaaauauggaaacacuaaacaugaccaugccacuuucauguaccaaaaacacaucacaccacuacauacgaguaggaaacgacacaggacuagaacucacacuaacaaacgaaacacuauuacaccacaaauucugcaaucuaucagacgcacacaaaagaaaccucuacgaucacgcacuaaugucaauaauaucaacauuucacuuaucaauccccaacuucaaccaauacgaagcaaugucaugugacuuuaauggcgguaaaauaaccguacaauacaacuuaucacacucauaugcaguagaugccgccaaacauugcggaaccguagccaacggcguacuccaaacauuuaugagaauggcauggggaggaucauacaucgcacuagacuccagacacggaaacugggauugcauaaugacuucauaccaauaccucaucauacaaaacaccacaugggaagaucacugucaauuuucacgaccaucucccaucggauaucuaggacuauuaucacaaagaacacgagacaucuauauauccagaagacuacuuggcacauucacauggacauuaucagacucagaaggaaacgaaacaccaggaggcuacugcuuaacuagauggauguuaauugaagcagaacuaaaaugcuucggaaacacagcagucgcaaaaugcaacgaaaaacaugacgaagaauuuugcgacauguuacgacuauucgauuucaauaaacaagcaauaagaagauuaaaaacagaagcacaaaugucuauacaacuaauuaacaaagccguaaaugcucuuaucaaugaccaacuaauaaugaaaaaucaccuuagagauauaaugggaauaccauacugcaacuauuccaaauacugguaccuaaaccacacaucaacaggaaaaaccucuuuaccaagaugcugguuagucucaaacgguucauaccucaacgaaacacacuuuucagacgacauagaacaacaagcagauaauaugauaaccgaaaugcuacaaaaagaauaucuagauagacaaggcaaaacaccacucggccuaguagauuuauucguauucucaaccucuuuuuaucuaauauccauauuucuacaucuaaucaaaauaccuacacacagacacaucguaggaaaaccaugcccaaaaccacauagacucaaccauaugggaauaugcuccuguggcuuauacaaacaaccaggaguaccaguaagauggaaaagauaa

SEQ ID NO: 2634 - RNA, 1473 nt, Artificial Sequence
  derived and/or modified CDS sequence (opt6) from Lassa virus__AAT49014__GPC
augggacaaauaauaacauuuuuccaagaaguaccgcacguaauagaggaaguaaugaacauagucuuaauagccuugucauuauuagcaauauuaaaaggacucuauaauaucgcaacaugcggaauaauaggauuaguagcauuccuauuucuaugcggaaaaucauguucauuaacacucaaaggaggcuaugaacuccaaacccuagaacucaacauggaaacccuaaacaugacaaugccacucucaugcacuaaaaauucaucucaccacuacauaagaguuggaaacgaaaccggccuagaacuaacacucacaaacacauccauaauaaaccauaaauucuguaaccuaucagacgcacacaaaaaaaacuuauacgaucacgcauuaaugucaauaauauccaccuuucaucuaucgauaccuaacuucaaccaauacgaagcaaugucaugcgacuuuaacggagguaaaauaucaguacaauacaauuuaucacauaguuacgcaggugacgcagcugaacauugcggcacaguugcaaacggaguacuacaaacuuucaugcgaauggcuuggggaggaagauacauugcacuagauuccggaaaaggaaauugggacugcauaaugacaucuuaccaauaucuaauaauccaaaacacaacaugggaagaccacugccaauuuucaagaccaucaccaaucggauaccucggauuacuaucacaaagaacaagagauaucuacauaucacgcagauuacuagguacauuuacauggacccuaucagacuccgaaggaaacgaaacaccaggaggcuacugccuaacaagauggaugcuaauagaagcagaacuaaaaugcuucggaaacacagcaguagcaaaaugcaacgaaaaacaugacgaagaauuuugcgauaugcucagacuauuugauuuuaacaaacaagcaauaagaagauuaaaagcagaagcacaaauguccauacaauuaauaaacaaagcaguaaacgcauuaauaaacgaucaacuaauaaugaaaaaccaccuaagagacauaaugggaauaccauacugcaauuauucaaaauacugguacuuaaaccauacaucaucaggacgaacaucauuaccaaaaugcugguuaauaucaaacggaucuuaccuaaacgaaacccaauuuucagacgacaucgaacaacaagccgaccacaugaucacagaaaugcuacaaaaagaauauauagaacgacaaggaaaaacuccacucggucuaguagacauauuuauauucuccacaucauuuuaccuaauauccaucuuccuccaccuaauaaaaauaccaacacacagacacaucguaggcaaaccuuguccuaaaccccaccgauuaaaccacaugggagucuguucaugcggacuauacaaacacccagguguaccaacaaaauggaaaagauaa

SEQ ID NO: 2635 - RNA, 1476 nt, Artificial Sequence
  derived and/or modified CDS sequence (opt6) from Lassa virus__AAV54104__GPC
augggacaaauuguuacauucuuucaagaaguaccacacguaauagaagaagucaugaacauaguccuaauagcacuauccguccuagcaguauuaaaaggacuauacaauuuugcaacaugcggacuugucggucuaguaacauuccuauuacuaugcggacgcucaugcacaacaucauuauauaaaggagucuacgaacuacaaacacuagaacuaaauauggaaacacuaaacaugacaaugccacuaucaugcaccaaaaauaauucacaucacuacauaaugguagguaaugaaacaggacuagaauuaacauuaacaaacacaucuauaauaaaccacaaauucugcaaccuaucugaugcccacaagaaaaacuuauacgaccaugcacuaaugucaaucauaucaacauuccaccuaucaauaccaaacuucaaucaauacgaagcaaugucaugcgacuuuaacgguggaaaaauauccguacaauacaaccuaucucacaguuaugcaggagacgcagcaaaccacugcggaacaguagcaaauggaguauuacaaacauuuaugagaauggcauggggaggcucauauauagcacuagacucuggucgaggaaauugggauuguauaaugacaucauaccaauacuuaauaauacaaaacaccaccugggaagaccacugccaauuuucaagaccaucacccauaggcuaccucggacuacuuucccaacgaacuagagauauauauauauccagaagacuauuaggaacauucaccuggacauuaagcgacucagaaggagaagauacaccaggaggauacugucuuacaagauggauguuaauagaagcagaauuaaaaugcuuuggaaauaccgcaguagcaaaaugcaacgaaaaacacgaugaagaauuuugugacaugcucagauuauucgacuucaacaaacaagcaauucaaagacuaaaagcagaagcacaaaugucaauccaacuaauaaauaaagcaguaaacgcacuaauaaacgaucaacuaaucaugaaaaaccauuuaagagacauaaugggaaucccauacuguaauuauucaaaauauugguauuuaaaccacacaacaacaggaagaacaucauuacccaaaugcuggcuaguaucaaacggaucuuaucuaaacgaaacacacuuuucagacgacauagaacaacaagcagacaacaugauaacagaaaugcuacaaaaagaauacauggaaagacaaggaaaaacaccucuuggccuaguagaucucuucguuuucagcacaaguuucuaccuaauaucaauauuucuccaccuaguaaaaauacccacucauagacauaucguuggaaaaucaugucccaaaccucaccgacucaaucacaugggaauauguucauguggacuauacaaacaaccuggaguccccgucaaauggaaaagauaa

SEQ ID NO: 2636 - RNA, 1476 nt, Artificial Sequence
  derived and/or modified CDS sequence (opt6) from Lassa virus__ADI39451__GPC
augggccaaauaguuacauuuuuucaagaaguaccccacguuauagaagaaguaaugaacauaguacuaaucgcccuaucuguccuagccguacuaaaaggacuauacaacguagcaacaugcggacuaauaggucuaauugccuuucuccuacucugcggaagaucaugcacaacaacucucuauaaaggagucuacgaauuacaagcauuagaauuaaauauggaaacauuaaacaugacaaugccacuuuccuguacaaaaaacaacucacaccacuauauaauggucggaaacgaaacaggccuugaacucaccuuaacaaacacuagcauaaucaaccacaaauuuugcaaccuaucagacgcccauaaaaaaaacuuauacgaccacgcacuaaugucuauaauaucaacauuccaccuuuccauaccuaacuucaaccaauaugaagcaaugucaugcgacuucaauggaggaaaaauauccguucaauacaaucuaucacacacauacgcaguagacgcggcaaaccacugcgguacaguugccaauggaguauuacaaacauuuaugagaauggcauggggcggcucauauaucgcacuagacagcggaagaggaucaugggauugcauaaugacuucauaucaauacuuaauaauacaaaacacaacaugggaagaucacugccaauucuccagaccaucaccaaucggcuaccuaggauuacucucacaaagaacaagagacauauacauaucaagacgacuacuaggaacauuuacauggacacuauccgauucagaaggaaaagacacaccaggagguuacugccuaacacguuggauguuaauagaagcagaauuaaaauguuucggaaacacagcaguggcaaaaugcaacgaaaaacacgacgaagaauucugcgauaugcuaagacuauucgacuucaacaaacaagcaauacaaagacuaaaagcagaagcacaaaugucaauacaauuaaucaacaaagcagucaacgcacuaauaaaugaccaacuaauaaugaaaaaccacuuaagagacauaaugggaauaccauacugcaauuauuccaaauacugguacuuaaaccacacuauaacaggacgaacaucacuaccuaaauguugguuaguaagcaacggaucauaccuaaacgaaacucauuucucagacgacauagaacaacaagcagacaacaugauaacggaaauguuacaaaaagaauacauagaaagacaaggcaaaacuccacuaggacuaguagaccucuuuguauucucaacaucauucuaucuaauaucaaucuuucuacaccuaauaaaaauaccaacacacagacacauaguaaauaaaccuuguccaaaaccacauagacucaaucacaugggaguaugcucaugcggccuauacaaacaacccggaguaccagucagauggaaaagauaa

SEQ ID NO: 2637 - RNA, 1473 nt, Artificial Sequence
  derived and/or modified CDS sequence (opt6) from Lassa virus__ADU56610__GPC
augggacaaaucguaacauucuuccaagaagucccucacguaauagaagaaguaaugaacauaguacucauagcauuaucacuauuagccauacuaaaaggaauauauaacguugcaacaugcggacuauucggauuaauaucauuuuuacuccuaugcggucgcucaugcucaacuacauacaaaggaguauacgaauuacaaacacucgaacuagacauggcaaaucuaaacaugacaaugccucuaucauguacuaaaaacucaucacaccauuauauaauggucggaaaugaaacuggacuagaauuaacuuuaacuaacacaagcauaauaaaucacaaauucugcaaucuaagugaugcacauaaaaaaaaccuauacgaucacgcacuaaugucaauaaucucaacauuucaccuauccauaccaaacuucaaccaauacgaagccaugucaugugacuucaacggcggaaaaauaucagugcaauacaaccuaucacacgcauacgcaguagaugcugccaaccauuguggaacaauagcaaacggcguacuacaaacauuuaugagaauggcauggggaggauccuacauagcacuugacucuggaaaaggaaacugggacuguauaaugaccuccuaccaauacuuaauaauacaaaauacuacaugggaagaccacugccaauucucacgaccaucaccaaucggauaccuaggauuacuuucacaacgcacaagggacauauacauaucgagaagacuacucggaacauuuacauggacccuaucagacucagaaggaaacgaagcacccggcggauacugcuuaacaagauggaugcuaauagaagccgaacuaaaaugcuuuggcaacacagcaauugcaaaauguaaugaaaaacaugaugaagaauucugcgacaugcuacgacuauuugacuucaauaaacaagcaauaaaaagacuuaaagcagaagcacaaaugucaauacaacuaauuaacaaagcaguuaaugcauuaauuaaugaccaacuaauaaugaaaaaccacuuaagagauauaaugggaauaccauacuguaauuacucaaaauacugguaucuaaaccacaccgucacaggcaaaacaucacuaccaagaugcugguuaauauccaacggaucauaucucaacgagacacauuucucagacgacauugaacaacaagcagauaacaugaucacagaacuacuacaaaaagaauacauggacagacaaggcaaaacaccacuaggacuaguagauuuauucgucuuuucaacaucauuuuacuuaauaucuaucuucuuacaccuagucaaaauaccaacacacagacacauaguaggaagaccauguccaaaaccccaccgacucaaccauaugggcauaugcuccuguggacuauacaaacacccaggaguacccguuaaauggaaaagauaa

SEQ ID NO: 2638 - RNA, 1473 nt, Artificial Sequence
  derived and/or modified CDS sequence (opt6) from Lassa virus__ADU56618__GPC
augggacaaauagucacuuucuuccaagaaguaccacauguuauugaagaaguaaugaacauaguacuuauagcauuaucuauauuagcaauauuaaaaggccuauacaacauagcaacaugcggucuuaucggccuagucacauuccuccuacuauccggaagaagcuguucaaugacauacaaaggaguauaugaacuacaaacauuagaacuaaauaugaauacucuuaacaugacaaugccucuaucauguaccaaaaacaacucacaccacuacauaaugguaggaaacgaaacaggacuagaauuaacacuaacaaacacaucacuacuacaucacaaauucugcaauuuaucagacgcacacaagaaaaaucuauaugaccauacccuaaugaguauaauaucaaccuuccaccuaucgauaccaaauuucaaccaauacgaagcaauguccugcgacuuuaauggaggaaaaaucaccguacaauauaaccuaucacauucuuacgcaauagacgcagcaaaccauugcggcaccgucgcaaacggaguauuacaaacauucaugagaauggcauggggagguucuuauauagcccuugacucaggaagaggcaaaugggacugcauaaugacaucauaucaauaccuaauaauacaaaauaccacaugggaagaucauugccaauucucuagaccaucaccaauuggauaucuaggacuccucucacaaagaacaagagauauauacauaagcagaagacuacucggaaccuucacauggacacuauccgacucagaaggcaacgaaacacccggaggauauugcuuaacaagauggauguuaauagaagccgaacuaaaaugcuucggaaacacagcaguagcaaaaugcaaugaaaaacaugacgaagaauuuugugauaugcuaagauuauucgacuucaauaaacaagcaauaagacgucuaaaagcugaagcacaaaugucuauacaacuaauaaacaaagcagucaaugcauuaauaaacgaccaacucauaaugaaaaaccaccugagagacauaaugggaauaccauacuguaacuacucaaaauacugguaccuaaaccacacaucaacaggacguacaucauuacccagauguuggcuuguaucaaacggaucuuaccuaaacgaaacacacuucucugacgauauagaacaacaagcagacaacaugauaacagaaaugcuacaaaaagaauaucucgauagacaaggaaaaaccccacuaggauuaguagaccuauuugucuucucaaccucauucuauuuaauaucaauuuuccuacauuuaguaaaaauaccaacacaccgacacaucguaggcaaaccauguccgaaaccacaccgacuaaaucauaugggcauaugcagcugcggauuauacaaacaaccaggaguccccgucagauggaaacgauaa

SEQ ID NO: 2639 - RNA, 1473 nt, Artificial Sequence
  derived and/or modified CDS sequence (opt6) from Lassa virus__ADU56622__GPC
augggacaaauaaucaccuucuuucaagaagucccccacgucauagaagaaguaaugaacauaguauuaauagcucuaucacuauuagcaauauuaaaaggcauauacaauguugccaccugcggauuauucggauuaguaucauuccuacuuuuaugcggacgauccugcucuacaacauauaaaggaguauacgagcuacaaaccuuagaauuagacauggccucacucaacaugacaaugccacuaucaugcaccaaaaacaacucucaucacuacauaauggucggaaacgaaacagguuuagaacuaacauuaacaaacacauccauaaucaaccacaaauuuugcaaucucucagacgcccacaaaaaaaaccuauacgaucacgcucuaaugucaaucauaucaaccuuucacuuauccaucccaaacuucaaccaauaugaagcaaugucaugcgacuucaacggaggcaaaauaucaguacaauacaaccucucacacacauaugcaguagacgcugcaaaccauugcggcacaauagccaauggcguauuacaaacauucaugcgcauggccuggggcggauccuacauagcccucgacucuggaaaaggcucuugggacugcauaaugacuucauaccaauaucuaaucauacaaaauacaacaugggaagaucacugccaauuuucacgacccucaccaauaggauauuuaggauuacuaucacaaagaaccagggacauauacauaucacgacgacuacuaggaaccuucaccuggacacuauccgacucagaaggcaaugaaaccccuggcggcuacugccuaacaagauggauguuaauagaagcagaauuaaaaugcuucggaaauacagcaguagcaaaauguaacgaaaaacacgacgaagaauucugcgauaugcuaagacucuucgacuuuaauaaacaagcaauaagaagauuaaaaaccgaagcacaaaugucuauacaacuaaucaacaaagcagucaacgcuuuaauaaacgaccaauuaauaaugaaaaaccaucuacgagauaucaugggaauaccauauuguaauuacuccaaauauugguacuuaaaccacacaguaaccggaaaaaccucucuaccacgaugcuggcuagucucaaauggaaguuacuuaaacgaaacucauuucucagaugacauagaacaacaagccgacaacaugauaaccgaacuccuacaaaaagaauauauagacaggcaaggcaaaaccccucucggcuuagucgacuuauucguauuuucaacauccuuuuaccuaauuucaauuuuccuacaccuaguaaaaauaccaacccaucgccacguaauaggaaaaccaugcccaaaaccacauagauuaaaucacaugggaauaugcucauguggauuauacaaacauccaggagucccaguaaaauggaaaagauaa

SEQ ID NO: 2640 - RNA, 1473 nt, Artificial Sequence
  derived and/or modified CDS sequence (opt6) from Lassa virus__ADU56626__GPC
augggacaaauaauaacauucuuucaagaaguaccacacguaauagaagaagucaugaacauaguacuaauugcacuaucccuauuagcaauacuaaaaggaauauauaacguagcaaccugcggauuauucggccuaguaucauuccuacuacuaugcggacgaucauguuccaccacauauaaagguguauacgaacuccaaacacuagaacuaaauauggcaucacucaauaugaccaugccucuaucaugcaccaaaaacaauucacaccacuacauaauggucggaaaugaaacaggacucgaacuaacacuuaccaacacaucaauaauaaaccacaaauucugcaaucuaucagacgcacacaaacgaaaccuauaugaucacgcccucaugucaauaaucucaaccuuccaccuaucaauaccaaacuuuaaucaauaugaagcaaugucaugugacuuuaacgguggcaaaauuuccguacaauauaacuuaagucauacauacgcaguugacgcagcaaaacacugcggaacaauagcaaacggaguacuacaaacauucaugagaauggcuuggggaggaucauacauagcccuagacucaggaaaaggaucaugggacuguaucaugacaucauaccaauauuuaauaauacaaaacacaacaugggaagaccacugccaauuuucacgaccaucaccuauuggauaccuaggacuucuaucccaaagaacaagagacauauauauauccagaagacuacuaggaacuuuuacauggacauuaucagacucagaagguaaugaaacaccuggagguuacugucuaacuagauggauguugauagaagcagaauuaaaauguuucggaaacacugcaguagcaaaaugcaacgaaaaacaugacgaagaauuuugcgacauguuaagauuauucgauuucaacaaacaagcuauaagaagacuaaaagcagaagcacaaauguccauccaacuaauuaauaaagcagucaacgcccucauaaacgaccaacuaauaaugaaaaaccaucucagagauauaaugggaauccccuacugcaacuacuccaaauacugguacuuaaaccauacaguaacuggaaaaacaucacuaccacgaugcugguuaguaucaaacggcucauaucuuaacgaaacacacuucuccgacgauauagaacaacaagcagacaacaugauaacagaacuauuacaaaaagaauauauagauagacaagguaaaacaccguuaggccuaguagaccucuuuguauucuccaccuccuucuaucuaauaagcauauuuuuacaccuaguaaaaauaccaacacauagacacguaauuggaaaaccaugcccaaaaccacacagacuuaaccacaugggaaucugcagcugcggauuauacaaacacccaggcguacccguaaaauggaaaagauaa

SEQ ID NO: 2641 - RNA, 1473 nt, Artificial Sequence
  derived and/or modified CDS sequence (opt6) from Lassa virus__ADU56630__GPC
augggacaaauaauaacauucuuccaagaaguuccacacguaauagaagaaguaaugaacauaguacuaauagcauuaucacuacuagcaauacuuaaaggaaucuacaacguagcaacaugcggacuuuucggauuagucucauuccuauuacuaugcggaagaucaugcucaacaacauauaaaggaguauacgaauuacaaaccuuagaacucgacauggccucauuaaacaugacaaugccacuuucauguacuaaaaacaacucacaccauuacauaaugguaggaaacgaaaccggccuagaacuuacacuaacaaacacaucaauaauaaaucacaaauuuugcaaucuaucagacgcacauaagaaaaaccucuacgaccacgccuuaauguccaucauauccacauuccaccuauccaucccaaauuuuaaucaauacgaagcuaugucaugcgacuucaacggaggaaaaauaucaguccaauacaaccuaucccacgccuacgcagucgaugcagcaaaccacugcggaacaauagccaauggaguacuacaaacauucaugagaauggcauggggaggaucauacauagcacucgacuccggaaaaggaucaugggauugcaucaugacaaguuaccaguauuuaauaauacaaaacacaacaugggaagaccacugccaauucagcagaccaagcccaauaggauaucucggacuacuaagccaacgaaccagagacauauacauaucaagaagacuucuaggaacauuuacuuggacuuuaucagacucagaaggaaacgaaacaccagguggcuacugcuuaacaagauggaugcuuauagaagcagaacuuaaaugcuucggcaacacagcaguagcuaaaugcaacgaaaaacaugaugaagaauuuugcgacaugcuacgacucuucgauuucaacaaacaagcaauccgacgacuaaaaacagaagcacaaaugucaauacaacuaauaaauaaagcaguaaacgccuuaauaaacgaccaacuaauaaugaaaaaucaccuaagagacauaaugggaauaccauacugcaacuacucaaaauacugguaccuaaaccacacaguaacuggaaaaaccucacuaccacgaugcuggcuuguaucaaauggcucauaccuuaaugaaacacacuucucagaugacaucgaacaacaagcagacaacaugauaacagaacuccuacaaaaagaauauauggacagacaaggaaaaacucccuuaggucucgucgacuuauucguauucucaacaucauucuaccuaauaagcauauuccuacacuuaguaagaauaccaacacacagacauguaaucggaaaaccauguccaaaaccacauagacuaaaccacaugggaauauguucauguggacuauacaaacaccccggaguaccaguaaaauggaaacgauaa

SEQ ID NO: 2642 - RNA, 1476 nt, Artificial Sequence
  derived and/or modified CDS sequence (opt6) from Lassa virus__AFY05588__GPC
augggacaaauaguaaccuuuuuucaagaagucccacacguaauagaagaaguuaugaauauaguacuaauagcauuaucaguauuagcaguacuuaaaggacucuacaauuucgccaccugcggacuaguaggacuuguaacuuuucuacuacuaugugggcgaucaugcacaacaucauuauauaaagguguuuaugaauuacaaacacuagaacuaaauauggaaaccuuaaacaugacaaugcccuuauccugcacaaaaaauaacucccaucacuauaucaugguaggaaacgaaacaggacuugaauuaacauuaacaaauacaagcaucaucaaccacaaauucuguaaccuaucugaugcacacaaaaaaaaccuauaugaucaugcacuuaugucaaucauauccacauuccacuuaucaauaccaaacuucaaucaauacgaagcaaugagcugugacuuuaauggcggcaaaauaucuguucaauauaaccuaagucauucauacgcaggagaugcagcaaaccacugcggcacaguagccaacggaguauuacaaacauucaugagaauggcauggggagguucauacaucgcacuagacuccgggagaggaaacugggacuguauaaugacauccuaccaauacuuaauaauacaaaacacaacaugggaagaucacugucaauucucaagaccuucaccaauaggauaccuaggacuacucucacaacgcaccagagacuuauacauaucacgccgauuacuaggaaccuuuacauggacacuaucagauagugaaggcgaagacacaccaggaggauacugccuaacaagauggaugcuaauagaagcugaauuaaaaugcuucggaaauacagcaguagcaaaauguaacgaaaaacaugacgaagaauucugcgacaugcuaagacuauuugacuucaacaaacaagcaauucaaagacuaaaagcugaagcacaaaugucaauacaacuaaucaauaaagcagucaaugcauuaauaaaugaccaacuaauaaugaaaaaccaccuacgagacauaaugggaauaccauauugcaauuauucaaaauacugguaucuaaaccacacaacaacuggcagaacaucauuaccaaaaugcuggcuaguaagcaacggaucauauuuaaaugaaacucacuucucagaugauaucgaacaacaagcugauaacaugauaacagaaaugcuacaaaaagaauauauggaaagacaaggaaaaacaccacuaggauuagucgaccuauucguauuuucaacaucauucuacuuaauaaguauauuccuacaccuuguuaaaauuccaacacacagacauauagucggaaaaaguugccccaaaccacauagauuaaaccauaugggaauauguucaugcggauuauauaaacaaccaggaguaccugucaaauggaaaagauaa

SEQ ID NO: 2643 - RNA, 1476 nt, Artificial Sequence
  derived and/or modified CDS sequence (opt6) from Lassa virus__AFY05590__GPC
augggacaaaucgucacauuuuuccaagaaguaccccacgucauagaagaaguaaugaauauaguacuaauagccuuaucaguacuagcaguacuaaaaggacuauacaacuucgcaacuuguggacuagucggccucguaacuuuccuacuacuaugcggaagaucaugcacaacaucacuauacaaaggaguauaugaauuacaaacgcucgaacuaaauauggaaacccuaaauaugaccaugccacucucaugcacaaaaaacaacucacaccauuauauaaugguagggaaugaaaccggacuagaacucaccuuaaccaacacaagcauaauaaaccacaaauucugcaaccuaagcgacgcccacaaaaaaaaucucuacgaccaugcacucaugucaauaauaucaacauuccaccuauccauaccaaauuuuaaccaauacgaagcaauguccugcgacuucaacggaggaaaaauaagcguucaauacaauuuaucccacagcuacgcaggagacgcagcaaaccauugcggaacaguagcaaacggaguacuacaaacauucaugcgaauggccuggggaggaucauacauugcacuagacucaggaagaggaaauugggacugcauaaugacaucauaccaauauuuaauaauacaaaacacaacaugggaagaccacugucaauucucccgaccuaguccaauaggauacuuaggacuauuaucacaacgaacaagagauauguauauaucaagaagacuacuaggaacauuuacauggacacuuuccgauucagaaggagaagacacacccggaggauacugcuuaacacgauggaugcuaaucgaagcugaacucaaauguuucggaaacacagcagucgccaaaugcaacgaaaaacacgacgaagaauucugcgauauguuaagacuauucgacuucaauaaacaagcaauacaaagauuaaaagcagaagcccaaauguccauacaacuaauaaacaaagcaguaaacgcccuaauaaaugaccaacuaauaaugaaaaaucaccuacgcgacauaaugggaauuccauauugcaauuacucaaaauacugguaccuaaaccacacuacaacaggcagaacaagccuaccaaaaugcuggcuagucaguaacggauccuaucuaaacgaaacccauuucucagaugauaucgaacaacaagcagauaauaugauaacugaaauguuacaaaaagaauacauggaaagacaaggcaaaacuccacucggcuuaguagacuuauuuguauucuccacauccuuuuaucucauaucaauauuucuacauuuaguaaaaauaccuacacacagacauauaguagguaaaucaugcccaaaaccacacagacucaaccacaugggcaucugcucuugcggauuauauaaacaaccaggaguacccguaaaauggaaaagauaa

SEQ ID NO: 2644 - RNA, 1476 nt, Artificial Sequence
  derived and/or modified CDS sequence (opt6) from Lassa virus__AHC95553__GPC
augggacaaauaguaaccuucuuccaagaaguaccacauguaauagaagaaguaaugaacauaguacucauagcuuuaucaauucucgcaguucuaaaaggacuauacaacauagcaacaugcggauuaauaggcuuaguuacauuuuuccuacuaugugguagaucaugcucaaguaaccuauauaaaggaguauaugaauuacaaucauuagacuuaaacauggaaacauuaaacaugacuaugccacuaucaugcaccaaaaacaacucacaccacuacauuagaguaggaaaugaaacaggccucgaacuaaccuuaacaaauacaucacuauuagaccacaaauucugcaaucuaucagacgcacacaaaaaaaauuuauaugaucaugcacuaauguccauuauaucaacuuuccaucucuccauaccuaacuuuaaccaauacgaagccaugucaugugacuucaacggaggaaaaauaacaguacaauacaaccuaucacacaguuaugcaggcgacgcagcucgucauuguggaaccauagcaaacggaguuuuacaaacauucaugagaauggccuggggaggcuccuacauagcauuagacucaggccacggaaacugggacugcauaaugacaucauaccaauaucuaauaauacaaaacaccacaugggaagaccauugccaauuuucacgaccauccccaauaggauaccuauccuuacuaagccaaagaacacgagacauauacaucucacgacgccuacuaggaaccuucacauggacauuauccgacagcgaaggaaacgccacacccggaggauacugccuaacaagauggauguuaauagaagcagaauuaaaaugcuucggaaauacagcaguagcaaaaugcaacgaaaaacacgacgaagaauucugcgacauguuaagacuauuugauuucaacaaacaagccauaucacgucuaagaucagaagcccaaaugagcauacaguuaauuaacaaagccgucaacgcccuaaucaacgaccaacuaauaaugaaaaaccaucuaagagacauaaugggaauacccuacugcaacuacuccaaauacugguacuuaaaccacacaguuacaggacgaacaucacuaccaaaaugcuggcuaguaucaaauggaucauaccuaaacgaaacacauuucucagacgacauagaacaacaagcugacaacaugauaacagaaaugcuacaaaaagaauacauggaccgacaaggcaaaacacccuuaggacuaguagauuuauucguauucuccacaagcuuuuauuuaauauccauauucuuacacuuaguaaaaaucccuacccacagacacauaguuggaaaaccaugcccaaaaccccacagacuuaaucguaugggaaucugcucaugcggacuauacaaacaaccaggaguaccaguaaaauggaaaagauaa

SEQ ID NO: 2645 - RNA, 1476 nt, Artificial Sequence
  derived and/or modified CDS sequence (opt6) from Lassa virus__AHC95555__GPC
augggucaaauaguaacauuuuuccaagaaguaccacacguaaucgaagaaguaaugaacauaguacuaauagcccuuuccauacuagcaguccuaaaaggauuauauaauauagcaacuuguggauuaauaggacuaguaacauuccuauuacuaugcggucgaucauguucauccaacuuauacaaagguguauaugaacuacaaagucucgauuuaaacauggaaacauuaaacaugacaaugcccuuaucaugcacaaaaaauaacucacaucauuauauaagagcaggaaacgaaacaggacuagaacuaacccuuacaaacacaucucuaauaaaccauaaauucuguaaucucucagacgcccacaaaaaaaaucuauaugaccacacacucaugucaauaauaucaacauuccaucuaucaauaccaaacuucaaccaauacgaagccaugucuugcgacuuuaacggaggcaaaauuuccguacaauacaaccucucccacgcauaugcaauagacgcagccgaacacuguggaacaguagcaaacggaguccuacaaacauucaugagaauggcaugggguggaucauacauagccuuagacucaggaagaggaaacugggacuguauaaugacuucauaucaauauuuaauaauucaaaauacaacaugggaagaccacugccaauuuucacgcccaucccccauaggauacuuaggauuacuaucacaaagaacccgagacauauacaucucuagaagacuacuaggaacauucacauggacacucucagauuccgaaggaaaugcaacaccaggcgguuacuguuuaacaagauggaugcuaauagaagcagaacuaaaaugcuuuggaaauacugcuguagcuaaaugcaaugaaaaacacgacgaagaauuuugcgacaugcuaagacuauucgauuucaauaaacaagcuauaucaagacucaaaagcgaagcacagauguccauacaacuaauuaauaaagcaguaaacgcacuaauaaacgaccaacuaaucaugaaaaaccaucucagagauauaaugggaaucccauacugcaacuacucuaaauacugguaucuaaaccauacaauaacaggaagaacuucacuaccaaaaugcuggcuaguaucaaacggaucauaucuaaacgaaacacacuuuuccgaugacauagaacaacaagcagacaauaugauaacagaaaugcuacaaaaagaauacauggaaagacaagguaaaacaccacuaggacuaguagaccuauucgucuuuucaacaucauucuaccuuauauccauauuccuucaucuagucaaaauaccaacacacagacacauagucgguaaaccuugcccaaaaccgcaucgacuaaaccacaugggaauaugcuccuguggacuauacaaacaaccaggaguaccucuaaaauggaaaagauaa

SEQ ID NO: 2646 - RNA, 1476 nt, Artificial Sequence
  derived and/or modified CDS sequence (opt6) from Lassa virus__AHC95557__GPC
augggacaaauaguaacauucuuccaagaaguaccacacguaauugaagaaguaaugaauauuguacuaauagcauuaucaauacuagcagucuuaaaaggauuauacaacauagcaacaugcggccuaauaggucuaguaacuuucuuucuacuaugcggccgaucaugcucaucaaaucuauacaaaggaguauacgaauuacaaucacucgaccuaaacauggaaacacucaacaugaccaugcccuuaucaugcaccaaaaauaacucacaccacuacauaagagucggaaaugaaacaggacuagaauuaacacuaacaaacacaucacuauuaaaccacaaauuuuguaacuuaucagacgcccacaaacgaaaccuauacgaucaugcauuaaugucaaucauaucaacauuucaucuaucuaucccaaacuuuaaccaauacgaagcaaugucaugugacuucaacggcggcaaaauaacaguacaauauaaccuaucacacucauacgcaggagacacagccaaacauugcggaacaauagcuaacggcguauuacaaacauucaugagaauggcaugggguggaucauacauagcccuagacuccggacacggaaacugggauugcauaaugaccucuuaucaauacuuaauaauacaaaacacaacaugggaagaccauugccaauucucucgaccaaguccaauaggauaccuaggccuacuaucccaaagaacccgagauauauacauaucuagaagacuacuuggaacauuuacauggacauuaucugacucugaaggcaacgcaacaccaggaggcuauugucuaacuagauggaugcuaauugaagcagaauuaaaaugcuuuggaaacacagcaguagccaaaugcaacgaaaaacacgacgaagaauuuugcgacaugcucagacuauucgacuucaauaaacaagcaaucucccgacuaagaucagaagcacaaaugucaauacaacuaaucaacaaagcaguaaacgcucuaauuaaugaucaauuaauaaugaaaaaucaccuacgagacauuaugggcauaccauacugcaauuacucuaaauacugguauuuaaaucacacaguaacuggccgaacaucauuaccaaaaugcugguuaguaaguaauggcucauacuuaaacgaaacacacuucuccgaugacauagaacaacaagccgauaauaugauuacagaaaugcuacaaaaagaauacauggauagacaaggcaaaacaccacuaggccuaguagaccucuucguauuuucuacaucauucuacuugauaucaaucuucuuacaucuaguuaaaauaccuacacacagacacauuguaggaaaaccaugcccaaaaccacauagauuaaacagaaugggaauaugcuccugcggacucuauaaacaaccuggaguaccagucaaauggaaaagauaa

SEQ ID NO: 2647 - RNA, 1476 nt, Artificial Sequence
  derived and/or modified CDS sequence (opt6) from Lassa virus__AHC95559__GPC
augggacaaaucaucacuuucuuccaagaaguaccccaugucauagaagagguaaugaacauaguuuuaauagcccugucaauacuagcaguauuaaaaggacuauacaacauagcuacuugcggacuaaucgguuuaguaacauuuuuauuauuaugcgguagauccugcucauccucacuauacaaaggcguauacgaacuucaaucauuagaccuaaacauggaaacacuaaauaugacaaugccauuaucaugcacaaaaaauaacucucaucauuacauuagaguaggaaacgaaacuggucucgaacuaacucuuacaaacacaucccuaauuaaccacaaauucugcaacuuaucagaugcacacaaaaaaaacuuauacgaccaugccuuaaugucaauaaucucaacuuuucaccuaucaauaccaaauuuuaaccaauacgaagcaauguccugcgacuucaacggcggaaaaauaucaguccaauacaaucuaucacacgcauacgcaauagaugcagcaucacacuguggaacugucgcaaauggaguacuacaaacauucaugagaauggcauggggaggaucauacauagccuuagauucaggacauggcaauugggacugcauaaugacaucauaccaauaucuaauaauacaaaacacaacaugggaagaccacugccaauuuucaagacccucaccaauaggauauuuaggacuacuaagccaaagaaccagagauauauacauuucaagacgacuauuaggaacauucacauggacacuaucagacucagaagguaaugcaacaccaggaggauacugcuuaaccagauggauguuaauagaagcagaacucaaauguuucggcaacacagcaguagcaaaauguaacgaaaaacaugaugaagaauucugcgacaugcuaagacuauuugacuucaacaaacaagcaauaucaagacuaaaaucagaagcacaaaugucaauacaacuaauaaauaaagcaguaaacgcacuaauaaacgaccaacuaauaaugaaaaaccaccuccgagauauaauggguauaccauacuguaacuacucaaaauacugguaucuaaaucacacaguaacuggaaaaacuucauuaccaaaaugcuggcuagucucgaacggaucauaucuaaacgaaacucacuucucagaugauaucgaacaacaagcagacaacaugauaacagaaaugcuacaaaaagaauauauggaaagacaaggcaaaacaccauuaggccuaguagaccuuuucgucuucucuacuucauucuaccucauaucaauauuucuacaccuuguuaaaauaccaacacauagacacauagucggcaaacccugcccaaaaccacaucgccucaaccacaugggaauauguucauguggccucuacaaacaacccgguguacccguuaaauggaaaagauaa

SEQ ID NO: 2648 - RNA, 1476 nt, Artificial Sequence
  derived and/or modified CDS sequence (opt6) from Lassa virus__AIT17126__GPC
augggccaaauaguaacauucuuccaagaaguaccacacguuauugaagaaguaaugaacauaguuuuaaucgcccuuuccauacuugccguacuaaaaggauuauauaacuucgcaacuugugguuuaguaggacuauuaacauuuuuauuauuaugcggcagaucaugcacuacaggcuuauacaaaggugucuaugaacuacaaacauuagaacuaaacauggaaacacuaaauaugacaaugccacuaucaugcaccaaaaauaacucacaccacuauauaauggucggcaacgaaacaggucuugaacuaacccuaacaaauacauccauaauaaaccauaaauucuguaauuuaucagacgcacacaaaaaaaacuuauaugaccacgcauuaaugucaauaauaaguaccuuccacuuaucaaucccuaauuuuaaccaauacgaagcaaugucaugcgauuucaacggaggcaaaauaucaguacaauacaaccuaucccacucauacgcaggagacgcagcugaccauuguggaacaguagccaacggaguauuacaaacauuuaugagaauggcauggggaggaagcuauauagcacuagauucaggaagaggaagaugggacuguauaaugaccucauaccaauacuuaaucauacaaaacacuacaugggaagaccacugccaauucuccagaccauccccaaucggauacuuagguuuacuaucacaaagaacuagagacauauacauaagccgacgauuacuaggaaccuucacauggacacuaucugacucagaaggaaaagauacaccaggcgguuacugucuuacaagauggaugcuaauagaagcagaauuaaaauguuuuggaaauacagcuguagcuaaaugcaacgaaaaacacgacgaagaauucugcgacaugcuaagauuauucgacuucaacaaacaagcuauucaaagauuaaaagccgaagcacaaaugucaauacaauuaauaaacaaagcgguaaaugcacuaauaaaugaucaacuagucaugaaaaaucaccuuagagacauaaugggcauaccauauugcaauuacucaagauacugguaucucaaucauacaacaacaggaagaacaagucuacccaaauguuggcuaguaucaaacggaucauacuuaaaugaaacacacuucucagacgacauagaacaacaagcagacaacaugaucacugaaaugcuacaaaaagaauauauggaaagacaaggaaaaaccccauuaggacuuguagaccucuucgucuuuaguaccucauuuuauuuaauauccauuuuccuacaucuaguuaaaauacccacacauagacauauaguaggaaaaagcugcccaaaaccacacagacuaaaccauauggguauauguucaugcggacuuuacaaacaaccaggaguaccaguaaaauggaaaagauaa

SEQ ID NO: 2649 - RNA, 1476 nt, Artificial Sequence
  derived and/or modified CDS sequence (opt6) from Lassa virus__AIT17130__GPC
augggucaaaucgucacauucuuccaagaaguaccacacguaauagaagaaguaaugaauauaguuuuaaucgcauuaucaauacucgcaguccuaaaaggacuauacaacuucgccacaugcggauuuguaggauuaguaaccuuccuucuauuaugcggccgaucaugcacaacaucccuuuauaaaggaguauacgaacuacaaacccuagaauuaaacauggaaacacuuaacaugacaaugccacuauccuguaccaaaaacaacucacaccacuacauacgaguaggaaacgacacaggacucgaacuaacacuaacaaacaccuccaucauaaaccacaaauucugcaaucuuucagaugcacacaagaaaaaccuauacgaccaugcacucauguccauaauauccacauuccauuuaagcauacccaacuuuaaccaauacgaagccaugucaugcgauuucaacggaggaaaaauauccguacaauacaaccucucacacuccuaugcaguagacgcagcaucacacugcggaacaauagcaaacggaguauuacaaacauuuaugagaauggcauggggaggaagcuacauugcauuagacucuggaagagacagaugggacugcauaaugacaucuuaccaauaccucauaauacaaaacacaacaugggaagaccauugucaauucucaagaccaucuccaauaggauaccucggcuuacucucccaaagaacaagagauauauauauaucaagacgauuacuaggaacauucacauggacauuaucagacucugaaggaaaagauacccccgguggauacugccuaacaagauggaugcuuauagaagcagaauuaaaaugcuucggaaacacagcaguagcaaaauguaacgaaaaacaugacgaagaauuuugcgacauguuacgacuauucgacuucaauaaacaagcaauacaaagauuaaaagcagaagcacaaaugucaauacaauuaauaaacaaagcaguaaacgcauuaauaaaugaccaacucauaaugaaaaaccaccucagagauauaaugggcauaccauauugcaauuauucaaaauacugguacuuaaaucacacaaccacaggcaaaacaaguuuacccaaaugcuggcuaguaucaaauggaucauaccuaaaugaaacacacuucucagacgacauagaacaacaagcagauaacaugauaacagaaauguuacaaaaagaauacauggaaagacaaggaaaaacaccacuaggucuaguagaccuuuucguauucucaacuagcuucuacuuaauuucaauuuuccuccaucuagucaaaauaccaacacaccgacacauagucggaaaaucaugcccaaaaccacaucgauuaaaccacaugggaauaugcucaugcggacuauacaaacaaccaggagucccagucaaauggaaaagauaa

SEQ ID NO: 2650 - RNA, 1476 nt, Artificial Sequence
  derived and/or modified CDS sequence (opt6) from Lassa virus__AIT17134__GPC
augggacaaauaguaacauuuuuccaagaaguaccacauguaauagaagaagucaugaauauaguccuaauagcccuaucaauccuagcaguacuuaaaggacuuuacaacuucgcaaccugcggauuaguaggucuagucacauuccuccuauuaugcggacguucaugcaccacaucauuauauaaagguguauacgaacuacaaacauuagaauuaaauauggaaacacuaaacaugacaaugccacuaucaugcacaaaaaauaauucccaucacuacauaaugguaggcaacgaaacaggacuagaauuaacauuaacaaacacaucaauuauaaaucauaaauuuuguaaccuaucagaugcacacaaaaaaaaccuauacgaucacgcacucaugucaauaaucucaacauuccaccucucaauaccaaauuucaaucaauaugaagcaaugucaugcgauuuuaacggaggaaaaauaucaguccaauacaaucucucccauucuuacgcaggagaugcagcaaaucauugcggaacaguagccaauggcguuuuacaaacauucaugagaauggcauggggaggaucauacauagcauuagauucaggcagaggaagaugggacugcaucaugacaucauaucaauacuuaauaauacaaaacacaacaugggaagaccacugccaauucucaagaccaucacccaucggauacuuaggccuauuaucucaaagaacaagagacauuuacauaucccgaagauuacuuggcacauucacauggacccuuucagacuccgaaggaaaagacacaccuggugguuacugccuaacaagauggaugcuaauagaagcggaacuaaaaugcuucggaaacacagcaguagcuaaauguaacgaaaaacacgacgaagaauucugugacaugcuaagacuauucgacuucaauaaacaagcaauacaacgacucaaagcagaagcacaaaugucaauucaacuaaucaacaaagcaguaaacgcacuaauaaacgaucaauuaaucaugaaaaaccaccuaagagacauuaugggaauaccauacugcaacuacucuaaauacugguauuuaaaccacaccacaaccggcaaaacaucauuaccuaaaugcuggcuaguaucaaacggcucauaucuaaaugaaacucauuucuccgacgauauugaacaacaagccgacaacaugauaacugaaaugcuacaaaaagaauacauggaaagacaagguaaaacuccuuuaggacuagucgacuuauucguauuuucaacaucauucuaucuaauaucuauuuuccuacaccuugucaaaauucccacucacagacacauaguuggaaaaucaugcccaaaaccacauagacuaaaccauaugggaauaugcuccuguggauuauauaaacaaccaggaguaccagucaaauggaaacgcuaa

SEQ ID NO: 2651 - RNA, 1476 nt, Artificial Sequence
  derived and/or modified CDS sequence (opt6) from Lassa virus__AIT17138__GPC
augggacaaauuguaacauucuuucaagaaguaccacacguaauagaagaaguaaugaacauaguacuaauagcauuaucuauccuagcaguuuuaaaaggauuauauaaccuugcaaccugcggacuaguaggacucgucacuuuucuacuacuauguggacgcucauguaccaccucauuauacaaaggaguauacgaacuacaaacacuugaacuaaacauggaaacacuaaauaugacaaugccauuaucuugcacaaaaaacaacagccaucauuacauuauggucggcaaugaaacuggacuagaacuaacauuaacuaacacaucacuaauaaaccacaaauuuugcaaccuaucugaugcacacaaaaaaaauuuauaugaccaugcacuaaugucaauaauaucaacauuccaccuaucuauaccuaacuuuaaccaauacgaagcaaugucaugcgacuuuaacggcggcaaaauaagcguacaauacaacuuaucccauucauacgcaguagacgcagcaucacauugcggaacaguugcaaauggaguauuacaaacauuuaugagaauggcuuggggcgguucauacauagcacucgacucaggacgaggaggaugggacugcauuaugaccucauaccaauaccuaauaauacaaaauaccacaugggaagaccauugccaauuuucaagaccauccccaauuggauacuuaggacucuuaucacaaaggaccagagacauauacauaucuagacgauuauuaggcaccuucacauggacacuaagcgacucugaaggaaaagacacaccaggaggauauugucuaacccgcuggaugcuaauagaagcagaacuaaaaugcuucggaaacaccgcaguagcaaaaugcaacgaaaaacaugaugaagaauucugcgauaugcucagacuuuucgauuuuaacaaacaagcaauccaacgauuaaaagcugaagcacaaaugucaauccaauuaauuaacaaagcaguaaacgccuuaauuaacgaucaacuaauaaugaaaaaccauuuacgcgacauaaugggaauaccauacugcaacuacucaaaauacugguaucuaaaccacacuacaacaggaagaacaagccuaccacgauguuggcuaguaagcaacggaucuuauuugaacgaaacacauuuuuccgacgauauagaacaacaagcagauaauaugauaacagaaaugcuacaaaaagaauacauggaacgacaaggaaaaacaccauuaggccuaguugaccuuuuugucuucucaacaucauuuuaucuaauaucaaucuuccuacaccuaguaaaaauacccacacauagacacaucguaggcaaaucaugcccaaaaccacacagacuaaaucacaugggcauauguucaugcggacuauacaaacaacccggaguaccagugaaauggaaacgauaa

SEQ ID NO: 2652 - RNA, 1476 nt, Artificial Sequence
  derived and/or modified CDS sequence (opt6) from Lassa virus__AIT17142__GPC
augggacaaauaguuacauuuuuccaagaaguuccacacguuauagaagaaguaaugaacaucguacucauagcauuaucuguacuagcuguacuaaaaggucuauauaacuucgcaaccugcggaaucguaggacuaguaacauuccuucuccucugcggaagaucaugcacaacaucauuauacaaaggaguuuaugaacuacaaacauuagaacuaaacauggaaacauuaaacaugacaaugccuuuaaguugcacaaaaaauaacagccaccauuacauaaugguaggaaacgacacaggauuagaauuaacccuaacaaauacaucaauaauaaaucacaaauucuguaauuuaucagacgcucauaaaaaaaaucuauacgaccaugcacuaaugucaauaauaucuacauuucauuuaaguaucccaaauuuuaaccaauaugaagcaaugucaugcgauuucaauggaggaaaaauauccguacaauacaacuuaucacauucauacgcaggcgacgcagcagaucacuguggaacaguagcaaacgggguacuacaaaccuucaugagaauggcauggggagggucauauaucgcacuagauaguggaagaggcagaugggauuguauuaugaccucauaccaauaccuaaucauacaaaacacaacaugggaagaccacugccaauucucacgaccaucaccaauaggauauuuaggauuauuaucacaaagaacaagagacauauacauuucucgaagacuacuuggaacauucacuuggacacuaucagauuccgaagguaaagacacaccaggaggcuacugccucacaagauggaugcuaauagaagcagaacuaaaaugcuucggcaacacagcuguagcaaaaugcaacgaaaaacacgacgaagaauuuugugacaugcuccgauuauucgauuuuaacaaacaagcaauacaaagacucaaagcagaagcccaaaugucaauacaacuaauaaacaaagcaguaaacgcacuaauaaaugaccaacuuauuaugaaaaaccaccuaagagacauaaugggaauaccauacugcaacuacagcaaauauugguaccucaaucacaccacaaccggaaaaacuucauuaccaaaaugcuggcuaguaucaaacggaucauacuuaaacgaaacacauuucucagacgauauagaacaacaagcagacaacaugaucacagaaaugcuacaaaaagaauacauggaaagacaaggcaaaacaccccuaggauuaguugaccuauucgucuucucaacaagcuucuaccuaaucucaauauuccuacacuuaguaaaaauccccacacauagacacaucguaggaaaaccaugcccaaaaccucacagauuaaaccauauggguauuuguucaugcggacuauacaaacaaccaggaguaccgguaaaauggaaaagauaa

SEQ ID NO: 2653 - RNA, 1476 nt, Artificial Sequence
  derived and/or modified CDS sequence (opt6) from Lassa virus__AIT17146__GPC
augggacaaaucguaacauuuuuccaagaaguaccacacguaauagaagaaguaaugaacauaguccuaauagcuuuauccauauuagcaguauuaaaaggccuauacaaucucgcaacuugcgguuuaguugguuuaguaaccuuccuacuacuauguggcaggucaugcacaacaucuuuauacaaaggaguuuacgaacuacaaacccuagaacucaacauggagacucuaaacaugaccaugccccuaucuuguacaaaaaacaauucacaccacuacaucaugguagguaaugaaacaggauuagaacuaacauuaaccaacacaucaauaaucaaccauaaauucugcaauuuaucugaugcacauaaaaaaaaucuauaugaccacgcauuaauguccauaauaaguaccuuccaucuauccauaccaaacuuuaaucaauaugaagcaaugucaugcgacuuuaacggagguaaaauauccguacaauauaacuuaucacauucauacgcaggagaugcagcaaaccauugcggaaccguagccaauggaguacuacaaacauuuaugagaauggcauggggcggauccuacauagcauuagacucagguagaggaagaugggacugcaucaugacaaguuaucaauaccuaauaauacaaaauaccaccugggaagaccacugcucauuuucaagaccaucaccaauaggauacuuaggccuauuaucucaaagaaccagagacauauauauaucaagaagacucuuaggaaccuucacauggacacuauccgauucagaagguaaagacacccccggaggauauugcuuaacaagguggaugcuuauagaagcagaacuaaaaugcuucggaaauacagcaguagcaaaaugcaaugaaaaacacgacgaagaauucugcgacaugcuaagacuauuugauuuuaacaaacaagcaauucaacgccuaaaagcagaagcacaaaugucaauacaacucauaaauaaagcaguaaacgcacuuauaaacgaccaacuaauaaugaaaaaccacuuaagagacauaaugggaauuccauacugcaacuauucaaaauauugguaccuaaaccauaccacaaccggaaaaacaucacuaccaaaaugcugguuaguauccaacggaucauaucuuaacgaaacacacuucuccgaugacauugaacaacaagcagacaacaugauaacagaaaugcuacaaaaagaauauauggaaagacaaggcaaaacaccacuaggacucgucgauuuauucgucuucucaacauccuucuaccuaauauccauuuuccuacaucucguaaaaauuccaacccacagacacauaguuggcaaaucauguccaaaaccacaccgacuaaaccauaugggaauauguucaugcggauucuauaaacaacccgguguaccaguaaaauggaaaagauaa

SEQ ID NO: 2654 - RNA, 1476 nt, Artificial Sequence
  derived and/or modified CDS sequence (opt6) from Lassa virus__AIT17154__GPC
augggacaaauuguuacauuuuuccaagaaguaccacacguaauagaagaaguaaugaacauaguuuuaauagcacuauccauccuagcaguauuaaaaggacuauauaacuucgcaacaugcggaauuguaggcuuaguaucauucuuauuauuaugcggaagaucaugcacaacaucccuauacaaagguguauaugaacuacaaacccucgaauuaaauauggaaacucuaaacaugaccaugccacuaagcuguacaaaaaacaauucucaccauuauauuauggucggaaacgaaacaggacuagaacuaacacucacaaacacaucaauaaucaaccacaaauuuuguaaccuauccgaugcucacaaaaaaaacuuauacgaccacgcacuuauguccauaauauccacauuucacuugucaauaccuaacuucaaucaauacgaagcaaugucuugcgacuucaacgguggaaaaauauccguacaauacaaucuaagccauucuuaugcaggagacgccgcuaaucacuguggaacaauagccaacggaguccuacaaacauuuaugcgaauggcauggggcgguucauacauagccuuagacucaggaagagaccgaugggacugcauaaugacaucuuaccaauauuuaauaauacaaaacaccacaugggaagaccauugccaauucucccgacccucaccaauaggauaccugggacuccucucacaaagaacaagagauauauauauaagcagaagacuauuaggaacuuucacauggacucuauccgacucagaaggaaaagauacaccaggaggcuacugucuuacaagauggauguuaauagaagcagaacuaaaauguuuugguaauacugcaguagcaaaaugcaaugaaaaacaugaugaagaauuuugcgauauguuaagacucuucgacuuuaauaaacaagcaauacaaagacuaaaagccgaagcacaaauguccauacaacuuauaaauaaagcaguuaacgcauuaaucaaugaucaacucauaaugaaaaaccaccuuagagacauaaugggcaucccuuauugcaauuauuccaaauacugguaccuaaaccauacaacaacuggaaaaaccucauuaccaaaaugcugguuagucagcaauggaucauaccuuaacgaaacacacuucucagacgacauagaacaacaagccgacaacaugauaacagaaaugcuacaaaaagaauacauggaaagacaagguaaaacuccucuaggacuaguagaucuauucguauucucaacaucauucuacuuaauuucaauauuucuacaccuagucaaaauaccaacacaccgacacguaguaggaaaaaguuguccaaaaccacacagacuuaaucauaugggaauuugcuccugcggauuauacggacaaccagguguaccugucaaauggaaaagauaa

SEQ ID NO: 2655 - RNA, 1476 nt, Artificial Sequence
  derived and/or modified CDS sequence (opt6) from Lassa virus__AIT17158__GPC
augggacaaauagucacauuuuuucaagaaguaccacacguaauagaagaaguaaugaacauaguacuaauagcauuaucuauacuagcaguacuaaaaggucuauacaauuucgccacaugcggauuagucggccuagucacauuccuacuauuauguggaagaucuugcacaacaucacuauauaaaggaguauacgaauuacaaacauuagaauuaaacauggaaacauuaaacaugacaaugccacucucuugcacaaaaaacaacucccaccacuacauaauggucggaaacgaaacuggucucgaacuaacauuaacaaacacaucuaucauaaaucauaaauuuuguaaucucucagacgcacacaaaaaaaaccucuacgaccacgcacuaaugucaauaaucucaaccuuccaccuaucaauaccaaacuucaaccaauacgaagccauguccugcgacuucaacggaggaaaaauaucaguacaauacaaucuaucucauucauacgcaggagacgcagccaaccauugcgguacaguagccaacggaguacuacaaacauucaugagaauggcuuggggcggaagcuacauagcacucgacuccggaagagacagaugggacugcauaaugaccucauaucaauaucuaauaauacaaaacacaacaugggaagaccauugccaauucucaagacccucaccaaucggauacuuaggauuauuaucacaaagaacaagagacauauacauaucaagaaggcuauuaggaacauucaccuggacacuaucagauucagaaggaaaagacacaccaggaggcuauugccuaacaagauggauguuaauagaagcagaacuaaaauguuucggaaauacagcuguagcaaaaugcaacgaaaaacacgacgaagaauucugcgacaugcuacgacuauucgacuuuaacaaacaagcaauacaaagauuaaaagcugaagcacaaaugucaauccaacuaauaaacaaagcaguuaacgccuuaauaaacgaccaacucauaaugaaaaaccaccuuagagauaucaugggaauuccauacugcaauuacaguaaauacugguaccucaaccauacaacuacaggcaaaacaucucuaccaaaaugcuggcucguuucaaacgguucauaccuuaaugaaacucauuucucagaugauauagaacaacaagccgacaauaugaucacagaaaugcuccaaaaagaauauauggaacgacaaggaaaaacaccauuaggacuaguagaucucuucgucuucucaaccuccuucuaccuaauuucaauauuccuacacuuagucaaaaucccaacacaccgacauauaguagguaaaaguuguccaaaaccacacagacucaaccacaugggaaucugcucauguggacucuacaaacaaccuggaguacccguaaaauggaaaagauaa

SEQ ID NO: 2656 - RNA, 1476 nt, Artificial Sequence
  derived and/or modified CDS sequence (opt6) from Lassa virus__AIT17164__GPC
augggacaaauaguaaccuuuuuucaagaaguaccacauguaauagaagaaguaaugaacaucguacuuauagcauuaucgauacuagcaguccuaaaaggacuauacaauuucgcaacuugcggccuaguaggacucguaacauuccuacuacucuguggcagaucaugcacaucuagucuauauaaaggaguauacgaacuccaaacacuagaacucaauauggaaacucuaaauaugaccaugccccuaucauguacaaaaaauaacucacaccacuacauaagaguaggaaacgaaacaggauuagaauuaacacuaacaaacacaucaaucauagaccauaaauuuugcaacuuaucagacgcccacaaaaaaaacuuauaugaucacgcacucaugaguauaauaucaacauuucaccuaucaaucccaaacuucaaccaauacgaagcaaugucaugcgacuucaauggaggaaaaauaucaguacaauacaauuuaucacacuccuacgccggagacgcagcuaaacacugugguacaguagcaaacggaguauuacaaacauucaugagaauggcaugggguggaucuuauauagccuuagacucuggacacggaaacugggacuguauaaugaccucauaccaauaucucaucauacaaaacacaacaugggaagaccauugucaauuuucacgcccauccccaaucgguuaucuaggccuacucucacaaagaacaagagacaucuacaucucccgaagacuacuaggaacauucacauggacacuaucagauucagaagguaaugacgcccccggagguuacugcuuaacaagauggaugcuaauucaagcagaauuaaaaugcuucggaaacacugcuguugccaaauguaacgaaaaacacgacgaagaauucugugacauguuaagacuuuuugacuuuaauaaacaagcaauccaaagacuaaaagcagaagcacaaaugaguauccaacuaauaaauaaagcaguaaacgcacuaauuaaugaccaauuaaucaugaaaaaucaccuaagggacauaaugggaauuccauacuguaacuacucaaaauauugguauuuaaaccauacaacaacaggacgcacaucccuaccaagauguuggcuaguaucaaacggauccuaccuaaacgaaacacacuucucagacgacauugaacaacaagcagacaacaugauaacugaaaugcuacaaaaagaauacauggaaagacaagguaaaaccccacuaggauuaguagaccuauucgucuucucaacaucauuuuauuuaauaucaauauuuuuacauuuagucaaaauaccaacacauagacacauaguugguaaaucuugccccaaaccacaucgacuaaaccauaugggaauauguuccuguggucuauucaaacaaccaggcguacccguuaaauggaaacgcuaa

SEQ ID NO: 2657 - RNA, 1476 nt, Artificial Sequence
  derived and/or modified CDS sequence (opt6) from Lassa virus__AIT17168__GPC
augggacaaauagucacguucuuccaagaaguuccacaugucauagaagaaguaaugaacaucguacucaucgcauuaagcauacuagcaguauuaaaaggcuuauacaacuucgcaacaugcggacuaguaggacuauuaacauuucuacucuuaugcggccgaucaugcaccgcaagcagauacaaagguguauaugaacuucaaacccucgaacuaaacauggaaacccuuaauaugacaaugccacuaucaugcaccaaaaauaauagccaccacuacaucaugguuggaaacgaaaccggauuagaacuaacucucacaaacacaucaauaauaaaucacaaauucuguaaccuaucugacgcacacaaaaaaaauuuauacgaucaugcauuaaugucaauuauuuccacauuucaucuauccauaccaaacuucaaccaauacgaagccaugucaugugauuucaacggaggaaaaauuuccguacaauacaaccuaucacauucauacgccggcgacgcagcaaaccacugcgguacaguagcuaacggaguacuccaaacauuuaugcguauggcauggggcggcucauacauagcacucgacucaggccacggaucaugggauugcauuaugacuuccuaccaauacuuaaucauacaaaacacaacaugggaagaucacugccaauucucaagaccauccccaauuggauaucucggauuauuaucucaaagaacaagagacauauacauuucaagaagacuauuaggaacuuucacauggacacuaucagacuccgaaggaaaagauaccccaggaggcuauugccuaacacgcuggaugcucauagaagcagaauuaaaauguuucggaaacacagccguagcaaaauguaacgaaaaacacgaugaagaguucugugacaugcucagauuauucgauuuuaacaaacaagcaauacaacgccuaaaagcagaagcacaaauguccauacaacuaaucaacaaagcuguaaacgcccuaauaaacgaccaacuaauaaugaaaaaccaccuaagagacauaaugggaauaccauacugcaacuacuccaaauacugguacuuaaaccauacaacaacaggaaaaaccagccuaccaaaauguuggcucgucucaaacggcagcuacuuaaaugaaacucacuucucagacgacauagaacaacaagcagacaacaugauuacagaaaugcuacaaaaagaauacauggaaagacaaggaaaaacaccauuaggacuaguugacuuauucguauucucaacauccuucuauuuaauaucaauuuuucuccaucuaguaaaaauacccacacauagacauaucguaggcaaaucaugccccaaaccacauagauuaaaccauaugggaauauguucaugcggauuauacaaacaacccggaguaccagucaaauggaaaagauaa

SEQ ID NO: 2658 - RNA, 1476 nt, Artificial Sequence
  derived and/or modified CDS sequence (opt6) from Lassa virus__AIT17172__GPC
augggccaaauaguuacauucuuccaagaaguuccacacguaauagaagaaguaaugaacauaguacuuauagcacuaucaauacucgccguacuaaaaggacuauauaauuucgcaacaugcggccucguagguuuaguaacauuccuacuacuuugcggccgaucaugcacaacaucuuuauacaaaggcguuuacgaacuacaaacucuugaauuaaauauggaaacauuaaauaugacaaugccacucucaugcacuaaaaacaauucacaucacuauauaaugguaggaaacgaaacaggacucgaacuaacacuaaccaacacauccauaauaaaccacaaauuuuguaaccuuucagacgcacauaaaaaaaacuuauacgaccacgcacuaaugucaauuauauccacauuccacuuaucaauaccaaacuucaaucaauaugaagcaaugucaugcgacuuuaacggaggcaaaauaaguguacaauauaauuuaucucacucuuaugcaggagacgcagccaaccacugcggaacaguagcaaacggaguauuacaaaccuuuaugagaauggcauggggaggaucauacauagcacuagauucaggaagaggaagaugggacugcauuaugacaucauaccaauaccuaauaauacaaaacacaaccugggaagaccacugccaauuuucccgaccaagcccaauaggcuaccuaggacuauuaucacaaagaaccagagacaucuacauaucaagacgcuuauuaggcacauuuacauggacucuauccgacucagaaggaaaagacacaccagguggauauugcuuaaccagauggaugcuaauagaagcugaacuaaaauguuucggaaauacagccguagcuaaaugcaacgaaaaacaugacgaagaauucugcgauauguuaagacuauuugauuucaauaaacaagcuauacaaagauuaaaagcugaagcacaaaugucuauacaacuaaucaacaaagcuguaaaugcacuuauaaacgaccaacucauaaugaaaaaucaucuaagagacauaaugggaauaccauacuguaacuacagcaaauacugguauuuaaaccauacuacaacaggaaaaacaucacuaccaaaaugcugguuaguaucaaacggaucauacuuaaacgaaacacacuucucagaugacauagaacaacaagcagauaacaugauaacagaaaugcuccaaaaagaauacauggaacgacaagguaaaacuccacuagguuuagucgacuuauucguauucuccacaucauucuaucuuauuucaauauuucuacacuuaguaaaaaucccaacucauagacacauagucggaaaaccauguccccgaccucacagauuaaaucauaugggcaucugcucauguggauuauacaaacaaccaggaguaccuguaaaauggaaaagauaa

SEQ ID NO: 2659 - RNA, 1476 nt, Artificial Sequence
  derived and/or modified CDS sequence (opt6) from Lassa virus__AIT17176__GPC
augggacaaauaguaacauucuuucaagaaguuccccacguuauagaagaagucaugaacauaguauuaauagccuuaucacuacuagcaguacuaaaaggucuauacaauguagcaacauguggauuaauaggacuaaucacauuucuauuauuauguggaagaucaugcacaacuaacuuauauaaaggagucuacgaacuacaagcauuagaacuuaauauggaaacauuaaauaugaccaugcccuuaagcugcacuaaaaacaacucacaucacuacauaaugguaggaaacgaaacaggcuuagaacuaacauuaacaaacacaucuauaauuaaccacaaauucugcaaccuaucagaugcacacaaaaaaaaccuauacgaucaugcacucaugagcauaauaucaacauuucacuuaucaauaccuaacuucaaucaauacgaagcaaugucaugugacuucaacggcggacguauaucaguacaauacaaccuaucccacucauacgcaggagacgcugccucacacuguggaacuauagcaaacggcguauuacaaacauucaugagaauggcauggggaggcuccuacauagcauuagacucaggacacggaggaugggacugcauaaugacaucauaucaguaccuaaucauacaaaacacaacaugggaagaccacugccaauuuucacgacccucaccaauaggauacuuaggacuacuuucucaacgaacaagagacauauacauaucaagaagauuauuaggaacauucacauggacauuaagugacucagaaggaaaagacacacccggcggauauugccuaacaagauggauguuaauagaagcagaacuaaaaugcuucgguaacaccgcaguugcaaaauguaacgaaaaacacgacgaagaauucugcgacauguuaagacuauucgacuucaacaaacaagcaauccaaagacuaaaagcagaagcacaaauguccauacaauuaauaaauaaagcagucaacgcacuaauaaaugaccaacuuauaaugaaaaaccaccuaagagacauaaugggcauaccauacugcaacuacucaaaauacugguaccucaaccacacaguaacagguaaaaccucccuacccaaauguuggcucguuucaaacggaucauaucuaaaugaaacacauuucucagacgauauagaacaacaagcagauaauaugauaacagaaaugcuucaaaaagaauauauggaaagacaaggaaaaacuccacuaggacuaguagacuuauucgucuucucaacuaguuucuaccucaucucaauauuccuacaccucguaaaaauaccaacacauagacacguagucgguaaaccgugucccaaaccacaccgacucaaccacaugggaauauguucauguggccuauauaaacaaccaggagucccaguuagauggaaaagauaa

SEQ ID NO: 2660 - RNA, 1476 nt, Artificial Sequence
  derived and/or modified CDS sequence (opt6) from Lassa virus__AIT17180__GPC
augggacaaauagucacauucuuccaagaaguaccacauguaauagaagaagucaugaacauuguccuaauagcauuaaguauacuugcaguacuuaaaggacuauacaacgucgcaacuugcggauuaauaggacuaguaacuuuuuuauuauuauguggacgaaguugcacaacaacacucuacaaaggaguauacgaauuacaaacacuagaacuuaauauggaaacacuaaauaugacaaugccacuaucuuguacaaaaaacaacucacaccacuacauaagaguaggaaaugaaacaggacucgaauuaacucuaacaaacacaagcaucauaaaucacaaauuuugcaacuuauccgacgcacacaaaaaaaaccuauacgaucaugcacuaaugagcauaauaucaaccuuccaccuaucaauaccaaauuucaaccaauacgaggcaaugucaugugacuucaacggaggcaaaauaucaguacaauauaaccuaucacacucauacgcaggagacgccgcaaaucacugcggcacaguagcaaauggaguacuacaaacauucaugcgaauggcauggggaggaagcuauauugcacuagacucaggaagaggaaacugggauugcauaaugaccucauaccaauaucuaauaauacaaaacacuacaugggaugaccacugucaauucucacgaccaucaccaauaggauacuuaggauuacuaagccaaagaacccgcgacguauacauaaguagaagauuauuaggaaccuucacuuggacccucucagacucagaaggaaaagacacucccggcggauacugcuuaacaagauggaugcuaauagaagcagaacuaaaaugcuucggaaacacagcaguagccaaaugcaacgaaaaacacgaugaagaauucugugacaugcuaagacuauucgauuucaauaaacaagcaauacaaagacuaaaagcagaagcacaaaugagcauacaauuaaucaacaaagcaguaaacgcauuaauaaaugaccaacucaucaugaaaaaccacuuaagagacauaaugggaauaccauacuguaacuacaguaaauacugguauuuaaacaacacagcaaccggaaaaacaaguuuaccuaaauguuggcuaauaucaaacggauccuaccuaaacgaaacccauuucucugaugacaucgaacaagaagcagacaacaugauaacagaaaugcuacaaaaagaauacauggaaagacaaggaaaaacaccuuuaggauuaguagaccuuuucguauuuucaacuucauuuuaucuaauaucuauauuucuccaccuaguaaaaauaccaacacauaggcacauaguuggaaaaucaugcccaaaaccacauagauuaaaccauaugggaauauguucaugcggauuauacaaacaaccaggaguaccaguaagauggaaaagauaa

SEQ ID NO: 2661 - RNA, 1476 nt, Artificial Sequence
  derived and/or modified CDS sequence (opt6) from Lassa virus__AIT17184__GPC
augggacaaauaguaacauuuuuccaagaaguaccacacguaauagaggaagugaugaauaucguauuaauagcauuaucaauauuagcaguccuaaaaggcuuauacaacguagcaacaugcggauuaauaggccuaguaaccuuuuuacucuuauguggacgcucauguacaacuacauuauauaaagguguuuaugaacuacaagcucucgaauuaaacauggaaacccuaaacaugaccaugccauuaucaugcacaaaaaauaauucacaccauuacauaagagucgguaacgaaacaggacuagaauuaacauuaaccaacacaucaauaaucgaucauaaauucugcaaccuaucagaugcacacaaaaaaaaucuuuacgaccacgcacucaugucuauaauaucaacauuucaccuaucuauaccaaacuucaaucaauacgaagcaaugucaugugauuucaauggcggaaaaauauccguacaauauaauuuaucccauuccuacgcaggcgacgcagcaaaucacugcggcacagucgcuaacggcguauuacaaaccuucaugcgaauggccuggggaggaucauacauagcacuugacucaggaagaaacggaugggacugcauaaugacaucauaccaauacuuaauaauacaaaacacaacaugggaugaccacugccaauuuucacguccaucacccauaggauaccuaggacuacuaucccaaagaacacgcgauauauacauaucuagaagacuccuagguacauuuacauggacauuaucagauucugaagguaaagacacaccaggaggcuacugcuuaacaagauggaugcucaucgaagccgaacuaaaauguuucggaaacacagccguagcuaaaugcaaugaaaaacacgacgaagaauucugugacauguuaagacucuucgacuucaacaaacaagcaauaagaagacuaaaagcagaagcacaaaugucuauucaauuaaucaauaaagcaguaaacgcauugaucaaugaccaacuaauaaugaaaaaccaccuaagagacauaaugggcaucccauauugcaauuacucuaaauacugguauuuaaauaacaccgcaacaggcaaaaccucacucccacgauguuggcuaguauccaauggaucauaccuaaacgaaacacauuucagugacgauauagaacaacaagcagacaauaugaucacagaaaugcuacaaagagaauauauggaacgacaaggaaaaacaccacuaggacuaguagaccuauucgucuucaguacaucauucuaccucauaucaauauuccuacaccucguaaaaauaccaacucacagacacauaguaggaaaaccaugcccaaaaccacacagacuaaaccauaugggaauaugcucaugcggucuauacaaacaaccaggaguacccguaaaauggaaaagauaa

SEQ ID NO: 2662 - RNA, 1476 nt, Artificial Sequence
  derived and/or modified CDS sequence (opt6) from Lassa virus__AIT17188__GPC
augggccaaauaguaacauucuuucaagaaguuccacaugucauagaagaaguuaugaauauaguauuaauugcacuaucaauacuagcaguccuuaaaggcuuauacaacuuugcaaccugcggauucguaggacuagucucauuccuauuacuaugcggacgaucuuguacaacaucacucuacaaaggaguauaugaacuacaaacacuagaauuaaauauggaaacauuaaacaugaccaugccccuaucaugcaccaaaaauaacagucaccauuacaucaugguaggcaaugaaaccggccuagaacucacacuaacaaauacaucaauaauuaaccacaaauucugcaauuuauccgacgcacauaaaaaaaaccuauacgaccacgcacuaaugucaauaauauccacauuccaccuaucuauaccaaauuuuaaucaauaugaagcaaugucuugcgacuuuaacggcggaaaaauaucaguucaauacaaccuaucacacucauacgcaguagacgccgcaaaucacugcggaacaguagccaacggcgucuuacaaacauucaugagaauggcuuggggcgguagcuauauagccuuagauucaggacacggauccugggacugcaucaugacauccuaccaauaccuaaucauacaaaacacaacaugggaagaucauugccaauuuagcagaccuucaccaauaggauacuuaggcuuacucucacaaagaacaagagacauauauauaucaagacgacuacuaggaacauuuacauggacacucucagauuccgaaggaaaagacacaccaggaggauauugcuuaacaagauggauguuaauagaagccgaacuaaaaugcuucggaaauacagccgucgcuaaauguaaugaaaaacacgacgaagaauuuugcgacaugcuacgacuuuucgauuucaauaaacaagcaauucaaagauuaagagccgaagcacaaaugucuauacaacuaaucaauaaagcaguaaaugccuuaaucaacgaccaacuaauaaugaaaaaccacuuacgagacaucaugggaauaccauauugcaauuacuccaaauauugguaucuaaaucauacaacuaccggaagaacaucauuaccuaaauguuggcuuguaucaaacggaucauacuuaaacgaaacacacuucagugacgauauagaacaacaagcagacaacaugauaaccgaaaugcuacaaaaagaauauauggaacgccaaggcaaaacaccucuuggcuuaguagaccuauucguauucagcacuucuuucuaucuaauaucaauauuuuuacaccuaguaaaaauaccaacacacagacacaucguuggaaaauccugucccaaaccacacagauuaaaccacaugggaauauguucauguggauuauacggucaaccaggaguaccaguaaaauggaaacgauga

SEQ ID NO: 2663 - RNA, 1476 nt, Artificial Sequence
  derived and/or modified CDS sequence (opt6) from Lassa virus__AIT17192__GPC
augggccaaaucguaacauucuuccaagaaguaccccacguaauagaagaaguaaugaacaucguucuaauagcauuaagcauacuagcaguuuuaaaaggacuauacaauuuugcaacaugugguuuuauaggacuaguaucauuccuucuacuaugcggaagaucauguacaacaucacuauacaaaggaguauaugaguuacaaacacuagaauuaaacauggaaaccuuaaacaugacaaugcccuuaucauguacuaaaaacaacagccaccacuacauaaugguugguaaugaaaccggacuagagcuaacacuaacaaacacaucaauaauaaaccacaaauucugcaaucuuucagacgcucacaaaaaaaauuuauacgaccacgcauuaaugucuaucauaucaacauuccaccuuucaauacccaacuuuaaccaauucgaagccaugucaugcgauuuuaacggcggaaaaauaucaguacaauauaacuuaucacacuccuaugcuguugacgcagccaaccauugcggaacaguugcuaacggaguccuacaaacauucaugagaauggcauggggaggaucauacauagccuuagacucaggacaugguucaugggacuguauaaugacaucauaucaauacuuaauaauacaaaauacaacuugggaagaccauugccaauuuuccagaccaucaccaaucggcuaucucggucucuuaucacaaagaacaagagauauauauauauccagacgucuacuaggaacauuuacuuggacacucucagauagcgaaggaaaagacacaccaggagguuauugucuaacucgauggaugcucauugaagcagaacuaaaaugcuucggaaauacagccguugcaaaaugcaacgaaaaacaugacgaagaauucugugauaugcuacgauuauucgacuucaacaaacaagcaauacaaagauuaaaagcagaagcccaaaugucaauacaauuaauaaacaaagcaguaaacgcacuaaucaacgaccaauuaauaaugaaaaaccaccuacgagacauaaugggaauccccuacuguaacuacucaaaauacugguaccuaaaccacaccaccacaggccgaacaucacuaccaaaauguuggcuaguaagcaacggaucuuauuuaaacgaaacccacuucucagacgacaucgaacagcaagcugacaauaugauaacagaaauguuacaaaaagaauauauggaacgacaaggaaaaacaccccuaggacuaguagaccuauucguauucucaacauccuucuaccuaaucuccauauuuuuacaucuaguaaaaauaccaacacacagacacauaguaggaaaaucaugcccaaaaccucacagacuaaaccauaugggaauauguucaugcggccuuuacggucaaccugguguacccguaaaauggaaaagauaa

SEQ ID NO: 2664 - RNA, 1476 nt, Artificial Sequence
  derived and/or modified CDS sequence (opt6) from Lassa virus__AIT17196__GPC
augggacaaauaguaacauucuuccaagaaguaccgcacguaauagaagaaguaaugaacauaguacucaucgcccucaguauacucgccguccuaaaaggacuauauaacuuagcaacauguggauuaguuggauuaguaacauuccuacuauuaugcggaagaucauguacaacuucccuauauaaaggaguauacgaacuacaaacccucgaacuaaacauggaaacacuaaauaugacaaugccacuaucauguaccaaaaacaauucacaccauuauauaaugguaggcaaugaaacaggacuagaacuaacauuaacaaauacaucuauaaucaaccacaaauucuguaacuuaucagaugcccacaagaaaaaccuuuacgaccacgcacuaaugucuauaauaucaaccuuccaccuaucuauaccaaacuucaaccaauacgaagcaauguccugcgacuuuaacggcggaaaaauaucaguacaauacaaccuaucacacucauaugcaggagacgcagcuaaccauugcggaaccgucgcaaacggaguauuacaaacauucaugagaauggcauggggcggaaguuacauagcauuagacuccggacgaggaagaugggauugcauaaugacaucauaccaauaucuaauaauacaaaauacuacuugggaagaccacugccaauucucacgccccucacccauuggauaccuaggacuacuaucacaacgaacaagagacauauacaucagccgaagacuacuaggcacauuuacauggacccuaucagacucugaaggaaaagauacaccaggaggcuacugcuuaacacgauggaugcuaauagaagcagaauuaaaaugcuuuggaaauacagcaguagcuaaaugcaaugaaaaacaugacgaagaguucugugacaugcuuagacuuuucgacuucaacaaacaagcaauacaaagauuaaaagccgaagcacaaaugaacauccaacuaauaaacaaagcaguaaacgcacuuauaaacgaccaauuaaucaugaaaaaccaccuaagagauauaaugggaauaccauauuguaacuauuccaaguacugguaccucaaucacacaacaacaggaaaaacaucacuaccuagaugcuggcuaguaagcaacggaucauaccuaaacgaaacccacuuuucagacgauauagaacaacaagccgacaacaugauaacagaaaugcuucaaaaagaauauauggaaagacaaggaaaaacaccccuaggccuagucgaccuauucguauucucaacaucuuucuaccuaauaucaaucuuccuacaucuuguaaaaauaccuacccauagacacauaguuggaaaacccugcccaaaaccacaccgacuaaaccacaugggaauaugcucauguggauuuuacaaacaaccaggaguuccagucaaauggaaaagauaa

SEQ ID NO: 2665 - RNA, 1476 nt, Artificial Sequence
  derived and/or modified CDS sequence (opt6) from Lassa virus__AIT17204__GPC
augggccaaauagucacauucuuucaagaaguuccacauguaauagaagaaguaaugaauauaguacuaauagcacuaucaauauuagcaguuuuaaaaggauuauauaauuuagcuacaugcggacuaguaggacuaguaacuuuccuacuacuaugcggacgaaguugcacauccucacuauacaaagguguauacgaacuacaaacacuagaacuaaauauggaaacccuaaauaugacaaugccccucucuugcacaaaaaacucuagccaucacuacauaagaguaggaaaugaaacagguuuagaacuuacauuaaccaauacuucaauaauaaaucauaaauucugcaauuuaucagacgcacacaaaaaaaaccuauaugaccacgcauuaaugagcauaauaucaacauuucaccuaucaauuccuaacuuuaaccaauacgaagcaaugucaugcgacuuuaacggaggaaaaauaucaguacaauacaaccuaagccacucuuaugcaggagacgccgccaaccacugcggaacagucgcaaauggaguacuacaaacauucaugcgaauggcauggggcggauccuacauagcucuagacucuggacacgauagaugggacugcauaaugacaucuuaucaauaccuuauaauacaaaauacaacaugggaagaccacugucaauucucccgaccgucccccauaggauaccuaggucucuuaucacaaagaacaagagacauauauauuucacgaagacuauuaggaacauucacauggacucucucugacucagaaggaaaagacacacccggaggauacugcuuaacaagauggaugcuaauagaagcagaacuaaaaugcuuuggaaauacagcaguggcaaaaugcaaugaaaaacacgaugaagaauuuugcgacauguuacgacuauucgacuuuaauaaacaagcaauccaaagacuaaaagcagaagcacaaaugucaauacaacugauaaacaaagcaguaaaugcacuaauaaacgaucaacuuauaaugaaaaaucaccuaagagacauaaugggaauaccauacugcaacuauaguaaauacugguacuuaaaccacacaauaacaggaaaaacaucacuccccaaaugcugguuaguaucaaauggaucauaccuaaauaaaacacacuuuucagacgacauagaacaacaagcagacaauaugauaacagaaaugcuacaaaaagaauacauggaaagacaaggaaaaaccccuuuaggacuaguagaccuauucguauucucaacaucauucuaccuaaucucaauauuucuacaucuaauaaaaauaccaacacacagacacauaguuggcaaaccauguccuaaaccacauagacuaaaccauaugggaauuugcucuuguggacuauauaaacaaccaggaguuccagucaaauggaaacgauag

SEQ ID NO: 2666 - RNA, 1476 nt, Artificial Sequence
  derived and/or modified CDS sequence (opt6) from Lassa virus__AIT17208__GPC
augggacaaauuguuacuuuuuuucaagaaguaccacacguaauagaagaaguuaugaauauagucuuaauagcccucucuauauuagcuguucuaaaagggcuauauaacuucgcaacuuguggacucauaggacuaguaacauuccuauuauuaugcggacgcucaugcacaaccucacuauacaaaggaguuuacgaacuacaaacacuagagcuaaacauggaaacuuuaaacaugacuaugccucuauccuguacaaaaaacaacagccaccacuauauaaugguagguaacgaaacaggacuagaacucacacuaacaaauacaucaauaauaaaccauaaauucuguaaccucucagaugcucacaaaaaaaaucuuuacgaccacgcacuaaugaguauaaucucaacauuccauuuaucaauacccaacuucaaccaauacgaagcaaugucaugcgacuucaacggaggaaaaauaucaguacaauacaaccuaagucacucauacgcaggagacgcagcaaaccacuguggaacugucgcaaacggaguacuacaaaccuucaugagaauggccuggggugguagcuauauagcacuagacagcggaagaggccaaugggauuguaucaugacaucauaucaauaccucaucauacaaaauaccacaugggaagaccacugucaauuuucacgaccaucaccaauagguuaccucggacuacuaucacaaagaacccgagauauauauauaucacgaagacuacuaggcacauucacauggacccuauccgauucagaaggaaaagacacaccaggaggauacugcuuaaccagauggaugcucauagaagccgaacuaaaaugcuuuggaaauacagcaguagccaaaugcaacgaaaaacaugacgaagaauucugcgauaugcuaagacuuuuugacuucaauaaacaagcaauccagagacuuaaagcagaagcacaaaugucuauacaauuaauaaacaaagcaguaaaugcauuaauaaacgaccaacucauaaugaaaaaccacuuaagagacauaaugggaauaccauacugcaacuacucaaaauauugguacuuaaaucacacuacaaccggaaaaaccucucuaccaaaauguuggcucguaucaaauggaucauaucucaacgagacccauuucucagacgauauugaacaacaagcagacaauaugauaacggaaaugcuacaaaaagaauacauggaaagacaaggcaaaacaccacuaggacuaguagaccuauuuguauucucaacaucauucuacuuaaucucaauauuucuacaccuaguuaaaauaccaacacacagacauauaguaggaaaaucaugcccaaaaccacauagacuuaaccauaugggaaucugcucuugcggauuauauaaacaaccaggaguaccuguaaaauggaaaagauaa

SEQ ID NO: 2667 - RNA, 1476 nt, Artificial Sequence
  derived and/or modified CDS sequence (opt6) from Lassa virus__AIT17210__GPC
augggacaaauaguaacuuucuuucaagaaguuccacacguaauagaagaaguaaugaauauaguacuaauagcacuauccauacuugcaguacuaaaaggauuauacaaccuagcaacaugcggucucgucggccuaguaacauuuuuacuccucugcggcagauccuguacaacaucccuuuacaaaggcguauacgaacuacaaacacuagaacucaacauggaaacauuaaauaugacaaugccauuaucaugcacaaaaaauaacucacaucauuauauaaugguagguaaugaaacaggacuagaacuaacccuaacaaauacaucaauaauaaaccacaaauucugcaaccuauccgacgcacacaaaaaaaaccuauaugaucaugcauuaaugucuauaauauccacauuucacuuaucaauacccaacuuuaaccaauacgaagcaaugucaugcgauuucaacggaggaaaaauuucaguacaauauaaucuaucucacucauaugccggagacgcagcaaaccacuguggcacagucgcaaacggaguauuacaaacauucaugcgaauggccuggggaggauccuacauagcccuagauucaggaagagauagaugggacugcauaaugaccucauaucaauaccuuauaauacaaaacaccacaugggaagaccacugucaauuuagcagaccaagcccaauaggauaccuagguuuauuaucacaaagaacaagagauauauauauaucccguagacuacuaggaacuuuuacauggacacuaucagacucagaaggaaaagacacaccaggaggauacugcuuaacaagauggaugcuaauagaagccgaacuaaaaugcuucggcaacacagccgucgcuaaauguaacgaaaaacaugaugaagaauucugcgacaugcucagacuauucgauuucaauaaacaagccauacaaagacuuaaagcagaagcacaaaugaguauacaauuaauaaacaaagccguuaacgcauuaaucaaugaccaacuaauaaugaaaaaucaccuuagagauauaaugggaauacccuacuguaauuauucaaaauacugguacuuaaaccacacaacaacaggaaaaacaucacuacccaaaugcuggcuaguaucuaauggcucauauuuaaacgaaacccacuucucagacgauaucgaacaacaagcagacaacaugauaacagaaauguuacaaaaagaauacauggaaagacaagguaaaacaccucuaggauuaguugaccucuuugucuuuucaacaucauucuaucucauauccauuuuucuaagacuuguaaaaaucccuacacacagacacauaguuggcaaaccaugcccaaaaccacacagacuaaaccauauggguauauguucauguggucucuacaaacaaccaggaguaccagucaaauggaaacgauaa

SEQ ID NO: 2668 - RNA, 1476 nt, Artificial Sequence
  derived and/or modified CDS sequence (opt6) from Lassa virus__AIT17212__GPC
augggccaaauuguuacauucuuucaagaagucccacacguaauagaagaaguaaugaacauaguauuaauagcacucucaauauuagccguauuaaaaggacucuacaacuuagcaacuuguggccuaguaggucuaguaaccuuccuccuacuaugcggacgaucaugcaccacaucacuuuacaaaggaguauacgaacuacaaacauuagaacuaaacauggaaacacuaaacaugacuaugccccuuucaugcaccaaaaacaacucucaccauuacauaauggucggaaacgaaacaggacuagaauuaacacuaacaaauacaucaaucauaaaccauaaauucugcaacuuaucagacgcacaccguaaaaaccuauaugaucacgcacuaaugucaauaauaucaaccuuccacuuaagcauaccaaauuucaaccaauaugaagcaaugucaugcgacuuuaacggaggcaaaauauccguacaauauaaucuaucacacucauacgcaggagacgcugccaaucacuguggcacaguagcaaacggugucuuacaaacauucaugagaauggcauggggaggauccuacauagcacucgacucaggcagaggaaaaugggacuguauaaugacaucauaccaauacuuaauaauacaaaauacaacaugggaagaucauugucaauucucaagacccucaccaauaggauacuuaggacuacuaucacaaagaacccgagacauauacauaucaagaagacuuuuaggcacauucaccuggacauuauccgacuccgaaggaaaagauacacccggaggauacuguuuaacaagauggaugcuuauagaagcagaauuaaaaugcuuuggaaauaccgcaguagcuaaaugcaacgaaaaacacgacgaagaauuuugugauaugcucagacucuuugacuuuaauaaacaagcuauacaaagacuaaaagcagaagcacaaaugucaauacaauuaauaaacaaagccguuaacgcucuaauaaacgaccaacuuauaaugaaaaaccacuuaagagauauaaugggcauaccauauugcaacuacucaaaauauugguaucuaaaucacacaacaacaggaaaaacaucccuuccuagaugcugguuagucucaaacggcucauaccuaaaugaaacacacuuuuccgacgauauagaacaacaagcagauaacaugaucacagaaauguuacaaaaagaauacauggaacgccaaggaaaaacaccccuuggccuaguagaccucuucguauucuccacaaguuucuauuuaauauccauauuuuuacauuuaguaaaaauaccaacacacagacauauagucggaaaaccaugcccaaaaccacaccgauuaaaccacaugggaauaugcucauguggacuauacaaacaaccaggaguaccaguaaaauggaaaagguaa

SEQ ID NO: 2669 - RNA, 1476 nt, Artificial Sequence
  derived and/or modified CDS sequence (opt6) from Lassa virus__AIT17216__GPC
augggucaaaucguaacauucuuucaagaaguaccacauguaauagaagaaguaaugaacauaguacuuauagccuuaucaauacuagcaguacuaaaaggcuuauacaacuucgcaacauguggacuaguaggacucguaacauuucuacuacuuugcggaagaucuugcacaaccuccuuauauaaaggagucuacgaacuacaaacacuagaacugaacauggaaacccuaaacaugacaaugccacuaucaugcacuaaaaacaauucacaccacuacauaaugguaggcaacgaaacaggacuagaacuaacacuaacaaacacaucaauaauuaaccacaaauuuugcaaccuaagcgacgcacacaaaaaaaaccuguacgaccaugcacuaaugucaauaauaucuacauuucaucuaucaaucccaaauuucaaccaauacgaagcaaugucuugcgauuucaacggaggcaaaauaagcguacaauauaaccuaagucacucauacgcaggagacgcagcaaaccacugcgguaccguagccaauggcguacuacaaacauucaugagaauggcauggggaggauccuacauagcucuagauucaggacauggaagaugggauuguauuaugacaucauaucaauaucuaauaauacaaaacacaacaugggaagaccacugucaauucucacgcccaucaccaauaggauaccuuggacuacucucacaaagaacaagagauauauacauaucaagacgauuauuaggaacuuucacauggacacuaucagacucagaaggaaaagacacaccaggaggauacugccuaacacgauggauguuaauagaagccgaauuaaaaugcuuuggcaauacagcaguagcaaaauguaacgaaaaacacgaugaagaauucugcgacauguuaagauuauucgacuuuaacaaacaagcaauacaacgucuaaaagcugaagcacaaauguccauccaacuaauaaacaaagcgguaaacgcauuaauaaacgaccaacuaauaaugaaaaaucaccuaagagauauaauggguauacccuauugcaacuacagcaaauacugguauuuaaaucacaccacaacaggaaaaacgucacuacccaaaugcuggcuaguaagcaacggcuccuacuuaaacgaaacacacuuuucagacgacaucgaacaacaagcagauaacaugauaaccgaaaugcuacaaaaagaauauauggaacgccaaggaaaaacaccuuuaggauuaguagauuuauuuguauuuuccacaaguuucuacuuaauaucaauauuucuacaucuaguaaaaauucccacucaccgacacauagucggaaaaccaugcccaaaaccacacagacuaaacuauaugggaauaugcucaugcggacuuuauaaacaaccaggaguaccaguaagauggaaacguuaa

SEQ ID NO: 2670 - RNA, 1476 nt, Artificial Sequence
  derived and/or modified CDS sequence (opt6) from Lassa virus__AIT17224__GPC
augggccaaaucguaacauucuuccaagaaguaccacauguaauagaagaaguaaugaacauaguacuaauagcauuaucuauauuagcaguacuaaaaggauuauacaacguagccacaugcggccuaauaggcuuaguaacauuucuacuauuaugcggaagaucaugcacaacaacacuauacaaaggaguauacgaacuacaagcacuagaauuaaacauggaaacacucaacaugacaaugccacuaucuugcacuaaaaacaacucccaucacuacauaagaguaggaaaugacacaggcuuagaacuuacacucacaaauacaucuauaauacaacauaaauuuugcaaucuaucugacgcacacaagaaaaacuuauacgaccauacauuaaugucaauaauaucaacauuucaccuaucaauaccaaacuuuaaccaauacgaagcaaugucaugcgacuucaauggcggaaaaauaucaguucaauacaauuuaucacacucauacgcaggagacgcagcaucucacugcggaacaguagccaacggaguacuacaaacauucaugagaauggccugggguggaucuuauauugcauuagauucaggacgaggaaacugggauuguauaaugacaucuuaccaauaccuaauaauacaaaacacaacaugggaagaccacugccaauucucaagaccauccccuauaggauaccuaggauuauuaucucaacguaccagagauauauacauaucucgaagauuacuugguacauucacauggacacucucagacucagaaggaagagauacacccggcggcuauugccuaacaagauggaugcuaauagaagcagaauuaaaaugcuucggaaacacagcaguugcuaaauguaaugaaaaacacgaugaagaauuuugcgacauguuaagacuuuucgacuuuaacaaacaagccauacaaagacuaaaaacagaagcacaaaugucaauacaauuaaucaacaaagcagucaacgcacuaauaaacgaucaacuaauaaugaaaaaucaucucagagacauaaugggcauuccauacuguaacuauucuaaauacugguaucuaaauaacacaauaacaggaaaauccucauugccaaaaugcuggcuaguauccaacggaucauaccuaaaugaaacccacuucucagacgacauugaacaagaagcagacaauaugauaacagaaauguuacaaaaagaauauauggaaagacaaggcaaaacaccauuaggacuugucgaucuauucguauuuucuacauccuucuaccuuauauccauauuucuucaccuaguuaaaaucccaacacacagacacauagucggaaaaccuuguccaaaaccacacagauuaaaccacaugggaguaugcuccugcggauuauacaaacaaccaggaguaccaguacguuggaaaagauaa

SEQ ID NO: 2671 - RNA, 1476 nt, Artificial Sequence
  derived and/or modified CDS sequence (opt6) from Lassa virus__AIT17228__GPC
augggacaaauuguaacauucuuccaagaaguaccacacgucaucgaagaaguaaugaacauaguauuaauugcauuaucuauauuagcaguacuaaaaggacuauacaacuuugcaaccugcggccuaguaggacuacuuacauuucuacuccuauguggacgaucauguacaaccucauuauacaaagggguauacgaauuacaaacacuagaauuaaacauggaaacacuaaacaugaccaugccacuaaguugcaccaaaaauaauucccaccacuacaucaugguaggaaaugaaacaggacuagaacuaacacucacaaauacaagcauaauagaccacaaauucugcaaccuaucagacgcccacaaaaaaaaccuauacgaccaugcuuuaaugucaauaauuucaaccuuccauuuaagcauaccaaacuucaaucaauacgaagcaaugagcugugacuucaacggagguaaaauuuccguacaauacaaccuaucacacucuuacgcaggagacgcagcaaaccauugcggaaccguugcaaacggaguucuacaaacauuuaugagaauggcauggggaggaucauacauagcacucgacucaggaagaggcggcugggauugcauuaugacaucauaucaauauuuaauuauacaaaacacuacaugggaagaucacugccaauucucaagaccaucaccaauaggauaccuaggacuccuaucccaaagaacaagagauauauacauuucuagaagacuacucggaacauucaccuggacacuaucugauucagaaggaaaagacacaccaggagguuauugccuaacaagauggaugcuaauagaagcagaacuuaaaugcuuugguaauacagcaguagcaaaaugcaacgaaaaacacgacgaagaauucugcgacauguuaagacuauucgacuucaauaaacaagcaauacaaagauuaaaagcagaagcacaaaugucaauacaauuaaucaacaaagcagucaacgcauuaauaaacgaucaacuuauaaugaaaaaccaucuaagagacauaaugggaauuccauacuguaacuacucuaaauacugguacuuaaaucauacaaccacaggaaaaaccucucucccaaaaugcuggcucguaucaaauggaucauaccuaaaugaaacacauuuuuccgacgacauugaacaacaagcagacaauaugauuacagaaaugcuacaaaaagaauacauggaaagacaaggaaaaaccccacucggcuuaguagaucuguucguauuuagcacaucauuuuacuuaauaucaauauuccuacacuuaguaaaaaucccaacacaccgucauauaguaggaaaauccugcccaaaaccacacagacuaaaccacaugggcauaugcucaugcggacuauacaaacaaccaggaguaccagucaaauggaaacgauaa

SEQ ID NO: 2672 - RNA, 1476 nt, Artificial Sequence
  derived and/or modified CDS sequence (opt6) from Lassa virus__AIT17232__GPC
augggacaaauaguaacuuucuuccaagaaguaccacacguaauugaagaaguaaugaacauaguacuuauagcacuaucuauacuugcaguauuaaaaggacuuuacaacuucgccacaugcggauuaguuggcuuaguaacauucuuauuacuauguggaagaucaugcacaacaucauuauauaaaggaguuuacgaacuacaaacacuagaacuaaauauggaaacucuaaacaugacaaugccacuuuccugcaccaaaaacaauucacaccacuauauaagaguaggaaacgaaacaggauuagaacuaaccuuaacaaacaccucaauaauaaaccauaaauucugcaaccuaucugacgcacacaaaaaaaaccuguaugaccaugcccuaauguccauaaucuccacauuccaccuaucaauacccaauuucaaccaauacgaagcuaugucaugcgauuuuaacgaagguaaaauaucaguacaauacaaccuaucacacaguuacgcaggagacgccgcuaaucauugcgguacaguagccaacggcguacuacaaacauuuaugagaauggcauggggaggaucauacauagcacuagacucuggaagaggcaaaugggacuguauaaugacuagcuaccaauaucuaauaauacaaaacacaacaugggaagaucacugccaauucagcagaccaucaccaauaggauaccuaggauuacuaucccaaagaacacgagauaucuauaucucaagaagacuauuaggcacauuuacauggacccuauccgacagcgaaggaaaagacacaccagguggauacugccuaacaagauggaugcuuauagaagcugaauuaaaaugcuuuggaaacacagcaguagccaaaugcaacgaaaaacacgaugaagaauuuugcgacaugcuaagacuauuugacuucaauaaacaagccauagaaagacuaaaagcugaagcccaaaugucaauacaacuaauaaacaaagccguaaacgcauuaauaaacgaucaauuaauaaugaaaaaccacuuaagagacauaaugggcauuccauacugcaauuacucaaaauauugguacuuaaaccauacaacaacaggaaaaacaucccucccaaaaugcuggcuaguauccaacggcuccuaccuaaacgaaacccacuucucagacgacauagaacaacaagcagacaauaugauaacagaaauguuacaaaaagaauacauggaaagacaaggaaaaacaccucucggacuaguagaucuauucguauuuucaacauccuucuaccuaauaucaauuuuucuacaccuagucaaaauaccaacccaucgacacauaguuggaaaaucaugccccaaaccccacagacucaaucauaugggcauaugcuccuguggauuauauaaacaaccaggaguccccguuaaauggaaaagauaa

SEQ ID NO: 2673 - RNA, 1476 nt, Artificial Sequence
  derived and/or modified CDS sequence (opt6) from Lassa virus__AIT17236__GPC
augggacaaaucguaacauucuuccaagaaguuccucacguaauagaagaaguaaugaacauaguauuaauagcacuaagcauacucgcagucuuaaaaggacuauauaacuucgcaacauguggccuaguaggacucguaaccuucuuacuacuaugcggaagaucaugcacaaccucccucuauaaaggaguauacgaauuacaaacacuugaacuuaacauggaaacacuaaacaugacaaugccacuaucuugcaccaaaaacaauucacaccacuacauaaugguaggaaacgaaacaggacuugaacucacauuaaccaauacauccauaaucaaucacaaauucuguaaucuaucagacgcacauaagaaaaaccucuaugaccacgcauuaaugucuauaauuucaacauuccaucuaucaauaccaaacuuuaaccaauacgaagccaugucuugugacuuuaacggaggaagaaucucuguacaauacaaccuaucacacucauacgcaggagaagcagcaaaccacugcggaacagucgccaauggaguauuacaaacauucaugcgaauggcauggggaggaucuuacauagcacuagacucaggaagaggaaaaugggacugcauaaugacaucauaccaauaccuaauuauccaaaacacaaccugggaagaccauugccaauuuucaagaccaucaccaauaggauaucugggccuacuaucacaacgaaccagagacauauacauaucccgaagauuacuaggcacauuuacauggacacuaucugauucugaaggcaaagacacaccaggaggauacugucuaacaagauggaugcucauagaagcagaacuaaaauguuuuggaaacacagcuguagcaaaaugcaacgaaaaacacgacgaagaauuuugcgacaugcucagacuuuuugacuuuaauaaacaagcaauacaaagauuaaaagcagaagcacaaaugucaauacaacuuauaaacaaagcagucaacgcacuaauaaaugaccaacuaauaaugaaaaaccacuuaagagacauaaugggaauaccauauuguaauuauucaagauauugguaucuaaaucacaccacaacaggaaaaacaagucuacccaaaugcuggcucguaucuaauggaucauaccuaaaugaaacacacuucucagacgauauagaacaacaagcagacaacaugauaacagaaaugcuacaaaaagaauauauggaaagacaagguaaaacaccccuaggccuagucgacuuauucguauuuucaacaucauucuaccuaaucuccauauuucuucaucuagucaaaauacccacacacagacacauagucggcaaaucauguccuaaaccccauagacuaaaucauaugggaauuuguucaugcggucuauacaaacaaccagguguaccagucaaauggaaacgauaa

SEQ ID NO: 2674 - RNA, 1476 nt, Artificial Sequence
  derived and/or modified CDS sequence (opt6) from Lassa virus__AIT17240__GPC
auggggcaaauaguaaccuucuuucaagaagucccacacguaauagaagaaguaaugaacauaguacuuauagcucuuagcauacucgcagucuuaaaaggccuauauaaccuagcaacaugcggauuaguaggccucguuacauuccuacuacuaugcggaagaucaugcacaacaucacuauacaaaggcuucuaugaauuacaaacacuagaauuaaauauggaaacacuaaacaugaccaugccacuaucuuguacaaaaaacaacucucaccacuacauaagaguuggaaacgaaacaggccucgaauuaacacuaacaaacacaucaauaauagaccacaaauucugcaaccuuucagacgcacauaaaaaaaaccuuuacgaucaugcauuaaugucaauaauaucaacauuccacuuaucaauaccaaauuucaaucaauacgaagcaauguccugcgacuuuaacggaggcaaaauauccguacaauacaaccuaucacacaguuacgccggagaugcugcaaaccacugcgguacaguagccaacggaguauuacaaacauuuaugagaauggcauggggaggauccuacauagcacuugacucuggaagagguagaugggacugcaucaugacauccuaccaauaccuaauaauccaaaacacaacaugggaagaucacugccaauucuccagaccaagcccaauaggauaccuaggacuauuaucucaaaaaacaagagauauauacaucuccagaagauuacuaggaacuuucaccuggacacuaucugauucagaaggaaaagacacacccggcgguuauuguuuaacacgauggaugcuuauagaagcagaauuaaaaugcuuuggaaacaccgcaguugccaaaugcaaugaaaaacacgaugaagaauucugcgacauguuaagauuauucgacuuuaauaagcaagcaauucaaagauuaaaagcagaagcccaaaugucuauccaacuaauuaacaaagcaguaaacgcauuaauaaaugaccaacuaauaaugaaaaaucaccuaagagacauaaugggaauaccauauugcaacuacucuaaauacugguaucuaaaccacacaacuacaggaaaaaccucacuaccaaaaugcugguuaguaucaaauggaucauaucuaaaugaaacacacuucucagacgacauagaacaacaagcagauaauaugauaacagaaaugcuacaaaaagaauacauggaaagacaaggaaaaacaccacuaggacuaguagauuuauucguauucagcacaucauucuacuuaauauccauuuuccuacaccuagucaaaaucccaacacauagacacauaguaggcaaauccugccccaaaccacauagauuaaaucacaugggaauauguucaugcggacuuuacaaacaaccaggagucccaguaaaauggaaaagauaa

SEQ ID NO: 2675 - RNA, 1476 nt, Artificial Sequence
  derived and/or modified CDS sequence (opt6) from Lassa virus__AIT17244__GPC
augggacaaauaguaaccuuuuuccaagaaguaccacacguaauagaagaaguaaugaauauagucuuaauagcacuaucaaucuuagcaguacuaaaaggauuauacaaccuagcaacaugcggucuaguaggucuaguuaccuuuuuacuacuauguggacgaucauguacaacaaaccuuuauaaaggagucuaugaacuccaaacauuagaacuaaauauggaaacauuaaacaugacaaugccauuaucaugcaccaaaaacucaucucaccacuacauaagaguaggaaacgaaacaggacuagaacuaaccuuaaccaacacaucaauaauagaucauaaguucuguaaucuaucagacgcccacaagaaaaacuuauacgaucaugcauuaaugucaauaauuucaaccuuccacuuauccauaccuaacuucaaccaauacgaagcuaugucaugcgauuucaacggaggaaaaauauccguacaauacaaccuaucucacucauaugucggggacgcagcagaccacugcggaacuguagcaaacggaguucuacaaacauucaugaggauggcauggggaggcuccuauauagcacucgacucaggcagaggcaaaugggauugcauaauaacaucauaucaauauuuaauaauucaaaacacuacaugggaagaccacugucaauucucaagaccgucaccaaucggauauuuaggacuauuaucacaaagaacaagagauauauauauaucaagacgcuuacuaggaaccuucacauggacacuaucagacucagaagguaaagacacuccaggcggcuacugucuaacaagauggauguuaauagaagcugaauuaaaaugcuucggaaacaccgccgucgcaaaauguaacgaaaaacaugacgaagaauuuugcgacauguuaagauuauucgacuucaacaaacaagcaauccaaagacucaaagcagaagcccaaaugucaauacaacuaauaaauaaagcaguaaaugcacuaauaaacgaucaacucauaaugaaaaaccacuuaagagacaucaugggaauaccauauuguaacuacucaaaauauugguaccuaaaucacacuauaacaggaaaaacaucauuaccacgaugcuggcuuguauccaacggaucauacuuaaacgaaacacgauucucagaugacauagaacaacaagcagacaacaugauaacagaaaugcuccaaaaagaauauauggaacgacaaggaaaaacaccauuagguuuaguagacuuauucguauucucuacaucuuucuacuuaauaagcauauuccuacaccuaguaaaaaucccuacacacagacauauaguaggcaaaccaugcccaaaaccacacagauuaaaccacauggguauauguaguugcggacuauauaaacaaccaggagucccaguaaaauggaaaagguaa

SEQ ID NO: 2676 - RNA, 1476 nt, Artificial Sequence
  derived and/or modified CDS sequence (opt6) from Lassa virus__AIT17246__GPC
augggacaaauaguaacauucuuucaagaaguaccccacguaaucgaagaaguaaugaacauaguucucauagcuuuaucacuacuagcaguccuaaaaggauuauacaacguagcuacuugcggacuaauaggacuaauaacauuucuacuauuaugcggacgauccuguacaaccaaccuuuacaaagguguauaugaacuacaaacacuugaacuaaacauggaaaccuuaaauaugaccaugcccuuaagcuguacaaaaaauucaucccaucauuacauaaugguaggaaaugagacuggacuugaauuaacauuaacaaacacaucuauaaucaaccacaaauucugcaaccuaucagacgcacauaaaaaaaauuuguacgaccacacacucauguccauaauaucaaccuuccacuuauccauacccaacuuuaaccaauaugaagcaaugucaugcgacuucaacggaggaaaaauaaguguacaauacaaccuuucacauucauaugcaguagacgcagcaaaccacugcggaacaguagcaaacggaauccuucaaacuuuuaugagaauggcaugggguggauccuacaucgcacucgacuccggacgaggaaacugggacuguaucaugacuuccuaccaauaccuaauaauacaaaacaccacaugggaagaucacugccaauuuucacgaccaucaccaauaggauacuuaggccuacuuucacaacgaacacgugacauauacauaucacgucgauuauuaggaacauucacauggacacucucugacucugaaggaaaugacacacccgguggauacugccuaacaagauggauguuaauagaagcagaacucaaaugcuuuggaaacaccgcaguagccaaauguaacgaaaaacaugacgaagaauucugcgacauguuacgacuuuucgauuuuaacaaacaagcaauacaaagauuaaaagcagaagcacaaaugucaauacaauuaaucaauaaagcaguuaacgcucuaauaaaugaucaacuaauaaugaaaaaucaccucagagacauuaugggaauaccauacugcaacuacucaaaauauugguaucuaaaucacacuacuacuggaaaaacaucacuaccaaaauguuggcuaguaucaaacggcucauaucuaaacgaaacacacuuuucagaugauauagaacaacaagcagacaacaugaucacagaaaugcuacaaaaagaauacauggaaagacaaggaaaaaccccacuaggccucguagaccucuucguauucucaacauccuucuaccuaauaucuauauucuuacaccuagucaaaauaccaacacauagacacauaguuggaaaacccuguccaaaaccacauagauuaaaccauaugggaauauguuccugcggccuauauaaacaacccggaguaccaguacgauggaaacgauaa

SEQ ID NO: 2677 - RNA, 1476 nt, Artificial Sequence
  derived and/or modified CDS sequence (opt6) from Lassa virus__AIT17250__GPC
augggacaaauaguaaccuuuuuccaagaaguaccacauguaauagaagaaguaaugaacauuguacuaauagcauuaucacuacuagcagucuuaaaaggacuauauaacguagcaacaugcggacuuaucggucuagucacauucuuacuacucugcggaagaucauguacaaccaaccucuauaaaggaguauacgaacuacaaacucuugaauuaaacauggaaacauuaaauaugacuaugccccuaucaugcacaaaaaacaacucacaccauuacauaaugguaggaaacgaaacaggacuagaauuaacacucacaaacacauccauaauaaaccauaaauucugcaauuuaucagaugcacacaaaaaaaauuuauacgaccacacacucaugucaauaauuucaacauuccaccucucaauaccaaacuucaaucaauacgaagcaaugagcugugauuucaacggaggaaaaauaucuguucaauacaaccuaagucacucauacgcaguggaugcagcaaaccacugcggaacaguagcaaacggaguuuuacaaacguucaugagaauggccugggguggaucauacauagcacuagauucaggcagaggaaacugggacugcaucaugacaucuuaucaauacuuaauaauacaaaacacaacaugggaagaucauugucaauuuucaagaccaagcccuaucgguuaccuaggacuauuaucacaaagaacaagagauauauacauaucaagacgucuacuaggaacauucacauggacccuaucagacucagaaggcaacgauacaccuggaggauacugucuaacaagauggaugcuaauagaagccgaauuaaaaugcuucggaaacaccgcagucgcaaaauguaacgaaaaacacgacgaagaauucugcgacauguuaagacuauucgacuuuaauaaacaagcaauacaacgauuaaaagcagaagcacaaaugucuauucaauuaauaaacaaagcaguaaacgcucucauaaacgaccaacuuauaaugaaaaaccaccuucgagacauaaugggaauaccauacugcaacuacucaaaauacugguauuuaaaccacacaacaaccggaaaaacaucccuccccaaaugcuggcuaguauccaacggcucauacuuaaaugaaacacauuuuucugacgacauagaacaacaagcagacaauaugauaacagaaaugcuacaaaaagaauacauggaaagacaaggcaaaacaccacuaggacuagucgaucuauucgucuuuucaacauccuucuauuuaauaucaauauuccuacauuuagugaaaauaccuacacauagacauauaguaggaaaaccaugcccaaaaccacacagacuaaaucacaugggcauaugcucaugcggucucuauaaacaaccaggaguuccuguaagauggaaacgauaa

SEQ ID NO: 2678 - RNA, 1476 nt, Artificial Sequence
  derived and/or modified CDS sequence (opt6) from Lassa virus__AIT17254__GPC
augggacaaauaguaacauucuuucaagaagucccacacguaauagaagaagucaugaacaucguacuaauagccuuauccauacuagcaguccuaaaaggauuauacaacuuugcaacauguggaaucguagguuuaguaacauuucuacuuuuaugcggaagauccugcacaacaucccuauacaaaggaguauaugaauuacaaacacuagaacuuaacauggaaacacuaaauaugacaaugccacuaucuuguaccaaaaacaacucucaccauuauauaauggucggaaacgaaacaggccuagaauuaaccuuaacuaacacaucaauaaucaaccacaaauucugcaaucuaucagacgcccauaagaaaaaccuauacgaccacgcacuaaugucaaucauaucaacauuccaucuaucaauaccaaacuucaaucaauacgaagccaugucuugugacuucaacggcggcaaaauaucaguacaauacaaccuaucacauucauaugcuggagaugcugcaaaucauugcggaacaguagcaaacggaguauuacaaaccuucaugcgaauggcuugggguggaucauauauagcauuggacucaggcagagaucgaugggacugcauuaugacuucauaccaauaucuaauaauucaaaauacaacaugggaagaccacugucaauucucaaggcccucaccaauaggauaccuaggcuuacuuucacaaagaaccagagacauuuauauaucacgacgacuacuaggcacuuucacauggacauuaucugauucagaaggcaaaaacacccccggaggcuacugcuuaacuagauggaugcuaauagaagcagaacuaaaaugcuucggcaacacagccguagcaaaaugcaacgaaaaacaugaugaagaauuuugcgauaugcuaagacuauucgacuucaacaaacaagccauacaacguuuaaaagcagaagcacaaaugucaauaucacuaauaaauaaagcaguaaacgcacuaaucaacgaucaacucauaaugaaaaaccaccuaagagacauaaugggaauaccuuauugcaauuacagcaaauauugguacuuaaaucacacaacaaccggaaaaacaagccuaccaagauguugguuagucuccaacggcucauaucuaaaugaaacacacuucucagacgacauagaacaacaagcagauaacaugauuacagaaaugcuacaaaaagaauacauggacagacaaggaaaaacaccacuaggauuaguagacuuauucguuuucuccacaucauucuaccuaauaucaauuuuccuccaccucguaaaaauaccaacacaucgacauauagucggaaaaacaugcccaaaaccacaccguuuaaaccacaugggcauuuguucaugcggauuauacaaacaacccggagucccaguaaaauggaaaagauaa

SEQ ID NO: 2679 - RNA, 1476 nt, Artificial Sequence
  derived and/or modified CDS sequence (opt6) from Lassa virus__AIT17258__GPC
augggacaaauaguaacauucuuucaagaaguaccacauguaauagaagaaguaaugaacauaguacuaauugccuuaucaauauuagcuguacuaaaaggcuuauacaacauagccaccugcggauuaguaggccuaguuacauuccuacuccuauguggaagauccugcacaacaucacucuacaaaggcguuuacgaauuacaaacucuugaacuaaauauggaaacacuaaacaugacaaugccuuuaucuugcacuaaaaacaacucacaccauuacauaaugguaggaaacgaaacaggacuagaauuaacacucacaaauacauccauaauaaaccauaaauucugcaacuuaagcgacgcacacaaaaaaaaccuauacgaccaugcauuaaugucaaucguaagcacauuccaucuaucaauccccaacuucaaccaauacgaagcaauguccugcgacuucaacggaggaaaaauaucaguacaauauaaccuaucccacucuuacgcagucgaugcagcaaaccacuguggaacaguagcaaauggaguacuacaaacauucaugagaauggccuggggaggaucauacauagcacuagauucaggacgcggaggaugggauuguauaaugacaucauaccaauacuuaauaauacaaaacguuacaugggaagaccacugccaauucucacgaccaucucccaucggauaccuugguuuauuaucccaacgaacaagagauguauacauaucacgaagacuauuagguacauucacauggacacuaagugacagcgaaggaaaugacacacccggaggcuacugcuuaacccgauggauguuaauagaagcagaauuaaaauguuucggaaacacagccgucgcuaaaugcaacgaaaaacacgaugaagaauucugcgacaugcuacgacucuucgauuucaacaaacaagcaauucaaagacuaaaagccgaagcacaaauguccauacaauuaauaaacaaagcaguaaacgcacuaauaaacgaucaguuaauaaugaaaaaccauuuaagagacauaaugggaauaccauacugcaauuauucuaaauacugguaccuaaaccacacuacaacaggcaaaacuucauugccuaaaugcuggcuuguuucaaacggcucauauuuaaacgaaacacauuuuucagaugauauagaacaacaagcugauaacaugauaacagaaauguuacaaaaagaauacauggaacgacaaggaaaaacaccccuuggucuaguugaccuauucguuuucagcacaagcuucuacuuaauaucaaucuuccuacaccuaguaaaaauaccaacacaccgacacaucguaggaaaaccauguccaaaaccccaccgacuaaaccauaugggaauaugcucauguggacuauauaaacaaccaggagucccagucaaauggaaaagauaa

SEQ ID NO: 2680 - RNA, 1476 nt, Artificial Sequence
  derived and/or modified CDS sequence (opt6) from Lassa virus__AIT17262__GPC
augggacaaauaguuacauucuuccaagaaguaccucacgucauagaagaaguaaugaacauagucuuaauagcccuauccauauuagcaguacuaaaaggacuauacaacuuagcuacaugcggauuagucggccuagucacauucuuauuauuaugcggaagaucauguacuaccagucuuuacaaaggaguuuacgaacuacaaacacuugaauuaaacauggaaaccuuaaacaugacaaugccacuaucaugcacaaaaaacaacucacaccauuacauuaugguaggcaaugaaacaggauuagaauuaacccucacaaauacaucaauaauaaaccauaaauucuguaaccuauccgacgcacacaaaaaaaaccuauacgaucacgcauuaaugucuauaauaucaacuuuucacuuaucuauaccaaacuucaaccaauacgaagcaaugucaugugauuuuaacggaggaaaaauaucaguacaauacaaucuaucacacuccuacgcaggagacgcagcuacacacuguggaacaguugcaaacggcgucuuacaaacauuuaugagaauggcauggggaggaucauacauagcacucgacucaggaagaggaaaaugggauugcauaaugaccagcuaccaauacuuaauaauacaaaauacaaccugggaagaccauugccaauucaguagaccaucacccauaggauaccuaggccuauuaucacaaagaacaagagacauauacauaucuagaagauuacuggguacauucacauggacucucuccgacucagaaggaaaagacacaccaggaggauauuguuuaacaagauggaugcuaauagaggccgaacuaaaaugcuucggaaacacagcagucgcuaaauguaaugaaaaacaugacgaagaauucugugacaugcuacgccuauucgauuucaauaaacaagcaauucaaagacuaaaaacagaagcacaaaugucaauacaacuaauaaauaaagcaguaaacgcuuuaauaaacgaucaacuaauaaugaaaaaucaccucagagauaucaugggaauaccauauugcaacuacuccaaauauugguauuuaaaccacacaacaacaggaaaaaccucauuacccagauguugguuaguaucaaacggaucuuauuuaaacgaaacucauuucagcgacgauauugaacaacaagcagacaacaugauaacagaaaugcuacaaaaagaauauauggaacgccaaggcaaaacaccauuaggauuagucgaccuauuugucuucuccaccaguuuuuacuuaauaagcauauuucuccauuuaguaaaaauaccuacacacagacacauaguaggaaaaccaugcccaaaaccacacagauuaaaucauaugggaauauguucauguggacuauauaaacagcccggaguaccaguaaaauggaaaagauaa

SEQ ID NO: 2681 - RNA, 1476 nt, Artificial Sequence
  derived and/or modified CDS sequence (opt6) from Lassa virus__AIT17266__GPC
augggccaaauaguaacauucuuccaagaaguaccacacguaauugaagaagucaugaauaucgucuuaauugcucuuucaauauuagcaguacuaaaaggacuauacaaccuagcaacauguggauuaguaggauuaguaacauucuuacuauugugcggaagaaguugcaccacaagccuauacaaaggaguauaugaacuacaaacccuagaacuaaacauggaaacauuaaacaugacaaugccccuaucaugcaccaaaaacaauucccaccacuacauaaugguaggaaacgaaacaggcuuagaauuaacauuaacaaauacaucccuaauaaaccauaaauuuugcaacuuaagcgacgcgcacaagaaaaaccuauacgaccaugcauuaaugaguauaaucucaaccuuccaucuuaguauaccaaacuucaaccaauaugaagcaaugucaugcgauuucaacggaggaaaaauauccguacaauacaaccuaucacacuccuacgcaguagacgcagcaaaccacugcggaacaguagcaaacggaguccuacaaacauuuaugagaauggccuggggaggaucauacaucgcauuagacucaggacguggaggaugggauugcauaaugacaucauaccaauacuuaauuauccaaaauaccacaugggaagaccacugccaauucucaagaccaucuccaauaggauacuuaggucuauuaucucaaagaacaagagacauuuacauauccagaagauuauuagguacauucacauggacuuuaagcgacucagaaggcaaagauacaccaggaggauacugccuaacccgauggaugcuaauagaagcagaacuaaaaugcuucggaaauaccgccguagcaaaaugcaacgaaaaacacgacgaagaauuuugugauauguuaagauuauuugacuucaacaaacaagcaauccaaagacuaaaagccgaagcacaaaugucaauccaacuuauaaauaaagcaguaaacgcccuaauuaaugaccaacuaauaaugaaaaaccacuuacgugacauaaugggaauaccauacuguaauuacuccaaauacugguauuuaaaccauacaacaacaggaagaacauccuuacccagaugcugguugguaucaaaugguucauaucuaaacgaaacacacuucucagacgacauagaacaacaagcagacaacaugauaacagaaaugcuacaaaaagaauauauggaaagacaagguaaaacaccauuaggccuagucgacuuauuuguauucaguacaucauucuauuuaauaucaauuuuccuacacuuaguuaaaauaccuacacacagacacauagucggaaaaucaugccccaaaccacacagacuaaaccacaugggaauauguaguugcggauuauauaaacaaccagggguaccaguaaaauggaaacgcuaa

SEQ ID NO: 2682 - RNA, 1476 nt, Artificial Sequence
  derived and/or modified CDS sequence (opt6) from Lassa virus__AIT17270__GPC
augggccaaauaguuacuuuuuuucaagaaguaccacacguaauagaagaaguaaugaacaucguacuuauagccuuaucaguacucgcaguacuaaaaggacuauacaauuuugcuacaugcggacuaguaggacucguaacuuuccuacuauuaugcggaagaucaugcucuacuucaguauauaaaggcguauacgaacuacaaacacucgaauuaaauauggaaacacuaaacaugacuaugccauuaucaugcacaaaaaauaacucacaucacuacauaauggucggaaacgaaacuggccuagaacugacauuaacaaacacgagcaucauaaaucacaaauucugcaaucuaucagacgcucacaaaaaaaacuuauacgaccacgcacuuaugucaauaauauccacauuucacuuaucaauaccaaacuucaaccaauaugaagccaugucaugcgauuucaacggagguaaaauuagcguacaauauaaccuaucacacucauacgcaguagacgcagccaaccacugcggaacaguagcaaauggaguccuacaaacauuuaugagaauggcuuggggaggaucauacauagcacuagauucaggacauggaggaugggacugcaucaugacaaacuaccaauaccuuauaauccaaaauacaaccugggaagaccacugucaauucuccagaccaagcccaauaggauaccuaggauuacucagucaaagaacuagagacauauacauaucaagaagauuauuaggaacuuucacauggacacuaagcgacagugaaggcaaagacacaccaggaggauacugcuuaacaagauggaugcuaauagaagcagaauuaaaaugcuucggaaacacagcaguagcaaaauguaacgaaaaacacgacgaagaauucugcgacaugcuaagacucuuugacuucaacaaacaagcaauccaacgacuaaaagcagaagcacaaauguccauacaacuaauuaauaaagcagucaacgcacuaauaaaugaccaauuaauaaugaaaaaccacuuaagagauauaaugggaauaccauauugcaacuauucaaaauauugguaucuaaaucauacaacaacaggcagaacaagcuuaccaaaauguugguuaguaucaaauggaucauacuuaaacgaaacucauuuuucagacgacauagaacaacaagcagacaauaugauaacagaaauguuacaaagagaauacauggaaagacaagguaaaacaccacuaggauuaguagaucuauuugucuuuagcacaucauuuuaccucauauccauauuucuucaccuaguaaaaauaccaacacacagacauauaguaggaaaaucaugcccaaaaccacaucgauuaaaucauaugggaauauguucaugcgggcucuauaaacaaccaggaguaccagucaaauggaaacguuaa

SEQ ID NO: 2683 - RNA, 1476 nt, Artificial Sequence
  derived and/or modified CDS sequence (opt6) from Lassa virus__AIT17274__GPC
augggacaaauagucacauucuuccaagaaguaccacacguaauagaagaaguaaugaacauaguacuaauagcacuaucuauccuagcaguauuaaaaggccuauacaacguagcaacaugcggccuaacuggacuaguugcuuuuuuacuacucuguggacgaucauguaccacaacacuuuauaaagguguauaugaauuacaagcacuagaacuuaacauggaaacccuuaacaugacaaugccacuauccugcaccaaaaauaauucacaccacuacauaagaguaggcaaugaaacaggacucgaacuaacauuaacaaauaccucaauaaucgaacacagauucuguaaucuaucagacgcacacaaaaaaaaccuauaugaccacgcacucaugucaauaauaucaacauuccaccuaucuaucccaaacuucaaccaauacgaagcaaugucaugugacuucaacgguggcaaaauuucaguucaauacaaccucagucacucauacgcaguugaugcggcaaaccauugcgguacaguagcaaauggaguacuacaaacauuuaugaggauggccuggggcggcucauacauugcccuagacucaggacgaaacggaugggacuguauaaugacaucauaccaauauuuaauaauacaaaacacaacaugggaagaccauugccaauuuucaagaccaucaccaauuggcuacuuaggcuuauuaucacaaagaacaagggacauauauauaucuagaagauuacuugguaccuucacauggacccuaucggauucagaaggaaaagauacaccuggagguuauugucuaaccagauggaugcuaauugaagccgaacuaaaaugcuucggaaacacagcaguugcuaaauguaaugaaaaacaugaugaagaauuuugcgacaugcuuagauuauucgauuuuaacaaacaagcaauccaaagacuaaaagcagaagcucaaauguccauacaacuaauuaacaaagcaguaaacgccuuaauaaacgaccaacuuauaaugaaaaaccaccuaagagacauaaugggaauaccauacuguaauuauucaaaauacugguaccuaaacaacacugcaacaggaaaaacaucccuaccacgaugcuggcuaguaucaaaugguuccuaccuaaaugaaacacauuucucagacgacaucgaacaacaagccgacaauaugaucacagaaaugcuccaaaaagaauauauggaaagacaaggcaaaacaccuuuaggacuaguugacuuauucgucuucuccacuucauucuauuuaauaucaauauuucuccacuuaguaaaaauucccacacacagacauauaguaggaaaacccugcccuaaaccccauagacucaaccauaugggaauaugcucaugcggacuauacaaacaaccaggagcaccuguaagauggaaaagauaa

SEQ ID NO: 2684 - RNA, 1476 nt, Artificial Sequence
  derived and/or modified CDS sequence (opt6) from Lassa virus__AIT17276__GPC
augggacaaauaguaacauuuuuccaagaagucccacauguaaucgaggaaguaaugaacauaguacuaauagcauuaucaauauuagcaguccuaaaaggauuauauaacuucgcaacaugcggacuuguuggccuaguaacauucuuacuacuuugcggaagaucaugcacaacaucacuauacaaaggaguauacgaauuacaaaccuuagaauuaaacauggaaacacuaaacaugacaaugccacucucaugcacuaaaaacaacucacaccacuacauaauggucgguaacgaaacagggcuagaauuaacauuaacaaauacaucuauaauaaaccacaaauucugcaaccuaucagacgcccacaaaaaaaauuuauacgaccaugcccuaaugucaauaauuucaaccuuccacuuaucaauccccaacuucaaccaauacgaagcaaugucaugugauuucaacggaggaaaaauaucaguacaauauaaccuaucacauuccuacgcuggagaugcagcaaaucacugcggaacaguagcaaacggcguacuccaaacauucaugcgaauggccuggggcgguucauacauagcacuagacucaggacaugguaaaugggacugcauaaugaccuccuaucaauaccuaauaauccaaaacacaacaugggaagaucacugccaauucucaagaccaucacccauaggauaccuaggacuccucucucaaagaacaagagauauauacauaucccgcagacuccuaggcacauuuacauggacacuauccgacucagaaggcaaagauaccccaggaggcuauugccuaacuagauggaugcuaauagaagcagaauuaaaaugcuuuggcaacacagcaguagcaaaauguaacgaaaaacacgacgaagaauuuugcgauauguuacgacuauucgacuuuaacaaacaagcaauacaacgacucaaagcagaagcacaaaugucaauacaacuaauuaacaaagcuguaaacgcacuaauuaacgaccaacuaauaaugaaaaaccaccuacgagauauuaugggaauaccauacugcaauuacucaaaauacugguacuuaaaccacacuaccaccggaaaaacaucauuaccuaaaugcuggcuaguaucaaacggaucauauuuaaaugaaacccauuucucagacgacauagaacaacaagcugacaauaugauaacagaaaugcuacaaaaagaauauauggaacgacaagguaaaacaccacuaggacuaguagaccuauucguauuuuccacuucauucuacuuaauaucaauuuuccuacaccucguaaaaauacccacccauagacauauaguaggaaaaucaugcccaaaaccacacagauuaaaccauaugggaauaugcucaugcggauuauacaaacaacccggaguaccaguaagauggaaaagauaa

SEQ ID NO: 2685 - RNA, 1473 nt, Artificial Sequence
  derived and/or modified CDS sequence (opt6) from Lassa virus__AIT17280__GPC
augggacaaauagucaccuucuuccaagaaguaccucacguaauagaagaaguaaugaacauaguacuaauugcacuaucaauucuagccgucuuaaaaggacucuacaauuucgcaacaugcggacuagucggacuaguaacguuucuacucuuauguggacgauccugcacuacuucuuuauacaaaggaguauacgaacuacaaacacuagaauuaaacauggaaacacucaacaugacaaugccccuaucaugcacaaaaaacaacagccaccacuauauaagaguaggaaacgaaacaggauuagaacuaacauuaacaaacacauccauaaucgaccauaaauuuuguaaccuaagcgaugcacacaaaaaaaaccuuuaugaccacgcauuaaugagcaucauaucaacauuucacuuaucuauacccaauuuuaaccaauaugaagcaaugucaugcgauuucaauggaggaaaaaucagcguacaauauaaccucucacacagcuacgcaggagacgcagcaaaccacuguggaaccguagcaaacggagucuuacaaacuuucaugcgaauggcauggggcggaagcuacauagcacuagauucaggucacgaaugggacuguaucaugacaagcuaucaauaucucauaauacaaaacacgacaugggauaaccacugccaguucucaagaccaucuccaauuggauauuuaggacuauuaucacaaagaacaagagacaucuauauaucaagaagauuacucgguacauucacauggacuuuaucagauucagaagguaaagauacaccuggcggcuacugccuaacaagauggaugcuaauagaagcagaacuaaaauguuucggaaacacagccguugccaaaugcaaugaaaaacaugaugaagaauucugcgauaugcucagauuauuugacuuuaacaaacaagcaauacaaagacucaaagucgaagcacaaaugucaauccaauuaauaaacaaagccguuaaugcauuaauaaaugaucaacuaauaaugaaaaaccaccuaagagauauaaugggaauaccauacugcaacuacucaaaauacugguaccuaaaucacaccacaacaggcaaaacaucauuaccaaaaugcugguuaguaucaaacggaucauaccuaaacgaaacacacuucucagaugacauagaacaacaagcagacaacaugaucacagaaaugcuacaaaaagaauacauggaacgacaaggaaaaacuccacuagggcuaguagaccucuuuguauucucaaccucauucuaccuaauaucaauauucuuacaccucguaaaaauaccgacacacagacacaucguagguaaauccugccccaaaccacauagauuaaaccauaugggaauauguaguugcggauuuuacaaacaaccaggaguaccaguaaaauggaaacgauaa

SEQ ID NO: 2686 - RNA, 1476 nt, Artificial Sequence
  derived and/or modified CDS sequence (opt6) from Lassa virus__AIT17288__GPC
augggacaaauaguaacauuuuuccaagaaguuccacacguaauugaggaaguaaugaauaucguacucauagcacuaaguauacucgccguccuuaaaggacucuacaacuuugccacaugcggauuaguaggacuaguaacauuuuuacuacuaugcggaagaucaugcacaaccucacuauauaaaggaguauacgaacuccaaacauuagaacuaaauauggaaaccuuaaauaugacaaugccacuaucauguaccaaaaacaacucacaccacuacauaauggucggaaacgaaaccggauuagaauuaacauuaacaaacacaucaauaauaaaucacaaauucugcaaccucucagacgcacauaaaaaaaaccuauacgaucacgcauuaaugucaauaauaaguacauuucacuuauccauaccaaacuucaaucaauacgaagcaaugucuugcgacuucaacggaggaaaaauaucaguucaauauaaucucucacacucauacgcaguagaugcagcaaaccacugcggaacagucgcaaacggaguacuacaaacauuuaugcgaauggcaugggguggaggauacauagcauuagauagcggaagaggaaacugggacuguauaaugacaucguaucaauaucuuauaauucaaaacacaaccugggaagaccauugucaauucucacgcccaucaccaauaggauaucuaggccuacuaucacaacgaacaagagacauauacauaagucgccgccuauuaggaacuuucacauggacauuaucugacucagaaggcaaagacaccccaggagguuacugccuaacaagauggaugcuaauagaagcagaauuaaaaugcuuuggcaacacagcaguagcaaaauguaacgaaaaacacgacgaagaauucugugacaugcuaagacuauuugauuuuaacaaacaagcaauacaacgacuaaaagcagaagcccaaaugagcauacaacuaauuaacaaagcaguaaacgcauuaauaaacgaccaauuaauaaugaaaaaccaucucagagacauaaugggaauaccauauugcaacuauaguaaauauugguauuuaaaccauacaguaacagguaaaacaucccuacccaaaugcugguuaguaucaaacggcucauaccuaaacgaaacacacuucucagaugacauagaacaacaagcagacaacaugauaacagaaauguuacagaaagaauacauggaaagacaagggaaaacaccacucggcuuaguugauuuauuuguauucucaaccagcuuuuaccuaauuucaaucuuuuuacaccuuguaaaaauaccaacacacagacacaucgucggaaaaucaugcccaaaaccacaccgucuaaaucacaugggaauuugcucuugcggacuauacaaacaaccaggaguaccaguaagauggaaaagauaa

SEQ ID NO: 2687 - RNA, 1476 nt, Artificial Sequence
  derived and/or modified CDS sequence (opt6) from Lassa virus__AIT17292__GPC
augggacaaauaguaacauucuuccaagaagucccccacgucauagaagaagucaugaauauaguauuaauagcccuuucgauaauggcuguauuaaaaggacuauacaacaucgcaacaugcggucuuguaggcuuaguaaccuucuuauuacuaugcggaagauccuguacaacaacguuauacaaaggcguauaugaacuacaaacacuagaauuaaacauggaaacucuaaauaugacaaugccacucucuugcacuaaaaacaauucacaccauuacaucaugguaggaaacgaaacaggacuagaauuaacacuaaccaacacaucaauuauuaaccauaaauuuuguaaccugucagaugcacacaaaaaaaacuuauacgaccaugcacuaaugucaauuauuucaaccuuccaccucucaaucccaaacuuuaaccaauacgaagcaauguccugcgacuucaauggcggcaaaauaucuguacaauacaacuuaagccacucauacgcaggagacgcagcaaaucacugcggaacaguagcaaauggcguacuacaaacauucaugcgaauggcauggggaggauccuauauagcacuugacucaggacauggaggaugggacugcauaaugacuucauaccaauaccuaauaauacaaaacacuacaugggaagaccauugccaauucacaagaccaagcccaauaggauaccucggacucuuaucccaaagaaccagagauauauacaucucaagaagauuacuaggaacuuuuacauggacacuaagugacucugaaggaaacgacacaccaggaggauacugcuuaacaagauggaugcuaauagaagcagaacucaaauguuuuggaaauaccgcuguagcaaaauguaacgaaaaacaugacgaagaauucugcgauaugcuuagauuauucgacuucaacaaacaagcaauacaaagauuaagagccgaagcccaaaugucaauacaacuaauaaacaaagcaguuaaugcccuaauuaacgaccaacuaauaaugaaaaaccaccuaagagacauaaugggaauaccauacugcaacuacucuaaauacugguaucuaaaucacacuacaacaggaagaacaaguuuaccaagauguuggcuaguaucaaacggaucauacuuaaaugaaacacacuucucagacgacauugaacaacaagcugacaacaugauaacugaaaugcuccaaaaagaauauauggaaagacaaggaaaaacaccacuagguuuaguagaccuauuuguuuucuccacaucauucuaccuaauuucaauauuccuacaccuaauaaaaauaccaacacauagacauauaguaggcaaaccauguccaaaaccacauagauuaaaccacauggguguauguucuugcggacuauacaaacaacccggagucccuguaagauggaaacgauaa

SEQ ID NO: 2688 - RNA, 1476 nt, Artificial Sequence
  derived and/or modified CDS sequence (opt6) from Lassa virus__AIT17294__GPC
augggacaaaucguaacauuuuuucaagaaguaccacacgucauagaagaaguaaugaacauaguacuaauagcacuaucaauacuagccguacucaaaggacucuacaaccuagcaacaugcggauuaguaggacuaguaacauuccuauuacuuuguggaagaucaugcaccacaucacuauacaaaggagucuacgaacuacaaacacuggaauuaaacauggaaacacuaaacaugacaaugccauuaucaugcacaaaaaacaacucucaccacuacauaaugguaggaaacgaaacaggacucgaauuaacccuaacaaacacaucuauuauagaccacaaauucugcaacuuaucagaugcacacaaaaaaaaccuauacgaucacgcacuuaugucaauaauuucaacauuucaucugucaauaccaaacuucaaucaauaugaagcaaugucaugugacuuuaacggaggaaaaaucucaguacaauauaauuuaucacauuccuacgccggagacgcagcaaaucacugcgguacagucgcaaauggaguauuacaaacauucaugagaauggccuggggaggaucauacauagcacuagacagcggacgcggugguugggacugcauaaugacaucauaccaauacuuaauaauucaaaacacaacaugggaagaucacugucaauucucucgaccaucaccagucggauacuuaggauuacuaucacaaagaacucgugauauauacauaucaagaagacuacuaggaaccuucacauggacacuauccgacucagaagguaaagacacaccuggaggauacugccuaacaagauggaugcuaauagaagcagaacuaaaaugcuucggaaauacagcaguagcaaaaugcaacgaaaaacacgacgaagaauucugcgacaugcuuagacuauuugauuucaauaaacaagcaauacaaagacuuaaaaccgaagcacaaauguccauacaacuaauuaacaaagcaguaaacgcacuaauaaacgaccaauuaauaaugaaaaaucaccuaagagauauaaugggaauccccuacugcaacuacucaaaauacugguaccucaaccauacaaccacaggaaaaaccucuuuaccaagauguuggcuagucucaaauggaucauaccuaaacgaaacacauuucucagaugacauagaacaacaagcagacaauaugauaacagaaaugcuacaaaaagaauacauggaaagacaaggaaaaacuccucuaggacuaguagaccuauucguauuuucaaccucauucuaccuaauaagcauauuccuucaccuaguuaaaauaccaacacacagacauauugucggaaaaccaugcccaaaaccacacagacuuaaccacaugggaauaugcucauguggacuauacaaacaacccggagucccagucaaauggaaacgcuaa

SEQ ID NO: 2689 - RNA, 1476 nt, Artificial Sequence
  derived and/or modified CDS sequence (opt6) from Lassa virus__AIT17298__GPC
augggccaaauaguaacauuuuuccaagaagucccacacguaauagaagaaguaaugaacaucgucuuaauagccuuaucaauauuagcuguacuaaaaggauuauacaauauagcaacaugcggacuccuaggccuaguauguuuucuacuacuaugcggacguucuuguacuacuagccuauacaaaggaguauacgaacugcaaacacuagaacuuaacauggaaacuuuaaacaugacaaugccacuaucaugcaccaaaaacaacucccaccacuacaucaugguaggaaacgaaacaggauuagaauuaacacuaacaaauacaaguauaauuaaccacaaauucugcaaccuaagcgaugcacauaagaaaaaucuauaugaucaugcacucaugaguauaauaucaaccuuccacuuaucaauaccaaacuucaaucaauacgaagcaaugucaugcgauuuuaacggcggaaaaauaucaguacaauacaaucuaucccacucuuaugcuguagacgcagcaucucauugcggaacaauagcaaauggaguucuacaaacauucaugcgaauggcauggggaggguccuacauugcacuagacucaggacauggaggaugggacugcauaaugacuucauaucaauauuuaauaauacaaaacacaacaugggaagaucacugccaauucuccagaccaagcccaauaggauaccuaggccuauuaucacaaagaacacgcgacauuuacauuucacgcagauuacuaggaacauuuacauggacccuauccgauucagaaggaaaagauacacccggagguuacugccucacucgauggaugcuaauagaagcagaauuaaaaugcuucggaaacacagcaguagccaaauguaaugaaaaacacgacgaagaauuuugcgacaugcucagauuauuugacuuuaauaaacaagcaauacaaagacuaaaagcagaagcacaaaugucaauucaauuaauaaauaaagcaguaaacgcccuaauaaacgaccaacucauaaugaaaaaccaccuacgagacaucaugggaauaccauacugcaacuacucuaaauacugguaucucaaucacacaacaaccggaaaaacaucacucccuaaaugcuggcuaguauccaacggaucauaccucaacgaaacccacuuuuccgaugauauagaacaacaagccgacaacaugauaacagaaauguuacaaaaagaauacauggaaagacaaggaaaaacaccacucggccuaguagaccucuucgucuuuuccacauccuucuacuuaauaucaauauuccuacacuuaguaaaaauaccaacacacagacacguaguaggaaaaccaugccccaaaccacacagauuaaaucauaugggaauaugcucaugcggacuauauggacaaccaggaguacccguaaaauggaaaagauaa

SEQ ID NO: 2690 - RNA, 1476 nt, Artificial Sequence
  derived and/or modified CDS sequence (opt6) from Lassa virus__AIT17302__GPC
augggucaaauaguaacguucuuccaagaaguaccacauguaauagaagaaguuaugaauauaguauuaauagcuuuaucacuccuagcaguauuaaaaggacuauauaacguagcaacaugcggauuaauaggacucguaacauuccuauuacuauguggcagaucauguacuacuaaccuuuacaaaggaguauacgaacuacaaacauuagaacuaaacauggaaacacuaaacaugacaaugccccuaagcuguacaaaaaacaacagucaucacuauauaaugguaggaaacgaaacaggauuagaauuaacacucacaaauacaucaauaauaucacacaaauucugcaaucuaagcgacgcacacaaaaaaaaccuauacgaccacacccuuaugucaauaauaucaacauuccaucuauccauaccaaauuucaaucaauaugaagcaauguccugcgauuuuaacggaggaaaaauaagcguacaauacaaccuaucccacucauaugcaguagacgcagcuaaucacuguggaaccguagcaaacggugucuuacaaacauucaugagaauggcuuggggaggauccuacauagcacucgacucaggaagaggcaacugggacuguauaaugacaucauaccaauacuuaauaauacaaaacaccacaugggaagaccacugucaauuuucacgaccauccccaauaggauaccucggccuacuaucacaaagaaccagagacauauacauuagcagacgacuacuaggaacauuuaccuggacacuauccgacucagaagguaaugacacaccaggaggauacugucuaacaagauggaugcucauagaagcagaauuaaaauguuuuggaaacacagcaguagcaaaaugcaaugaaaaacaugacgaagaauucugcgauauguuaagauuauuugauuuuaacaaacaagcaauacaaagauuaaaagcagaggcacaaaugucuauacaauuaauaaacaaagccguaaaugcauuaauaaacgaucaauuaauaaugaaaaaccaccuaagagacauaaugggaauaccauacugcaauuauucaaaauauugguaccuaaaccacacaaccacaggaaaaacauccuuaccaaaauguuggcuaguauccaauggcucauaucuaaaugaaacacauuucucagacgacauagaacaacaagcagacaauaugauaacagaaaugcuacaaaaagaauacauggaacgacaaggaaaaacaccacuaggacuaguugaucuauucguauucucaacaucuuucuaccuaauaucaauauuccuacaucuaguaaaaaucccaacccaccgacacauaguaggaaaaccaugcccaaaaccacauagacuaaaucacaugggaauuugcucauguggauuauacaaacaaccaggcguaccaguccgauggaaacgauaa

SEQ ID NO: 2691 - RNA, 1476 nt, Artificial Sequence
  derived and/or modified CDS sequence (opt6) from Lassa virus__AIT17310__GPC
augggccaaauagucacauuuuuccaagaagucccccacguaauagaagaagugaugaauauaguacuaauagcacuuaguauauuagcaguucucaaaggacuauauaacuuagccaccugcggauuaguaggacuaguaacauuucuauuacuaugcggaagaucaugcaccacaucauuauacaaaggagucuacgaacuccaaacauuagaguuaaacauggaaacacucaauaugacaaugccccuuucauguacaaaaaauaauucacaccacuauaucauggucggaaacgaaacagguuuagaacuaacauuaacuaacacauccauaauaaaccacaaauucugcaaccuaucagacgcccacaaaaaaaacuuauaugaccacgcauuaaugucaauuauuucaacauuccaucuaucaaucccaaauuuuaaccaauacgaagcaaugucuugcgauuuuaacggcggaaaaauaucaguucaauacaaccuaucacacucauaugcaggagacgcagcaacacacugcgguacaguagcaaauggcguuuuacaaacauucaugagaauggcuuggggaggauccuauauagcacuagacuccggccgaggaaaaugggacugcauaaugaccucauaucaauaccuaauaauacaaaacaccacaugggaagaccacugccaauucucuagaccaucccccauagguuauuuaggccuacuaucacaaagaaccagagacauauacaucucaagacgcuuacucggaacauucacuuggacacuauccgacucagaaggaaaagacacaccaggaggcuauugcuuaaccagauggaugcucauagaagccgaacuaaaauguuuuggcaacaccgcaguagcaaaaugcaacgaaaaacacgacgaagaauuuugugauaugcuaagauuauucgacuucaacaaacaagcuauacaaagacuaaaaacagaagcacaaaugucuauacaauuaauaaacaaagcaguaaaugcuuuaauaaacgaucaacuaaucaugaaaaaccaccuaagagacauaaugggaauaccauauugcaauuacaguaaauacugguaccuaaaccacacaacaacaggaaaaacaucauuaccaagaugcuggcucgucucaaacgguucauaccucaacgaaacccacuuuucagacgauauagaacaacaagccgacaauaugauaacagaaaugcuccaaaaagaauacauggaaagacaaggaaaaaccccucuaggacuaguugacuuauucguauucucaacaucauucuaccuaauaucuauauuucuacauuuaguaaaaauuccuacucacagacauauaguaggcaaacccugcccaaaaccucacagacucaacuauaugggaauaugcucuugcggacucuacaaacaaccugguguaccuguaaaauggaaacgauaa

SEQ ID NO: 2692 - RNA, 1476 nt, Artificial Sequence
  derived and/or modified CDS sequence (opt6) from Lassa virus__AIT17314__GPC
augggucaaauaguaacauucuuucaagaaguaccacacgucauagaagaaguaaugaacauuguucuaauaacauuaucaauacuagcuguucuaaaaggacuauacaacguugcaacauguggacuaguuggauuaguuacauuccuauuacuauguggaagaucauguacaacaucccuauacaaaggaguauacgaauuacaaacauuagaauuaaacauggaaaccuuaaauaugacaaugccacuauccugcacaaaaaacaacagccaccauuacauaauggucggaaacgaaacaggacuagaacuuacacuaaccaacacgucaauaaucaaccacaaauucugcaaccuaucagaugcccauaaaaaagaccuauaugaucacgcacuaaugagcauaauaucaaccuuucaucuaucuauaccaaacuucaaccaauacgaagccaugucaugugauuuuaacggaggaaaaauaagcguacaauacaaccuaucacauucauacgcaguagacgcagccaaucacuguggaaccguagcaaacggaguauuacaaacauucaugagaauggcauggggaggaucauauaucgcacucgacucaggaagaggcggaugggacugcauaaugacauccuaccaauaucucaucauacaaaauaccacaugggaagaccauugccaauucucaagaccaaguccaaucggauaccuaggcuuacuaucacaaagaacuagggacaucuacauaucaagaagacuacuagguacauucacauggacacuaucagauucagaaggaaaugauacaccaggcggcuauugccuaacaagauggaugcucaucgaagcagaacuaaaaugcuucgguaauacagcaguagcaaaaugcaacgaaaaacacgacgaagaauucugugacauguuaagauuauucgacuuuaacaaacaagcaauacaaagacuaaaagcagaagcacaaaugucaauacaauuaauuaacaaagccguaaacgcuuuaauaaaugaccaauuaauuaugaaaaaccaccuaagagacauaaugggaaucccauacuguaacuauucuaaauacugguaucuaaaccacacaacaaccggaaaaacuagcuuaccaaaauguuggcuaguaucaaacggcuccuaccucaacgaaacacacuuuucugacgauauagaacaacaagcagauaauaugauaacagaaauguuacaaaaagaauacauggaacgucaaggcaaaaccccacuuggacuaguagaccucuucguauuuucaaccuccuucuaucuuauuucaauauucuuacacuuaguaaaaauuccaacacaccgacacauaguaggaaaaccauguccuaaaccacauagauuaaaccacaugggaaucuguagcugcggauuauacaaacaaccaggagucccaguaaaauggaaaagauaa

SEQ ID NO: 2693 - RNA, 1476 nt, Artificial Sequence
  derived and/or modified CDS sequence (opt6) from Lassa virus__AIT17318__GPC
augggacaaauaguaacauucuuccaagaaguaccacacguaauagaagaaguaaugaacauaguacucauagcauuaucauuacuugccguauuaaaaggauuauauaauguagcaacaugugggcuuauaggacuaguaacauucuuacuccuaugcggaagaucaugcacaacaaauuuauauaaaggaguuuacgaauuacaaacauuagaauuaaauauggaaacuuuaaacaugacaaugccacucucauguacaaaaaacaauucccaccacuacaucaugguaggaaacgaaacaggauuagaacuaacacuaaccaacacaucaauuauaaaccacaaauucuguaaccuaucagacgcucauaaaaaaaauuuauacgaucacgcccucaugagcaucaucucaaccuuccaucuaucaauaccaaacuucaaccaauacgaagcaaugucuugcgacuuuaauggaggaaaaauaucuguacaauacaaccuaucccauucauacgcaguagacgcagcaaaccauugcgguacaguagcaaauggaguccuacaaacauucaugagaauggcauggggcggaucauacauagcacuagauagcggaagaggcaacugggauugcauaaugacuucauaccaauaucuaauaauacaaaauauaacaugggaagaucauugucaauucucacgaccaagcccaaucgguuaccucggauuauuaucacaaagaacaagagacauauauauuucuagaagacuacucgguacauucacauggacauuaucagacucagaaggcaaugacacaccaggaggauacugucucacaagauggaugcuaauagaagcagaacuaaaaugcuucggaaauacagccguagcaaaaugcaaugaaaaacaugacgaagaauucugugauaugcuaagacuauucgacuucaacaaacaagcuauacaaagauuaaaagcugaagcucaaaugucaauccaauuaaucaacaaagcuguaaaugcacucauaaacgaccaauuaauaaugaaaaaccaucuacgagacauuaugggaauaccauacuguaacuauucuaaauauugguaucuaaaccacacuacaacaggaaaaacaucuuuaccaaaaugcuggcucguaucaaauggcucauaccuuaaugaaacacacuuuuccgacgacauagaacaacaagcugauaacaugauaacagaaaugcuacaaaaagaauacauggaacgacaaggcaaaacaccacucggauuagucgauuuauuuguauucucaacauccuuuuacuuaauuucaaucuuccuacauuuaguaaaaauaccaacccaccgacacauaguaggaaaaccaugccccaaaccacauagacuuaaucacaugggaauauguuccugcggcuuauauaaacaaccaggaguaccaguacgcuggaaaagauaa

SEQ ID NO: 2694 - RNA, 1476 nt, Artificial Sequence
  derived and/or modified CDS sequence (opt6) from Lassa virus__AIT17322__GPC
augggccaaaucguaacauucuuccaagaaguuccccacguuauagaagaaguaaugaacauaguacuaauagcccuaucucuauuagcaguccuaaaaggccucuauaacguagcaacuugcggauuaauaggacuaguaacauucuuacuacuaugcggcagaucaugcacaacaaaccuauacaaaggagccuacgaacuacaaacacucgaacuuaacauggaaacauuaaauaugacuaugccccuauccugcacaaaaaacaauucacaucacuacauaaugguaggaaacgaaaccggauuagaauuaacacuaacaaacaccuccauaauaaaccacaaauucugcaaccuaucagacgcacacaaaaaaaauuuauacgaucacacccuaaugucaauaauaucaaccuuccacuuaagcauaccaaauuuuaaucaauacgaagcaauguccugcgacuucaacgguggaaaaauuagcguccaauacaaucuaucccauucauacgcaguagaugcagcuaaucauugcggaacaguugcaaacggaguacuacaaacauucaugagaauggcaugggguggcucauauauagcacuagacucaggccgaggaaacugggacugcauuaugacaucauaucaauacuuaauaauacaaaacaccacaugggaagaucacugccaauucucaagaccaucaccaauaggauaccuaggacuauuaagccaacgaacaagagacauauacauaucaagaagacuucuuggcacauucacauggacacuaucagauucagaagguaaugauacacccggaggauacuguuuaacacgauggaugcuaauagaagcagaauuaaaaugcuuuggaaauacagcuguugcaaaaugcaacgaaaaacacgacgaagaauucugcgauaugcuacgacucuucgacuucaauaaacaagcaauacagagauuaaaagcagaagcacaaauguccauccaacuaauaaauaaagcaguaaacgcacuaauaaacgaccaacuaaucaugaaaaaucacuuaagagacauaaugggcaucccuuauugcaacuauucaaaauacugguacuuaaaccacacuacaacaggcaaaacuucauuaccuaaaugcugguuaguaucaaauggcucuuaccuaaacgaaacucacuucucagacgauaucgaacaacaagcugacaauaugauaacagaaaugcuacaaaaagaauacauggaaagacaaggaaaaacuccacuaggccuaguagaucuauucgucuucucaacaucauucuacuuaauauccauauucuuacaccuaguaaaaauaccuacucacagacacauaguagggaaaccauguccaaaaccacauagacuaaaccacaugggaauaugcuccugcggacuauauaaacaaccaggaguacccguccgauggaaaagauaa

SEQ ID NO: 2695 - RNA, 1476 nt, Artificial Sequence
  derived and/or modified CDS sequence (opt6) from Lassa virus__AIT17328__GPC
augggacaaauaguaacauucuuccaagaaguaccacacguuauagaagaaguaaugaacauaguccuaauuacauuaucaauauuagcaguauuaaaaggacuauacaacauagcaacuugcggacuaguuggccuuguaacauucuuauuacucugcggaaaaucaugcacaacaucacuuuauaaagguguauacgaauuacaaacacuagaacuaaauauggaaacauuaaauaugaccaugcccuuauccugcaccaaaaacaauucacaucacuauauaagaguaggaaacgaaacuggacuugaacuaacacuaacaaacacaucaauaauaaaccacaaauucugcaaucuaucagaugcacacaaaaaaaauuuauacgaucacgcacuaauguccauaauuucaacauuccaucuaucaauaccaaacuucaaccaauacgaagcuauguccugcgauuucaacggcggaaaaauuucaguccaauacaacuuaucacauucauaugcaguagacgcagccaaccacuguggaacaguagcaaacggaguacuacaaacauucaugcgaauggcuuggggaggaucuuauauagcacuagacucaggacacggaaacugggauugcauaaugacaucauaccaauaccuaauaauacaaaacacaacaugggaagaccacugucaauuuucaagaccaagucccauaggauaccuaggauuauuaucacaaagaaccagagacauauacauaucaagaagauuauuaggaacauuuacauggacacucucugacucugaaggaaacgacgccccaggaggcuacugccuaacaagauggauguuaauagaagcagaacuaaaaugcuuugguaacacugcaguagcaaaauguaaugaaaaacaugacgaagaauucugcgacaugcuacgacuauucgacuucaauaaacaagcuauccaaagacuaaaagcagaagcucaaaugucgauccaacuaaucaauaaagcaguaaaugcauuaauaaaugaccaauuaauaaugaaaaaucacuuaagagacauaaugggaauacccuauugcaauuacaguaaauauugguacuuaaaucacacuacuaccggaaaaacaucauuaccaaaaugcuggcuaguuucaaacggaagcuaccuaaacgaaacacacuucucagaugauauagaacaacaagcagacaauaugauaacagaaauguuacaaaaagaauauauggaaagacaaggaaaaacacccuuaggauuaguagaccuauucguauuuagcaccaguuucuacuuaauauccauauuucuacauuuagucaaaauaccaacacauagacacguaguuggaaaaagcuguccaaaaccacacagacuuaaccauaugggaauaugcucaugcggacuauauaaacaacccggcguaccaguaaaauggaaacgauaa

SEQ ID NO: 2696 - RNA, 1476 nt, Artificial Sequence
  derived and/or modified CDS sequence (opt6) from Lassa virus__AIT17332__GPC
augggucaaaucguuaccuuuuuccaagaaguuccacacguaauagaagaaguaaugaacauaguauuaauagcacuaucuauauuagcaguauuaaaaggacuauacaaucuagccacaugcggauuaguaggccucguaacauuccuccucuuaugcggcagaucauguacaacaucacucuauaaaggaguauacgaauuacaaacacuagaauuaaauauggaaacacuaaauaugacaaugccacuaucauguacaaaaaacaacucacaucacuacauaagaguaggcaaugaaaccggacuagaauuaacccucacaaacacuucaauaauaaaucacaaauucuguaaucuaucugacgcacacaaaaaaaaccuauacgaucaugcacuaaugucaauaaucucaacauuucacuuauccauaccaaacuucaaccaauaugaagcaaugucaugugacuuuaacggaggaaaaauaucaguacaauacaaccuaucacacuccuacgcaguagaugcagcaaaccauugcggaacaguggcaaacggaguauuacaaaccuucaugagaauggccuggggaggaucauacauagcauuagacucaggacacggaagaugggauuguauaaugacaucauaucaauacuuaauaauacaaaacacuacaugggaagaccauugcuuauuuuccagaccuucuccaauaggauacuuaggauuauuaucacaaagaacuagagauauauauauauccagaagacuauuaggaacuuucacauggacauuaucagacucagaaggacgcgauaccccaggaggauacugucucacacgauggaugcuuaucgaagcagaacuuaaauguuucggaaacacugccguagcaaaaugcaacgaaaaacaugaugaagaauuuugugacaugcuucgacuauuugacuucaacaaacaagcaauacaaagauuaaaagcagaagcacaaaugucaauacaacuaaucaauaaagcaguaaacgcccuaauaaacgaucaacuaauaaugaaaaaccaccuaagagacauaaugggaauaccauacugcaacuauucaaaauacugguauuuaaaccacacaaccacaggaagaacaucucuacccagauguuggcuaguauccaauggaucuuacuuaaacgaaacccacuuuagugacgacauagaacaacaagccgacaauaugauaacagaaauguuacaaaaagaauacauggaacgccaagguaaaacaccuuuaggucuaguagaccuauucguauucucaacaucauuuuacuuaauaucaauauuccuacaccuaguaaaaauaccaacacaccgacacauagucggaaaaagcugccccaaaccacaccgacuaaaucauaugggcauaugcuccugcggacuauauaaacaaccaggaguuccaguaaaauggaaaagauaa

SEQ ID NO: 2697 - RNA, 1476 nt, Artificial Sequence
  derived and/or modified CDS sequence (opt6) from Lassa virus__AIT17340__GPC
augggacaaauaguuacauucuuccaagaaguaccacaugucauagaagaaguaaugaauauaguacuaauagcacuaucaauacucgccguauuaaaaggauuauauaacuucgcaaccugcggccucgucggccucguaacuuuucuacuauuaugcggaagaucauguacaacaucacuauacaaagggguauacgaacuacaaaccuuagaacucaacauggaaacccugaauaugacaaugccacuaaguugcacaaaaaacaauucccaucauuacaucaugguaggaaaugaaacagguuuagaauuaacacuaacaaauaucuccauaaucaaccacaaauuuuguaacuuaucagacgcacacaaaaaaaauuuauacgaccaugcauuaaugucaauaaucucaacauuucaucuauccauaccuaauuuuaaccaauacgaagcaaugucuugcgacuucaacgguggaaaaauaucaguccaauacaaccuaucacacucauaugcaggcgaugcagcaaaccacuguggaacaguagcaaacggcguccuucaaaccuuuaugagaauggcuuggggaggcucauacauagcauuagauucaggaagaggugaaugggacugcauaaugacaucauaccaauacuuaauaauacaaaacacaaccugggaagaccacugccaauucucacgcccaucaccaauaggauauuuaggacuacucucacaaagaacuagagacauauacauaucaagacgacuacucggaacauucacauggacacuaagugacuccgaaggaaaagacacaccaggaggauauugccuaaccagguggaugcucauagaagcagaacuaaaaugcuucggaaauacagccguagcaaaaugcaacgaaaaacaugacgaagaauucugugauauguuacgacuauucgauuucaacaaacaagcuauacaacgacuaaaagcagaagcacaaauguccauacaacuaauaaacaaagcaguaaacgcacuaauaaacgaccaacuaauaaugaaaaaccaccucagagauauaaugggaaucccauauugcaauuacuccaaauauugguacuuaaaccauaccacaacaggaaaaaccucccuacccaaauguuggcuaguauccaauggaucauacuuaaacgaaacacacuuuucugacgauauagaacaacaagcagacaauaugauaacagaaauguuacaaaaagaauauauggaaagacaaggaaaaacaccauuaggacucguagaucuauucguauucucuacaucauucuauuuaaucuccauauuucuacaccuaguuaaaauaccaacacacagacauauagucggcaaaccaugccccagaccacacagauuaaaucacaugggaauauguagcugcgguuuauacaaacaaccuggcgucccaguaaaauggaaaagauaa

SEQ ID NO: 2698 - RNA, 1476 nt, Artificial Sequence
  derived and/or modified CDS sequence (opt6) from Lassa virus__AIT17344__GPC
augggacaaauaguaacauuuuuucaagaagucccacacguaauagaagaaguaaugaacauaguacucauagcccuauccauacuugcaguacuaaaaggacuauauaacuucgcuacaugcggauuaguaggacuaguaacauuccuucuacuuugcggacguaguuguacaacaucacuauacaaaggagucuacgaauuacaaacauuagaacuaaacauggagacauuaaacaugacaaugccauuaaguugcacuaaaaauaauucccaucacuacaucaugguaggaaacgaaacaggacucgaacuaacauuaacaaauacaucuaucauaaaccacaaauucuguaaccuaucugaugcucauaaaaaaaacuuauacaaccacgcauuaaugucuauaauauccacuuuccacuuaaguauaccaaacuucaaccaauacgaagccaugucaugcgauuucaacgguggcaaaauaucaguucaauacaacuuaucccauuccuaugccggagaugcagcuucacauugcgguacaguugcaaacggaguacuacaaacuuucaugagaauggcauggggaggaucauauaucgcacuugacucaggauacgguaaaugggacugcaucaugacaucauaccaauauuuaauaauacaaaauacuacaugggaagaccauugccaauuuucacgaccauccccaauaggauaccucggacuauuaucccaaagaaccagagacauauacauaucacgaagauuacuagguacauuuacauggacuuuaucagacucagaaggaaaagacacaccuggaggcuauugccuaacaagauggauguuaauagaagcagaauuaaaauguuucggaaacacagcaguggcuaaauguaacgaaaaacacgacgaagaauuuugcgacauguuaagauuauucgacuucaacaaacaagcaauacaacgucuaaaaacagaagcccaaaugagcauccaacuaauaaacaaagcaguuaacgcacugauaaacgaucaacuaauaaugaaaaaccaccuaagagacauaaugggaauccccuacuguaacuacucuaaauacugguaucuaaaccacacaacaacaggaaaaacaucacugccaaaaugcuggcuaguaucaaacggaucauaccucaaugaaacacacuucucagacgauauagaacaacaagcagacaacaugaucacagaaauguuacaaaaagaauacauggaaagacaaggcaaaacacccuuaggccuaguugaccuauucguauucuccacaucuuucuacuuaauaagcauauuucuacaucuaguaaaaauacccacccacagacacauaguaggaaaaucaugcccaaaaccucacagacuaaaucauaugggcauaugcucauguggccucuacaaacaaccuggcgucccaguaagauggaaaagauaa

SEQ ID NO: 2699 - RNA, 1476 nt, Artificial Sequence
  derived and/or modified CDS sequence (opt6) from Lassa virus__AIT17348__GPC
augggacaaauaguaacauucuuccaagaaguaccacacguaauagaagaaguaaugaauauuguauuaauagcauuaucaauacuagcaguacuuaaaggauuauacaacauagcuacuugcggucuaauaggacucguaacauuccuucuacuaugcggaagaucauguacaaccucacucuauaaaggaguauaugaacuacaaacacuagaacuaaauauggaaacacuaaauaugaccaugccucucuccugcaccaaaaacaacucacaucacuacauaaugguaggaaaugaaaccgguuuagaacuaacauuaaccaacacaucaauuauaaaucauaaauucuguaaucucucugaugcgcacaaaaaaaaucucuacgaucacgcacuaaugucaauaauaucaacauuccaccuaucaauaccuaacuucaaucaauacgaagcaaugagcugcgauuuuaacggcggaaaaauaucaguacaauacaaccucucacacucuuacgcaggagacgcagcaaaucauugcggaacaguagcaaauggaguacuacaaacauucaugagaauggcuuggggcggcuccuacauagcacuagacucaggacgagguagaugggacugcauaaugacaucauaccaauaucuaauaauacaaaacacaacaugggaagaucacugccaauucucacgaccaucuccaauaggauaccuaggcuuacuaucccaaagaacaagagacauauauauaucaagacgacuauuagguaccuucacauggacauuaucagauucagaaggaaacgauaccccaggaggauacugccugacaagauggaugcuaauagaagcagaauuaaaaugcuucggaaauacagccguagcuaaaugcaacgaaaaacacgaugaagaauuuugcgauauguuacgacuauucgauuucaauaaacaagcaauacaaagacuaaaagcagaagcacaaauguccauacaauuaauaaauaaagcaguaaacgcacucauaaacgaucaacucauaaugaaaaaccaccucagagauauaaugggcauaccauacugcaacuauucaaaauacugguacuuaaaccacacaacaacuggaaaaacaucucuaccaaaaugcugguuagugagcaacggcucauaucuuaaugaaacacacuucucagacgacauagaacagcaagcugacaacaugauaaccgaaauguuacaaaaagaauacauggaaagacaaggaaaaacaccucuaggcuuaguagaccuauucguauuuucaacuuccuuuuaccuaauaucaauauuccuccaccuuguuaaaauacccacccacagacacauaguuggaaaaccaugcccuaaaccucaucgacuuaaccacaugggaauaugcucaugcggacuauauaaacaaccaggcgucccaguuaaauggaaaagauaa

SEQ ID NO: 2700 - RNA, 1476 nt, Artificial Sequence
  derived and/or modified CDS sequence (opt6) from Lassa virus__AIT17350__GPC
augggacaaauaguaacauuuuuccaagaaguaccacauguaauagaagaaguaaugaacauuguacuaauagcccuaucaauacuagcaguucuaaaaggucuauacaauguagcaacaugcggacuaauaggacuuguaacauucuuauuacuaugcggccgaagcugcacaaccacccuauauaaaggcguauaugaacuacaagcccuagaauuaaauauggaaacacucaauaugaccaugccauuaucaugcaccaaaaacaacucccaccacuauauaaugguaggaaacgaaacaggacuagaacuaacauuaacaaacacaucaauaauagaucacaaauuuugcaaccucucagacgcucauaaaaaaaaccuauacgaucacgcacuaaugucuauaaucucaacauuucaccuuuccauaccaaacuucaaccaauacgaagcaaugagcugugauuucaacggaggaaaaauaucuguacaauacaaccuaucacauucauaugcaggagacgccgcaaaacauugugggacaguagcuaauggaguuuuacaaacauuuaugagaauggccuggggaggaucauacaucgcacucgacucaggacgaaacggaugggacuguguaaugacaagcuaccaauacuuaauaauacaaaauacaacaugggaagaccacugccaauuuagcagaccuaguccaauaggauaccuaggacuacuaucacaacgaacaagagacauauacauuucuagacgucuucuaggaaccuucacauggacacuaucagacuccgaaggaaaagacacuccaggaggauacugucuaacaagauggaugcucauagaagcagaauuaaaauguuucggcaacaccgcagucgcaaaaugcaacgaaaaacacgaugaagaauucugcgacauguuacgcuuauucgauuuuaacaaacaagcuauacaaagacuaaaaacagaagcccaaaugucaauacaacuaauaaacaaagccguaaacgcacucauaaacgaccaacuaauaaugaaaaaccacuuaagagauauaaugggaauacccuacuguaacuacucuaaauacugguaccuaaaccacacaguaacaggaaaaacauccuuaccacgaugcugguuaguaucuaacggaucuuaccuaaacgaaacacacuucuccgaugacaucgaacaacaagccgacaacaugauaacagaaaugcuacaaaaagaauacauagaaagacaaggaaaaacuccacuaggauuaguagaccuauucguuuuuuccacaucauucuaucuaauaucaauauuccuccacuuagucaaaauacccacacaccgacacaucaucggaaaaccaugccccaaaccacacagacuuaaccacaugggaauaugcucaugcggauuauacaaacaaccaggaguaccaguccgauggaaacgauaa

SEQ ID NO: 2701 - RNA, 1476 nt, Artificial Sequence
  derived and/or modified CDS sequence (opt6) from Lassa virus__AIT17354__GPC
augggacaaauaguaacauucuuccaagaaguuccucauguaauagaagaagucaugaacauaguacucauagcacuaucuauacucgcaguccuaaaaggauuauauaacuucgcaacaugcggacuaguaggucuaguaacauuucuacuuuuauguggacgaaguuguacaacauccuuauacaaaggcguauacgaauuacaaacacuugaacuaaacauggaaacacuaaauaugaccaugccauuaucaugcacaaaaaacaauagucaccacuauauaaugguaggaaaugaaaccggacuagaacuaacacuaacaaacauaucaaucauaaaccacaaauucugcaaccuaucagacgcccacaaaaaaaaucuauacgaccacgcacuaauguccaucauaucaacauuccaccuaucuauaccaaacuucaaccaauacgaagcaauguccugcgacuucaauggaggaaaaauauccguacaauauaacuuaucacauucauacgcaggagaugcagcaaaccauugcggaacuguagcaaauggaguauuacaaacauucaugagaauggcauggggaggaucauacauagcauuagauucaggccacggaggaugggacugcaucaugacaucauaucaauaccuaauaauccaaaacacaacaugggaagaccacugccaauucucacgaccgucgccaaucggauaucuaggauuacuaucacaaagaacaagagauauauauauaucaagaagacuauuagguacauuuacauggacauuaucagauucagaaggaaaagacacuccaggaggauacuguuuaacacgauggauguuaauagaagcagaauuaaaaugcuucggaaacacagcaguagcaaaaugcaacgaaaaacacgacgaagaauucugcgacaugcuaagacuuuucgauuucaacaaacaagcaauacaacgauuaaaagcugaagcacaaaugucaauacaauuaauaaacaaagcaguaaacgcauuaaucaaugaccaacucauaaugaaaaaccaucuaagagacauaaugggaaucccauauugcaacuacagcaaauacugguacuuaaaccauaccaccacaggaaaaacaucauuaccaaaaugcugguuaguuuccaauggcucauaccuaaacgaaacucauuuuagcgacgacauagaacaacaagcagacaacaugauaacagaaaugcuacaaaaagaauacauggaaagacaaggaaaaacaccacuaggauuaguagaccucuucguauucucuacaucauuuuaccuaauaucaauauucuuacaucucgucaaaauaccaacccaucgacacauaguaggaaaaccauguccaagaccacauagacuaaaccauaugggaauaugcucauguggccuauacaaacaaccaggaguaccaguaaaauggaaacgauaa

SEQ ID NO: 2702 - RNA, 1476 nt, Artificial Sequence
  derived and/or modified CDS sequence (opt6) from Lassa virus__AIT17360__GPC
augggccaaauuguuacauucuuccaagaaguaccacauguaauagaagaagucaugaauauaguauuaauagcccuauccauacucgcaguacuaaaaggacuauacaacuuugcuacaugcggccuaguaggauuagucacuuuucuacuucuaugcggaagaucaugcacaacaucauuauacaaaggagucuaugaauuacaaacacuagaacucaauauggaaacccuuaacaugacaaugccacuuucaugcaccaaaaauaauucacaccacuacauaagaguaggaaacgaaacaggauuagaauuaacauuaacaaacaccucaauaauaaaccauagauuuuguaaccuaucagacgcacauaaaaaaaaucuauacgaucaugccuuaaugucuauaauuucaacauuccaccuauccauaccaaacuucaaccaauacgaagcaaugucaugugauuucaacggaggaaaaauaucaguacaauacaaccuaagucacucauacgccggagaugcagcaaaucacugcgguacaguugcaaauggcguucuacaaacauucaugagaauggcauggggaggcucauacauagcauuagacucaggacacggaaaaugggacugcauaaugacaucauaccaauaucuaaucauacaaaacacaacaugggacgaccacugucaauucucaagaccaucaccaauaggcuacuuaggucuacuaucacaacgaacccgcgacauauacaucagcagaagacucuuaggcacuuucacauggaccuuauccgacucagaaggaaaagauacaccaggaggauacugccucacaagauggaugcucauagaagcagaacuaaaaugcuucggaaacacagcaguagcaaaaugcaacgaaaaacaugaugaagaauucugcgauauguuaagacucuucgauuucaauaaacaagcaaucagaagacuaaaagcagaagcacaaaugucaauacaacuaauaaacaaagcaguaaacgcacuuauuaaugaucaacuaaucaugaaaaaucaccuacgugacauaaugggaauaccauacugcaacuacucaaaauacugguaccuaaaccauacaaccaccggaaaaacaucccuaccaagaugcugguuaguaucaaacggauccuaucucaacgaaacacauuuuucagaugauauugaacaacaagcugacaauaugauaacagaaaugcuacaaaaagaauauauggaacgacaaggcaaaacaccucuaggccuaguagacuuauucguauuuucuacauccuucuacuuaauaucaauauuccuacaccuagugaaaaucccaacacacagacauauuguaggaaaaaguugcccaaaaccacauagauuaaaccauaugggaauuugcaguugcggauucuauaaacaaccaggaguaccagucaaauggaaaagauaa

SEQ ID NO: 2703 - RNA, 1476 nt, Artificial Sequence
  derived and/or modified CDS sequence (opt6) from Lassa virus__AIT17364__GPC
augggacaaauaguaacauucuuccaagaagucccucauguaauagaagaaguaaugaacauaguccucauagcccuaucaauacuagcaguacuaaaaggauuauacaacuucgcaacaugcggccucguaggauuaguaacauucuuacuucuaugcggcagauccugcacaaccucacuuuauaaaggaguauacgaauugcaaacacucgaacuaaauauggaaacacuaaacaugacaaugccacuaucaugcaccaaaaauaacucacaucacuacauaauggucggaaaugaaacaggccucgaacucacacucacaaauacaucaauaauaaaccacaaauucugcaaccuauccgacgcacacaagaaaaacuuauacgaccacgcuuuaaugucaauaauaucaacauuccaccucagcauaccuaauuucaaucaauacgaagcaaugucaugcgauuuuaauggaggaaaaauuuccguacaauacaaccuaucccauucauacgcaggagacgcagccaaucauuguggaacuguagcaaacgguguacuacaaacauuuaugagaauggcauggggagguucguauauagccuuagacucaggacgugacagaugggauugcauaaugacuucauaccaauaccuaaucauacaaaacaccacaugggaagaccacugucaauuuucacguccaucaccaauuggauauuuaggucuauuaagccaacgaacaagagacauauacauaucaagaagacuuuuaggcacauucaccuggacacuuuccgauucagaaggaaaagacacaccaggaggauauugccuaacacgauggaugcucauagaagccgaacuaaaaugcuuuggaaacacagccguagcaaaauguaacgaaaaacaugaugaagaauuuugcgauaugcucagacuauucgacuucaacaaacaagcuauacaaagauuaaaagcagaagcacaaauguccauacaauuaaucaacaaagcaguuaacgcacuaauaaaugaucaauuaauaaugaaaaaccauuuaagagacauaauggguauaccauauugcaauuacucuaaauauugguacuuaaaucacacaacaacaggcaaaacaagucuacccaaaugcugguuaguaucaaacggaucauacuuaaaugaaacccauuucucagacgacauagaacaacaagcagauaauaugauaacagaaauguuacaaaaagaauauaucgaaagacaaggcaaaacaccuuuaggacucguagacuuauucgucuucucaacaucauucuaccuaauaucuauauucuuacaucuaguaaaaauaccaacacacagacacauaguaggaaaaccauguccaaaaccacacagauuaaaccauaugggaauauguucaugcggccuauacaaacaaccaggaguaucagucaaauggaaaagauaa

SEQ ID NO: 2704 - RNA, 1476 nt, Artificial Sequence
  derived and/or modified CDS sequence (opt6) from Lassa virus__AIT17368__GPC
augggacaaauaguaacauucuuucaagaaguaccacacguaaucgaagaaguaaugaacaucguccuuauagcauuaucaauacuagcaguccuaaaaggacuuuacaacuucgccacaugcggacuaguaggacuaguaacauucuuauuauuaugcggacgaucuuguacaaccucauuauacaaaggaguuuacgaacuacaaacacuagaacucaauauggaaacacucaauaugacaaugccacuaucuuguacaaaaaacaauucccaucauuauauaaugguaggaaacgaaacaggccuugaacugacacuaaccaacacaagcauaauaaaccauaaauucugcaacuuaagugacgcccacaaaaaaaaccuauaugaccacgcacuaaugucaauuauuucaacauuucaccuaucaauaccuaauuuuaaccaauucgaagcaaugucaugugacuucaaugguggaaaaauauccguacaauacaauuuaagucacuccuacgcaggcgaugcagccaaccauugcggaaccguagcaaacggaguacuacaaacauucaugagaauggcauggggaggcucauacauagcucuagauucaggacacucaaaaugggacugcauaaugaccucauaucaauacuuaauuauacaaaauacaaccugggacgaucacugccaauucucaagaccaucaccaauaggauacuuaggacuacuuucacaaagaacaagagacauauauaucucacgaagauuacuaggaacuuucacuuggacauuaucagacuccgaagguaaagacacaccuggaggauacugcuuaacaagauggaugcucauugaagcugaacuaaaaugcuuuggaaauacagcagucgccaaaugcaaugaaaaacaugaugaagaauucugugacaugcuaagacuauuugauuuuaacaaacaagcaauccaaagacuaaaagcagaagcucaaaugucaauacaacuaauuaacaaagcagucaaugcacuaauaaacgaccaauuaauaaugaaaaaccaccuuagagacaucaugggaauaccauacugcaauuacucaaaauacugguaccuaaaccacacaacaacuggaaaaacaagucuaccaaaaugcuggcucguauccaacggcucauaccuaaaugaaacccacuucucagacgacauagaacaacaagcagacaacaugauaacagaaaugcuacaaaaagaauacauggaaagacaaggcaaaacaccauuaggccuaguagaccuauucguauucucuacuagcuucuaccucauaucaauauucuuacaccucguaaaaaucccaacccacagacacauagucggcaaaucaugccccaaaccacauagacuaaacuauaugggcauaugcucaugcggauucuacaaacaacccgguguaccaguaaaauggaaacgauaa

SEQ ID NO: 2705 - RNA, 1476 nt, Artificial Sequence
  derived and/or modified CDS sequence (opt6) from Lassa virus__AIT17370__GPC
augggacaaaucguaacauucuuccaagaaguuccacacguaauagaagaaguaaugaacaucguacuaauagcauuaucuauauuagcaguauuaaaaggauuauauaacuucgcaacaugcggucuaguaggacuaguaacauuccucuuacuauguggacguucaugcacaacaucacuauauaaaggcguauacgaacuacaaacacuagaauuaaauauggaaacacuaaacaugacaaugccucuauccuguacaaaaaacaauucacaccacuacauaaugguuggcaacgaaacaggccuugaacucacacuaacaaacacaagcaucauaaaucacaaauucugcaacuuaagcgaugcacacaaaaaaaaccucuaugaucaugcauuaauguccauaauaucaacauuucaccuaucaauaccuaauuucaaccaauacgaagcaaugucaugcgacuuuaacggaggaaaaauaucaguacaauacaacuuaucccauucauaugcuggcgacgcagcuaaucauuguggaacaguagcaaacggaguauuacaaacauucaugagaauggcauggggaggaucauauauagcauuagacucaggacgagauagaugggacugcauuaugacuucauaucaauaccugauaauacaaaacacaacaugggaagaccacugucaauuuucuagaccauccccaauaggauauuuaggccuacuaagccaaagaaccagagacauauacauaucaagacgacuacuuggaaccuucaccuggacucuaucagacucagaaggaaaagacacuccaggaggcuacugccuaacaagauggauguuaauagaagcagaacuaaaauguuucgguaacacagcuguagcaaaaugcaacgaaaaacacgaugaagaauucugcgacaugcuaagauuauuugauuucaauaaacaagcaauccaacgauuaaaagcagaagcucaaauguccauacaacuaaucaauaaagcaguaaacgcuuuaaucaacgaccaacuuauaaugaaaaaccaccuacgagauauaaugggaauacccuauuguaauuacucaaaauacugguaccuaaaucacacuacaacagguaaaacaucuuuacccaaaugcugguuaguaucaaacggaagcuauuuaaaugaaacacacuuuucagacgacauagaacaacaagcagacaacaugauaacugaaaugcuucaaaaagaauacauggaaagacaaggaaaaacaccacuaggacugguugaccuauuuguauucucuacaagcuuuuaccuaauaucaaucuuucuccaucuaguaaaaauaccaacacacagacacaucguuggaaaaccauguccaaaaccccacagauuaaaucacaugggaauauguuccuguggucuauacaaacaaccaggagucuccgucaaauggaaaagauaa

SEQ ID NO: 2706 - RNA, 1476 nt, Artificial Sequence
  derived and/or modified CDS sequence (opt6) from Lassa virus__AIT17378__GPC
augggacaaauuguaacauucuuccaagaaguaccacacguaauagaagaaguaaugaacauaguccuaauagcucuaucaauauuagcuguacuuaaaggcuuauauaaccuagcaacaugcggccucgugggucuaguaaccuucuuacuacuaugcggaagaucauguacaacaucacucuacaaaggcguauaugaacuacaaaccuuagaauuaaacauggaaacccuaaacaugacaaugccacuaucauguacaaaaaauaacagccaucauuacauaaugguaggaaaugaaacaggcuuagaacuaacacuaacaaauacaucaauaauaaaccacaaauucugcaaucuaucagacgcacacaaaaaaaaccuauacgaccacacacuaaugucuaucauaucaacauuccaccuaucaauaccaaauuuuaaccaauaugaagcaaugagcugcgauuucaauggaggcaaaauaucaguacaauacaaccuaucacacucauacgcaguagacgcggccaaucacugcggaacaguagcaaacggaguacuacaaacauucaugagaauggcaugggguggcucauacauagcauuagacucuggaagaucaggcugggauugcauaaugaccucauaucaauaccuugucauacaaaauaccacuugggaagaucacugccaauucucuagaccaucaccaauaggcuaucuaggacuauuaucacaacgcacuagagacauauauauaucaagaagauuauuagguacauucacauggacauuaucagauucagaaggcaaaaauaccccaggaggcuacugccuaacccgauggaugcuaaucgaagcagaauuaaaauguuucggcaacaccgcagucgcaaaaugcaaugaaaaacaugacgaagaauucugcgauauguuacgacuauuugacuucaauaaacaagcaauccaacgacuaaaagcagaagcacaaaugucaauacaauuaauaaauaaagcaguaaaugcacuaauaaaugaccaacuuauaaugaaaaaucaccuaagagauauaauggguauaccauauugcaacuacuccaaauauugguacuuaaaucacaccacaaccggaagaacaucuuuacccagaugcuggcuaguaucaaauggaucauacuuaaaugaaacccacuuuucagacgacaucgaacaacaagcagacaauaugaucacagaaaugcuacaaaaagaauacauggaaagacaaggaaaaacaccauuaggucuuguagacuuauucguauucuccacaucauucuaccucaucucuauauucuuacacuuaguaaaaauaccaacacacagacacauaguaggcaaaagcugcccaaaaccacacagacuuaaccauaugggaauaugcagcuguggauucuacaaacaacccggaguaccuguaaaauggaaaagauaa

SEQ ID NO: 2707 - RNA, 1476 nt, Artificial Sequence
  derived and/or modified CDS sequence (opt6) from Lassa virus__AIT17388__GPC
augggacaaauaguaaccuucuuccaagaagucccccacguaauagaagaagucaugaauaucguauuaauagcacuaucaauauuagcuguacucaaaggacucuacaacgucgcuacaugugguuuaauaggcuuaguuacauuucucuuacuauguggacgaucaugcacaaccacacuauauaaaggaguauacgaacuacaagccuuagaacuaaacauggaaacauuaaauaugaccaugccauuaucaugcacaaaaaacaauucccaccacuauauaagaguaggaaacgaaaccggauuagaacuuacauuaacaaacacauccauaauuaaccauaaauuuugcaaucuaucagaugcccacaaaaaaaaucuauacgaccacgcccuaaugaguauaauauccacauuucacuuauccaucccuaacuucaaucaauaugaagccaugucaugcgauuuuaacggaggaaucauaucaguacaauauaauuuaucacacucauacgcaggagacgccgccaaccacugcggaacaguagccaacggaguacuucaaacauucaugagaauggcauggggaggauccuacauagcacuagacucaggcagaaacggaugggacugcauuaugaccucauaccaauaucucauuauacaaaacacaaccugggaugaccacugucaauucucacgcccaucaccaauaggauaucuaggacuacuaucacaaagaacaagagacaucuauauaucaagaagacuacuaggaaccuucacauggacacuaucagauucagaaggaaaagauacaccaggaggcuauugccuaaccagguggaugcuuauagaagcagaacuaaaauguuucggaaauaccgccguagcaaaaugcaacgaaaaacaugaugaagaauucugcgauaugcuaagacuauuugauuucaauaaacaagcaauacaaagacucaaaacugaagcucaaaugaacauacaauuaauaaacaaagcaguuaacgcacuaauaaacgaucaacucauaaugaaaaaucaccuaagagacauaaugggaauaccuuacugcaacuacagcaaauacugguaccuaaacaacaccgcuacaggaaaaacaucauuacccagaugcugguuaguaagcaacggcucuuaccuaaacgaaacucacuuuucagacgacauugaacaacaagcagacaacaugauaaccgaaaugcuccaaaaagaauacauggaacgacaaggaaaaacaccauuaggauuagucgaccuauucguauuuuccacgucauucuaccuaauaagcaucuuccuacaccucguaaaaaucccuacacauagacacauagucggcaaacccugcccaaaaccacaccgacuaaaucacauaggaauuugcuccugcggacuauauaaacaacccggcguaccaguaaaauggaaacgauaa

SEQ ID NO: 2708 - RNA, 1473 nt, Artificial Sequence
  derived and/or modified CDS sequence (opt6) from Lassa virus__AIT17404__GPC
augggacaaaucauaacauucuuccaagaaguaccacauguaauagaagaaguaaugaauaucguacuaaucgcacuaucacuacuagcaauacuaaaaggaauauacaacguagccacaugcggacuauuuggccuagucucauuucuacuacuaugcggaagaucuuguucaacuacauacaaaggaguuuacgaacuacaaacacuagaacucgacauggcaucacuaaacaugaccaugccauuaucaugcacuaaaaacaauucacaccauuacauaaugguaggaaacgaaacaggacuugaacuaacauuaacaaacacaucaauaauaaaucauaaauucugcaacuuauccgacgcacacaagaaaaacuuauacgaccaugcauuaaugaguauaauuucaaccuuccaccuaucuauaccuaacuucaaccaauacgaagcaauguccugcgacuuuaacggaggaaaaauaucaguacaauacaaccuaucacacgcauaugcaguugacgccgccaaucacugcggaacaauagcaaacggaguacuacaaacauucaugagaauggcauggggcggcucauacauagcacuagauuccggaaaaggaucaugggacugcaucaugacaucauaucaauacuuaauaauacaaaacacaacaugggaagaccacugccaauucucuagaccuaguccaauagguuaccucggacuccucucccaacgaacacgcgacauuuacauaucaagaagacuacuagggacauucacauggacauuaucagacucagaaggaaaugaaacaccaggaggauauugucucacaagauggauguuaauagaagcagaauuaaaaugcuucggcaacacugcagucgccaaaugcaaugaaaaacacgacgaagaauuuugcgauaugcuucgacuauucgauuucaacaaacaagcaauaagaagacuuaaaacagaagcacaaauguccauucagcuaauuaacaaagcaguaaacgcccuaaucaacgaccaacuaauaaugaaaaaccaucuacgagacauaaugggcaucccauacugcaacuacagcaaauauugguaucuaaaucacacaguaacagguaaaacaucacucccaagaugcuggcuaguaucuaauggaucauaccuaaacgaaacccacuucuccgacgacauagaacaacaagcagacaacaugauaacagaauuacuacaaaaagaauauauggaucgacaagguaaaaccccacuaggucuaguagaccuauucgucuuuucaacauccuucuauuuaauaucaauauuucuacaucucauaaaaauuccaacacacagacacauaacaggaaaaccaugucccaaaccacaccgacuuaaccacaugggaauaugcucaugcggacuauacaaacacccuggagucccaguaaaauggaaaagauaa

SEQ ID NO: 2709 - RNA, 1473 nt, Artificial Sequence
  derived and/or modified CDS sequence (opt6) from Lassa virus__AIT17408__GPC
augggucaaauaauaacauucuuucaagaaguaccucauguaauagaagaaguaaugaauauaguccucauagcacuaucacuccuagcuauauuaaaaggaauauauaacguagcaacaugcggacucuucggacuaguaucauucuuacuacuaugcggaagaucaugcucaacaacauauaaaggaguauacgaacuacaaacccuagaacuagauauggcaucauuaaacaugaccaugccacuauccugcacaaaaaacaacucacaccauuauauaaugguaggaaacgaaacaggauuagaacuaacacucacaaacaccucuaucauuaaccacaaauucugcaaccuaucagacgcucauaaaaaaaaucuauaugaucacgcacugaugucaauaauuucaacauuccaucuaucuauaccaaacuucaaucaauaugaagcaaugagcugugauuucaacggcggaaaaauaucuguacaauacaaccuaucacacacauacgcaguugacgcagcaaaucacugcggaacaguagccaauggcguacuccaaacguuuaugagaauggcauggggaggcucauauauagcacuagacucaggaaaaggaucaugggacugcaucaugacaucauaccaauaccuaauaauccaaaauaccacaugggaagaccacugccaauuuucaagaccaucaccaauaggcuaccuaggccuccuaucacaaagaacacgagacauauacauaucccgaagacuauuaggaacauucaccuggacacuaucagacucagaaggaaacgaaaccccaggaggauacugccuaacuagauggauguuaauagaagcagaacucaaaugcuucggaaauacugcaguagcaaaauguaaugaaaaacaugacgaagaauucugcgacauguuaagacuauucgacuucaacaaacaagcaauaagaagacucaaaaccgaagcccaaaugucaauacaacucauaaacaaagcugucaacgcacuuauaaacgaccaacuaauaaugaaaaaucacuuaagagacauuaugggaauaccauacuguaauuacucaaaauacugguaccucaaccacacagucacaggaaaaacuucacuaccacgaugcugguuagucucaaacggaucauaccugaaugaaacacauuuuucagaugauauagaacaacaagcugauaacaugauaacagaacuacuacaaaaagaauacauggacagacaaggaaaaacacccuuaggcuuaguagaucuauuuguuuucuccacuuccuucuauuuaauauccauauuccuacauuuagucaaaauaccaacacacagacauguuauaggaaaaccaugcccaaaaccacacagacuuaaucacaugggaaucugcuccugcggucucuacaaacacccuggaguaccaguaaaauggaaaagauaa

SEQ ID NO: 2710 - RNA, 1473 nt, Artificial Sequence
  derived and/or modified CDS sequence (opt6) from Lassa virus__AIT17412__GPC
augggacaaaucauaacauucuuucaagaaguaccccacguaaucgaagaaguuaugaauauaguacuaauugcauuaucacuacuagcaauacuaaaaggaauauacaauguugcaacuugcggacuauucggacuaguuucauuccuauuacuaugcgguagaagcugcuccacuacauauaaaggagucuacgaacuacaaacauuagaauuagauauggcaucacuuaacaugaccaugccacucucaugcacaaaaaauaauucacaccacuacauaauggucggcaaugaaacaggacuagaauuaacauuaacaaacacuucuauaaucaaccacaaauuuugcaaccuaucagacgcccacaaaaaaaaucuauacgaucaugcacuaaugucaauaauuagcacauuccaucuaucaauaccuaacuuuaaucaauaugaagcaaugucaugugacuuuaacggaggcaaaaucucaguacaauacaacuuaucacaugcauacgcuguagacgcagcaaaccauugcggaacuauagcaaacggaguauuacaaacuuucaugagaauggcauggggaggaucauacaucgcacuagacaguggcaaaggaucaugggacuguaucaugacaucauaccaauaccuaauaauccaaaauaccuccugggaagaccacugccaauucucaagaccaucccccauagguuaccuaggacuauuaucacaaagaacaagagauauauacauaucaagaagacuauuaggaacauuuacauggacauuaagugacagugaagguaacgaaacaccaggaggauauuguuuaacaagauggaugcuaauagaagcagaacuaaaauguuuuggaaacacagccguagccaaaugcaacgaaaaacacgaugaagaauuuugugacauguuaagacuauucgacuucaacaaacaagcaauaagaagauuaaaaacugaagcacaaaugucaauacaacuaauaaacaaagcaguaaacgcuuuaaucaacgaccaacugauaaugaaaaaucaccucagagacauaaugggaauaccauacugcaacuauaguaaauacugguaccuaaaucacacaguaaccggaaaaacaucacuaccaagauguuggcucguaucaaauggcucuuaucuaaacgaaacacacuucucugacgacauugaacaacaagcagacaacaugauaacagaacucuuacaaaaagaauauauagauagacaaggaaaaacaccacuaggccuaguagaccuauuuguauucucuaccucauucuacuuaauaucaauauuucuucaccucguuaaaauaccaacacauagacacguaauaggaaaaccaugcccaaaaccacacagacuaaaccacaugggcauauguucaugcggcuuauacaaacauccaggcgucccugucaaauggaaacgauaa

SEQ ID NO: 2711 - RNA, 1473 nt, Artificial Sequence
  derived and/or modified CDS sequence (opt6) from Lassa virus__AIT17416__GPC
augggacaaauaaucacauucuuucaagaaguaccucauguuauagaagaaguaaugaacauaguacuaaucgcacuaucauugcuagcaauauuaaaaggaauauauaacguugcuacauguggcuuauucggauuaguuagcuuccuacuccuauguggaagaucaugcagcacaacauacaaaggaguauacgaauuacaaaccuuagaacuugacauggccaguuuaaacaugaccaugccauuaucauguacaaaaaauaauucacaucauuacauaaugguaggaaaugaaaccggccuagaacuaacauuaacaaacacauccauaauuaaccauaaauucugcaaccucucagacgcacacagaaaaaaucuauacgaccacgcauuaaugucaauaauaagcacauuccauuuaagcauaccaaacuucaaccaauacgaagcaaugucaugcgacuucaacggcggaaaaauaucaguacaauauaacuuaucacaugcuuacgcaguagacgcagcaaaccacugcggaacaauagcaaauggaguacuccaaacauuuaugcgaauggcauggggaggcucauacauagcacuagacuccggaaaaggauccugggauugcauaaugacaucauaucaauauuuaaucauacaaaacacaucaugggaagaucauugccaauuuuccagaccaucaccaauuggcuacuuaggccuucuuucacaaagaacaagagacauauacaucucaagaagacuacuaggaacauucaccuggacauuaucugauagugaaggaaacgaaacaccaggaggcuacuguuuaacacgauggaugcucauagaagcagaauuaaaaugcuucggaaacacagcagucgcaaaaugcaacgaaaaacacgacgaagaauucugugacaugcuaagacuauucgauuucaacaaacaagcuauacgaagacuaaaaacagaagcucaaaugucaauucaauuaaucaauaaagcaguaaaugcacucauuaaugaccaacuaauaaugaaaaaucaccuuagagacaucaugggaauuccauacugcaacuauucaaaauacugguacuuaaaccacacaguuacaggcaaaaccucacuaccaagauguuggcuaguauccaacggaucauaucuuaaugaaacacauuucucagacgacauagaacaacaagcagacaacaugauaacagaauuauuacaaaaagaauacauagaucgacaaggcaaaacaccacuaggacuaguagaccuauucguauucucaacaucauucuacuuaaucucaauauuucuccacuuaguaaaaauacccacacaucgacacgucauaggaaaaccaugcccaaaaccacacagacuuaaccacaugggaauauguucaugcggacuauauaaacacccaggaguuccaguaaaauggaaacguuaa

SEQ ID NO: 2712 - RNA, 1473 nt, Artificial Sequence
  derived and/or modified CDS sequence (opt6) from Lassa virus__AIT17420__GPC
augggccagauaaucacuuucuuccaagaaguaccccacguaauagaagaaguuaugaacauagucuuaauagcccucucacuccuagcaauacuaaaaggcauauauaauguagcaacauguggauuauuuggccuaguaucuuuucuauuauuaugcggaagauccugcucaacaacauacaaaggaguauacgaacuacaaaccuuagaacuagauauggcaucacuaaauaugacuaugccauuaucauguaccaaaaacaacucccaccauuacauaaugguaggaaacgaaacaggacuagaacuaacacuaacaaacacaucaauaauaaaccacaaauucugcaaucuaagcgacgcccauaagaaaaaccuuuaugaccacgcacuaaugucaauaauaucaacuuuccauuuaucaauaccuaauuucaaccaauaugaagcaauguccugcgacuuuaacggaggcaaaauaucaguccaauacaaucucucccauacauacgccgucgaugccgcaaaccauugcggaacaauagcuaacgguguccuucaaacauuuaugcgaauggcauggggaggaucuuacauagcacuagauagcggaaaagguucaugggacugcauaaugaccucauaucaauaccuuauuauacaaaacaccacaugggaagaccauugccaauuuucaagaccaucaccaaucggauaccuaggacuauuaucacaaagaaccagagacauauacaucaguagaagacuacuuggcaccuucacuuggacacuaucagauucagaaggaaacgaaacaccaggaggauacugccuaacaagauggaugcuaauagaagcagaauuaaaaugcuuugguaacaccgcaguagcaaaaugcaacgaaaaacacgacgaagaauuuugcgacauguuaagauuauuugacuuuaacaaacaagcaauaagaagacuuaaaacugaagcacaaaugucaauucaacuaauaaacaaagcaguaaacgccuuaauaaacgaucaacuuauaaugaaaaaccaucuaagagacauaaugggcauaccauacugcaacuacucaaaauacugguaucuaaaucauaccguaacaggcaaaaccucacuaccaagaugcuggcuaguauccaauggaucuuauuuaaacgaaacacacuucuccgaugacauagaacaacaagcagauaauaugauaaccgaauuauuacaaaaagaauauauggauagacaaggaaaaacaccacuugguuuagucgaucuauuuguauucucaacauccuuuuaccuaauaucaauauuuuuacacuuaauaaaaauacccacacacagacacauaaccggaaaacccugcccaaaaccacacagauuaaaucacaugggaauauguucaugcggacuauacaagcacccaggcgucccaguaaaauggaaacgcuaa

SEQ ID NO: 2713 - RNA, 1473 nt, Artificial Sequence
  derived and/or modified CDS sequence (opt6) from Lassa virus__AIT17424__GPC
augggccaaauaauaacauuuuuucaggaaguaccacacguaauagaagaagucaugaauauaguacuaauagcuuuaagccuacuagccauauuaaaaggaauauauaauguagcaacaugcggacuauucggauuaguauccuuccuacuacuaugcggcagaucaugcucuacaaccuacaaaggcguauacgaacuacagacauuagaacuagacaugacaaaucuaaacaugacaaugccccuaucaugcacaaaaaacaacucacaccacuauauaaugguaggaaacgaaacaggcuuagaacuuacauuaaccaacacaucuauaauaaaccacaaauuuugcaacuuauccgacgcccauaaaaaaaaccuauauaaccacgcacuaauguccauaauaucuacauuccaccucuccauccccaacuucaaccaauacgaagcaaugucuugcgacuucaacggaggcaaaauaucaguacaauacaauuuaucacacgcauaugcaguagacgcagcaaaccauugcggaacaaucgcaaacggaguacuacaaacauucaugcgaauggcaugggguggauccuacaucgcauuagauucagguaaaggaucaugggacugcauaaugacaagcuaccaauauuuaaucauacaaaacacaacaugggaagaucauugucaauucagcagaccauccccaauuggauacuuaggcuuauuaucacaaagaacaagagacaucuauauaucuagaagauuauuaggaacauucacauggacccuaucagacucugaaggcaacgaaacaccuggaggcuacugucucacacgcuggaugcuaauagaagcagaacuaaaaugcuucggaaauacagcaguagcaaaauguaacgaaaaacaugacgaagaauuuugcgacaugcuucgauuauucgacuucaauaaacaagcaauaagaagauuaaaaacagaagcccaaacaaacauacaacuaauuaauaaagcaguaaaugcauuaauaaacgaccaauuaauaaugaaaaaccaucuaagagacauaaugggaauaccauacugcaacuacucuaaauacugguaccuaaaccauacaguaacaggaaaaacaucccuacccagaugcuggcucguaucaaacggcaguuaccuaaaugaaacccacuucucagacgacauagaacaacaagcagacaacaugauaacagaauuauuacaaaaagaauacauggaucgucaaggcaaaaccccucucggacuuguagauuuauuuguauuuucaacaucauucuaucucauaucaauauuccuacacuuaguaaaaauacccacacacagacacaucauagguaaacccuguccuaaaccccacagacuaaaccauaugggcaucugcucaugcggacuauacaaacacccuggaguuccaguaaaauggaaaagauaa

SEQ ID NO: 2714 - RNA, 1473 nt, Artificial Sequence
  derived and/or modified CDS sequence (opt6) from Lassa virus__AIT17428__GPC
augggucaaaucauuacauucuuccaagaaguaccacacgucauagaagaaguaaugaacauaguacuaauagcauuaucacuacuagcaauauuaaaaggaauauauaacguagcaacuuguggccuauucggauuaguaaguuuuuuacuacucugcggaagaucuugcucaaccacuuauaaaggcgucuaugaauuacaaacauuagaacuagacauggcaucccuaaacaugacaaugcccuuauccugcacaaaaaacaauagccaccacuacauaauggucggaaaugaaacaggcuuagaacuaacacucacaaacacaucaauaaucaaccacaaauucugcaacuuaucagacgcccacaaaaaaaacuuauacgaccaugcacuaaugucaauaauaucaacauuucaccucucaauaccaaacuucaaccaauacgaagcaaugucaugugauuucaacggaggaaaaauaucaguacaauauaaccucucucacacuuacgccgucgacgcagcaaaucacugcggcacuauagcaaauggaguauuacaaacauuuaugagaauggcauggggaggaucuuauaucgcacuagacucaggaaaaggaucaugggacuguauaaugacuuccuaucaauaccuaauaauacaaaacacaacaugggaagaucacugccaauucucuagaccaucaccaauaggauauuuaggauuauuaagccaaagaaccagagacauauacauauccagaagauuauuaggcacuuucacauggaccuuaucugacucagaaggcaacgaaacuccaggcggauacuguuuaacuagauggauguuaauagcagcagacuuaaaaugcuuuggcaacacagccguagcaaaaugcaacgaaaaacacgaugaagaauuuugcgacauguuaagauuauucgauuucaauaaacaagcaaucgaacgcuuaaaaacagaagcacaaaugucaauucaacucauaaacaaagccguuaacgcccuaauaaacgaccaacuaaucaugaaaaaccacuuaagagauauaaugggcauaccauauugcaacuacuccaaauacugguauuuaaaucacacaguaaccggacgaaccagccuuccaagauguugguuaguaucaaacggcucuuaucuaaaugaaacacacuucucagacgacauagaacaacaagcagacaacaugauaacagaacuauuacaaaaagaauacauggacagacaaggaaaaaccccacuaggccuaguagaccucuuuguauuuucaaccucauucuaucuaauauccauauucuuacauuuaguacguaucccaacucauagacauguaauaggaaaaccaugcccaaaaccccaccgauuaaaccauaugggaauaugcuccugcggacuauacaaacacccaggaguccccguuaaauggaaacgauaa

SEQ ID NO: 2715 - RNA, 1473 nt, Artificial Sequence
  derived and/or modified CDS sequence (opt6) from Lassa virus__AIT17430__GPC
augggacaaauaaucacauucuuucaagaagucccacaugucauagaagaagucaugaacauaguauuaauagcccuaucuuuacuagcaauuuuaaaaggaaucuauaacgucgcuacuugcggacuauucggccuaguaucauuucuguuauuauguggaagaucaugcucaacaacauacaaaggcguauacgaauuacaaacacucgaacuagacauggcuuccuuaaauaugacaaugccucuauccugcacaaaaaacaauucacaccacuacauaauggucggaaacgaaacuggacuagaacucacacucacaaacacaucuauuauuaaccacaaauucuguaaccuaucagacgcacacaaaaaaaauuuauaugaccaugcacucaugucaauuauaucaacuuuucacuuaucuauaccaaacuucaaccaauacgaagcaauguccugugauuucaauggcggaagaaucucaguccaauauaacuuaucccacacauacgcaguugaugcagcaaaacauugcggaacaauagcaaauggcguucuccaaacauuuaugagaauggcaugggguggaucauacauagcacuagacucagguaaaggaucaugggacugcauuaugacaucauaccaauaccucauuauacaaaacacaacaugggaagaccacugccaauuuuccagaccaucuccaauagguuaucuaggucuacuaucccaacgaacccgagacauauauauaucucgcagacuacuaggaacauucaccuggacacuaucagacuccgaagguaacgaaaccccaggaggauacugcuuaacccgauggauguuaauagaagcagaacuaaaaugcuucggaaacacugcaguagcaaaaugcaacgaaaaacaugacgaagaauucugcgacaugcuaagacuauucgacuuuaauaaacaagcaauuagacgacucaaaacagaagcacaaaugucaauacaacuaaucaacaaagcuguaaacgcacuaauaaacgaccaauuaauaaugaaaaaccacuuacgcgauauaaugggaauccccuacuguaauuauuccaaauauugguaccuaaaccacaccguaaccggaaaaaccucuuuaccaagauguuggcuaguaucaaacggaucauauuuaaacgaaacacacuucucagacgacauagaacaacaagcugacaauaugauaaccgaacuauuacaaaaagaauacaucgaccgacaaggcaaaaccccacucggacucguugauuuauucguauuuucaaccucuuuuuauuuaaucucaauauuccuacaucucguaaaaauuccaacacauagacacguaauaggaaaaccaugccccaaaccacaccgacuuaaccauaugggaauaugcucaugcggacuauauaaacacccaggcguuccaguaaaauggaaaagauaa

SEQ ID NO: 2716 - RNA, 1473 nt, Artificial Sequence
  derived and/or modified CDS sequence (opt6) from Lassa virus__AIT17438__GPC
augggccaaauaauuacuuucuuccaagaaguaccacacgucauugaagaaguaaugaacauaguacuaauagcauuaucauuauuagccauccuaaaagguauauauaacguagcaaccuguggacuauucggacuaguuucauuccuacuacuauguggacgaucaugcucuacaacuuauaaaggaguuuaugaacuacaaacacuagaacuugauauggcaaaccuuaacaugacuaugcccuuauccugcacaaaaaauaacucacaccacuacauaagagucggaaacgaaacaggacuagaauuaacacucacaaacaccuccauaauuucacacaaauuuugcaaccuaucagacgcacauaaaaaaaaccuauaugaucacgcauuaaugucaauaauaucaacauuccacuuaucuauaccaaacuucaaccaauacgaagcuauguccugugauuucaacggaggaaaaaucuccguacaauacaaccucucacauacauacgcuguagacgcagcaaaccauuguggaacaaucgcaaacggaguauuacaaacauuuaugcguauggcauggggaggaucuuauauagcacuagacucuggcaaagguucaugggacugcauaaugacauccuaucaauaucuaauuauacaaaacacaacuugggaagaccacugccaauucucccgacccuccccaauuggauauuuaggacuacuaucacaaagaacuagagacauauacaucucacgacgccuccuaggaacauuuaccuggacacuaagcgacucugaaggaaaagaaacaccaggaggauacugucuaacaagauggauguuaaucgaagcagaacuaaaaugcuucggaaauaccgcagucgccaaaugcaacgaaaaacacgaugaagaauucugcgauauguuaagauuauucgauuucaauaaacaagcaauaagaagacuaaaaacagaagcccaaaugaacauacaacuuauaaacaaagcuguuaacgcacuaauaaacgaccaacuaauaaugaaaaaccaucuccgugauauaauggguauaccguauuguaacuauucuaaauacugguaccuaaaccauaccguaacaggaaaaaccucauuaccaagaugcuggcuaguaucuaacgguucauacuuaaaugaaacacacuuuucagaugacauagaacaacaagcagauaacaugauaacagaauuacuacaaaaagaauauauugaccgccaaggaaaaacaccacuaggauuagucgacuuauucgucuucucaacaagcuuuuaccuaauaucaauauuccuacacuuaguaaaaauaccaacacaucgccauguaaucggaaaacccugcccuaaaccccacagacuaaaccaaaugggcauaugcuccugcgguuuauauaaacaaccaggcguucccguaaaauggaaaagauaa

SEQ ID NO: 2717 - RNA, 1473 nt, Artificial Sequence
  derived and/or modified CDS sequence (opt6) from Lassa virus__AIT17442__GPC
augggacaaauaauaacauucuuccaagaaguaccucacguaauagaagaaguuaugaauauaguuuuaaucgcacuaucacuccuagccauauuaaaaggcauauacaacguagccacaugcggacuauucggucuaguaucauuccuacuacuuugcggaagaucauguuccaccacauacaaaggaguauacgaauuacaaacacuagaauuagacauggcaucacucaacaugacaaugccccuuucauguacuaaaaauaacucacaucauuacauuaugguagguaacgaaacaggacuagaacuaacacuaacaaacacauccauaaucaaccacaaauucugcaaccuaucugacgcacaccgcaaaaacuuauaugaucacgcacuaaugucuauaaucucaacauuccaccuaucuauaccaaacuucaaccaauacgaagcuauguccugcgacuucaaugguggaaaaauaucuguacaauacaaucuaucccacgccuaugcaguagacgcagcaaaccacugcggaacaauagcaaacggaguccuacaaacauucaugagaauggccuggggcgguucuuacaucgcauuagauuccgguaaaggcucaugggacugcaucaugaccuccuaccaauaccuaaucauccaaaacacaucuugggaagaucacugucaauucucaagacccucccccauaggauauuuaggccuuuuaucucaaagaacaagagacaucuauauaucccgcagacuacuaggcacauuuacuuggacccuaucagacucugaaggaaaugaaacaccagguggauacugucuaacuagauggaugcuuauagaagcagaacuaaaaugcuucggaaauacagccgucgccaaaugcaacgaaaaacacgacgaagaauuuugugauauguuaagacuauucgacuucaacaaacaagcaauacgaagacuaaaaacugaagcacaaaugucaauacaacuaauaaauaaagcaguuaacgcacuaauaaacgaucaauuaauaaugaaaaaccacuuaagagacauaaugggcauccccuacugcaauuacucuaaauacugguauuuaaaccacacagucacaggaaaaacaucauuaccaagaugcuggcuaguaucaaacgguucauaccuaaaugaaacccacuucucagacgauauagaacaacaagcugauaauaugauaacugaacuacuacaaaaagaauacauagauagacaaggaaaaacuccuuuaggucuaguagaccuauucguauucucaacaucauuuuaccucauaucuauauucuuacaucuagucaaaauacccacacacagacacguuauaggaaaacccugucccaaaccacaccgaaucaaccacaugggaauaugcucaugcggacuauacaaacacccaggugucccaguaaaauggaaaagauaa

SEQ ID NO: 2718 - RNA, 1473 nt, Artificial Sequence
  derived and/or modified CDS sequence (opt6) from Lassa virus__AIT17446__GPC
augggacaaauaauaacauucuuccaagaaguaccucacguaaucgaagaaguaaugaacauaguacuaauagcauuaucauuacuagcaaucuuaaaaggaauauacaacguagcaacauguggacuguucggucuaguauccuuuuuauuacuauguggcagauccuguucaacaaccuauaaaggaguauacgaacuucaaacauuagaacuagacauggcuucauuaaacaugacaaugccacuaucaugcacuaaaaacaacucacaccauuacaucaugguaggaaaugaaaccggauuagaacucacacuaacaaacacaaguauuauaaaccauaaauucuguaaccuaucagacgcacacaagaaaaaccuauaugaccacgcacuuaugucaauaauaucuacauuucacuuaucaaucccaaacuucaaccaauacgaagcaaugucaugcgacuuuaacggaggaaaaauaucaguacaauauaaccucucacacaccuacgcagucgacgcagcuucacacuguggaacaguagcaaauggcguacuucaaacuuucaugcgaauggcauggggagguucuuacauagcacuagacucaggaaaaggaucaugggauuguaucaugacaucauaucaauaccuuauuauacaaaauacaacaugggaagaccacugucaauucucaagacccucccccauaggcuaucuaggacuacuaucccaaagaacacgagauauauacauaucccgaagacuacuaggaacauucacauggacccugucagauucagaaggaaacgaaacaccaggaggauauugcuuaacacgauggaugcucauagaagcagaacuaaaaugcuucggaaacacagcaguugcaaaaugcaacgaaaaacacgacgaagaauuuugcgacauguuaagacuauucgauuuuaauaaacaagcaauaagaagguuaaaaacagaagcacaaaugagcauacaauuaauuaauaaagcaguaaaugcauuaauaaacgaccaacuaauuaugaaaaaccaccuaagagacauaaugggcauuccauacugcaacuacucaaaauauugguacuuaaaucacacagucacaggaaaaacaucccuuccaagauguugguuagucucaaacggaucauaccuaaaugaaacccacuuuucagacgauauagaacaacaagcagacaacaugauuacugaacuacuacaaaaagaauauauggaccgacaaggaaaaacaccauuaggccuagucgaucuauucguauucucaacaucuuucuaccugauaucaauauucuuacaccuaguaaaaauacccacgcaccgacacguaauaggaaaaccuugcccaaaaccucacagacuaaaccacaugggaauauguucaugcggacuauacaaacaucccggaguaccuguuaaauggaaacgauaa

SEQ ID NO: 2719 - RNA, 1473 nt, Artificial Sequence
  derived and/or modified CDS sequence (opt6) from Lassa virus__AIT17450__GPC
augggacaaaucauaacauucuuccaagaaguaccacacguaauagaagaaguaaugaacaucguucuaauagcauuaucauuacuagccauacucaaaggaauuuauaacguagccacaugcgguuuauuuggacuuguauccuuuuuacuacuaugcggaagaucauguucaacaacauacaaaggugucuaugaacuacaaacacuugaauuagacauggcaucauuaaacaugacaaugccccuaucaugcacaaaaaacaacucacaccacuauaucauggucggaaacgaaacaggacuagaacuaacccuuaccaacacaucaauaauaaaucauaaauuuugcaacuuauccgacgcucauaaaaaaaaccuauacgaucacgcacuaaugucaauaaucucaacauuccacuuaucaauaccaaauuuuaaccaauacgaagcuaugucaugcgacuucaacggcggaaaaauaucaguacaauacaaccuaucacacacauacgcaguagacgcugcaaaccacugcggaacaaucgcaaauggaguauuacaaaccuucaugcgaauggcauggggaggaucauauauagcauuagauucuggaaaaggaucaugggauugcauaaugacauccuaccaauaccuuauaauccaaaacacaacaugggaagaccauugucaauuuucacgacccucaccaauuggcuacuuaggacuauuaucccaacgaacacgagacauauacauaucacgaagacuacucggaacuuucacauggacacucucagacucagaaggcaacgaaacaccaggaggauauugcuuaacccgcuggauguuaauagaagccgaacuaaaaugcuucgguaacaccgcaguagccaaaugcaaugaaaaacacgaugaagaauucugcgauaugcuaagacuauuugacuuuaauaaacaagcuaucagacgacuaaaaacagaagcacaaauguccauacaacucauaaacaaagcaguaaacgcauuaaucaacgaccaacuaaucaugaaaaaccaucuaagagacauaaugggaauacccuauugcaacuacucaaaauauugguaccuaaaccacacaguaaccgguaaaacuucauuaccucguugcuggcucgucucuaacggaucauaccuaaacgaaacacacuucucagacgacaucgaacaacaagcagacaacaugauaacagaacuacuacaaaaagaauacauagacagacaaggcaaaaccccacuaggacuaguugauuuauucguuuuuucaacaucauuuuacuuaauauccauuuuccuacaccuagucaaaauaccaacucacagacacauaaucggaaaaccaugcccaaaaccacauagacuaaaccacaugggcaucugcucaugcggauuauauaaacaccccggaguuccaguaaaauggaaacgauaa

SEQ ID NO: 2720 - RNA, 1473 nt, Artificial Sequence
  derived and/or modified CDS sequence (opt6) from Lassa virus__AIT17454__GPC
augggacaaauaauaacuuucuuccaagaaguaccacacgucauagaagaaguaaugaauaucguacuaaucgcauuuucucuccuagcaauacucaaagguauauacaacgucgcaacaugcggcuuauuuggccuaguaucauucuuacuacuaugcggacgaucauguucaacaaccuacaaaggaguauacgaacuacaaacauuagaacuagauauggcaucauuaaauaugacaaugccauuaucaugcacuaaaaacaacagccaucauuacaucaugguaggaaaugaaacagguuuagaacuaacacuaacaaacacaucaauaauaaaccacaaauucuguaaccuaucugaugcacacaaaagaaaucuauacgaucacgcacuaaugucaauuauaucaacauuucauuuaucuauaccaaacuuuaaccaauacgaagcaaugucaugcgacuucaauggaggaaaaauaucaguacaauacaauuuaucucacacauacgccgucgacgcagccgggcauugcggaacaauagcaaacggaguauuacaaacauucaugagaauggcauggggcggaucauacauagcacuagauuccggaaaaggaucaugggauuguaucaugacaucauaccaauaccuuauaauacaaaauacaacaugggaagaccacugucaauucuccagaccaucuccaauaggauacuuaggucuucuaucacaaagaacaagagacauauacauuuccagaagacugcuaggaaccuuuacauggacccuuucugacagugaaggcaaugaaaccccaggaggauauugccuaacaagauggauguuaauagaagcugaacuaaaaugcuucggcaacaccgcaguagcaaaauguaacgaaaaacaugaugaagaauuuugcgacaugcuaagauuauucgauuucaacaaacaagcaauaagaagacuaaaaacagaagcacaaaugucaauacaacuaauaaauaaagcaguaaacgcacuaauaaacgaucaacuaauaaugaaaaaccacuuaagagacauaaugggaauaccguacugcaauuacucaaaauauugguaucucaaccacacaaucacuggaaaaacauccuuaccaagaugcugguuaguaucaaacggaucauaucuaaacgaaacacauuucuccgacgauauagaacaacaagccgauaacaugauaaccgaauuacuccaaaaagaauacauggaccgacaaggaaaaacaccacuaggucuaguugacuuauucguauucucuacaucauucuaucuuauaucuauauuccuacaccuaguaaaaauaccuacacacagacacauaauaggaaaaccaugcccaaaaccucauagacuaaaccauaugggaaucuguucaugcggccuauauaaacauccaggaguaccaguaagauggaaacgauaa

SEQ ID NO: 2721 - RNA, 1473 nt, Artificial Sequence
  derived and/or modified CDS sequence (opt6) from Lassa virus__AIT17458__GPC
augggacaaauaaucacauucuuucaagaagucccacacguuaucgaagaaguaaugaacauaguccuuaucgcccucucucuauuagcaauccuaaaaggcauauacaacguagcgaccugcggccuauucggacuaguaucauuccuauuacuauguggaagauccugcuccacaacauacaaaggaguauacgaacuccaaacacuagaauuagacauggccucauuaaacaugaccaugccauuaagcugcacaaaaaacaacucacaccauuacauaaugguaggaaaugaaacaggccuagaacuaacauuaacaaacaccucaaucauaaaccacaaauuuuguaaccucucugaugcacauaaaaaaaaucuauaugaucaugcacuaaugucaauaauaucaacauuccaucuaucuauaccaaauuuuaaucaauacgaagcaauguccugcgauuucaacggcggaaaaauaucaguacaauacaacuuaucacacacauacgcaauagaugccgcuaaccauuguggaacaauagcaaacggaguccuacaaaccuuuaugcgcauggcauggggcggcucauauauagcuuuagacuccggaaaaggaucaugggacugcauaaugacaacauaccaauacuuaaucauacaaaacacaacaugggaagaccacugccaauuuagcagaccaaguccaauaggauacuuaggacuauuaucucaacgcacaagagacauauacauaucaaggagacuacuaggcaccuuuacauggacacuaucagacucagaaggaaaugaaacacccggcggauacugccuuacacgauggaugcuaauagaagcagaacuaaaaugcuucggcaacacagcaguagcaaaaugcaaugaaaaacacgacgaagaauuuugugacaugcuaagacuguuugacuucaacaaacaagcaauacgacgcuuaaaaacagaagcccaaaugagcauacaacuaauaaauaaagcaguaaacgcacuaauaaacgaccaauuaauaaugaaaaaccaccuccgagacauaauggguauaccauauugcaauuacagcaaauauugguaucuaaaccauacaguaacaggaaaaacuucacuaccaagauguugguuaguuuccaacggaucauaccuaaacgaaacacacuucucagaugacauagaacaacaagcagacaauaugauaacagaacuacuucaaaaagaauauauggaccgacaaggaaaaacaccacuaggauuaguagacuuauucguauucucaacaucauuuuaccuaauaucaauauuccuacaucuaguaaaaauaccaacucacagacacguaauaggaaaaccaugcccaaaaccucaccgacuuaaccacauggguaucugcucaugcggacuauauaaacaccccggaguaccagucaaauggaaacgauaa

SEQ ID NO: 2722 - RNA, 1473 nt, Artificial Sequence
  derived and/or modified CDS sequence (opt6) from Lassa virus__AIT17462__GPC
augggacaaauaauaaccuucuuccaagaaguaccacacguaauagaagaaguaaugaacauagucuuaauugcacuaagccuacuagccauauuaaaaggaaucuauaacgucgccacaugcggucucuucggucuaguaucauuucuauuauuaugcggaagauccuguucaacaacauacaaaggagucuacgaauuacaaacacuagaacuagacauggcaucacuuaacaugacaaugccacuaucaugcaccaaaaauaacagucaucauuacauaauggucggaaaugaaacaggauuagaauuaacauuaaccaacacuucuauaauaaaccacaaauuuugcaaccuaucagacgcccacaagaaaaaccuauaugaucacgcauuaaugucaauaauaaguaccuuccauuuaucaauccccaauuucaaccaauaugaagcaaugucaugcgacuuuaauggaggcaaaaucucaguacaauacaaccucucccaugcauacgcaguagacgccgcaaaccauugcggcacaauagcaaacggaguacuacaaaccuucaugcgcauggcauggggcggaucauacauagcauuagacucaggcaaaggauccugggauugcauaaugacaagcuaccaauaucuaauaauccaaaauacuacaugggaagaccacugccaauuuucaagaccaagcccuaucggcuaccuaggauuacucucacaacgaacacgcgacauuuauauaucucgaagacuacuaggcacauucacauggacacuaucagacucagaaggaaacgaaacaccaggaggcuacugucuaacaagauggauguuaauagaagcagaauuaaaaugcuuugguaacacagcagucgcaaaaugcaaugaaaaacacgacgaagaauuuugcgacaugcuaagauuauucgacuucaacaaacaagcaaucagaagacuaaaaacugaagcacaaauguccauacaacuaauaaacaaagcaguaaaugcauuaauuaacgaucaauuaauaaugaaaaaccacuuaagagacauaaugggaaucccauauugcaauuacucaaaauacugguaccuaaaccauaccguaacaggcaaaaccucucuacccaaaugcuggcucguuucaaacggaucauauuuaaacgaaacacacuucucugacgacauagaacaacaagcagauaacaugauuacagaauuacuacaaaaagaauauauagauagacaaggaaaaaccccacuaggccuaguugaccucuucguauucuccacauccuucuaccuuauuuccauauucuuacauuuaguaaaaauaccaacacaucgacauguuauaggaaaaccaugcccaaaaccacacagauuaaaucacaugggaauauguucuuguggacuauauaaacacccaggaguaccagucaaauggaaacguuaa

SEQ ID NO: 2723 - RNA, 1473 nt, Artificial Sequence
  derived and/or modified CDS sequence (opt6) from Lassa virus__AIT17466__GPC
augggccaaauaauaacauuuuuccaagaagucccacaaguuauugaagaaguuaugaacaucguucuaauagcacuaucauuauuagcaauauuaaaaggcauauacaaugucgcaaccugcggacucuucggauuaguaucauuuuuacuacuaugcggaagaucaugcucaaccacauacaaaggcguauacgaacuacaaacacuagaauuagacauggccuccuuaaauaugaccaugccucucucuugcaccaaaaauaacucccaccacuacauaaugguuggaaacgaaacaggauuagaauuaacacuaacaaaccaaucaauaauaaaccacaaauucugcaauuuaagcgacgcacauaaaaaaaacuuauaugaucacgcccuaaugucuaucauaucuacauuccaccuaucaauaccaaacuucaaccaauacgaagcaaugucaugcgacuucaacggugguaaaauuucaguucaauauaaccucucacacacauucgcaguagacgcagcaaaccacugcggcacaauugcaaauggaguauuacaaaccuuuaugagaauggcauggggcggcucauauaucgcauuagauuccggcagaggaagcugggacugcauaaugacaucauaccaauaccuaauaauacaaaacacuacaugggaagaucacugccaauucucacguccuucacccauaggcuaccuaggauuacuaagccaaagaacccgagacauauacauaucaagacgacuucuuggaacauuuaccuggacauuauccgacucagaaggaaaugaaaccccaggaggcuauugcuuaacuagauggaugcuaauugaagcagaauuaaaauguuucgguaauacagcaguagcaaaaugcaacgaaaaacaugacgaagaauucugugacaugcuaagacuauuugauuucaacaaacaagcaauaagaagguuaaaaacagaagcccaaauguccauacaacucauaaauaaagccguuaaugcacuaauaaacgaucaauuaauaaugaaaaaccacuuaagagauauaaugggaauacccuacugcaacuacucaaaauacugguaucuaaaucacaccauaacaggaaaaaccucacuaccaagaugcugguuaguauccaacggcucauaccucaacgaaacccacuucucagacgacauugaacaacaagcugacaacaugauaacagaauuacuccaaaaagaauacauggaccgucaaggaaaaacaccauuaggacuaguagaccucuuuguuuucucaacaucauuuuaccuaauaucaauauuucuacaucuaguaaaaaucccaacacaucgacauguaaucggaaaaccuuguccaaaaccacauagauuaaaccauaugggcauaugcuccugcggcuuauacaaacaccccggaguuccaguaaaauggaaacgauaa

SEQ ID NO: 2724 - RNA, 1473 nt, Artificial Sequence
  derived and/or modified CDS sequence (opt6) from Lassa virus__AIT17470__GPC
augggccaaauaauuaccuuuuuccaagaaguaccacacguuauagaagaagucaugaauauaguauuaauagcauuaucccuacuugccauacuaaaaggaauauauaacguugcaacaugcggacuauuuggccuaguaucauuccuuuuacuaugcggaagaucaugcucaacaacauacaaaggaguuuacgaauuacaaacucucgaacuagauauggcaucauuaaacaugacaaugccccuaaguuguacuaaaaauaauucacaccacuacauaaugguaggaaacgaaacaggacuagaacuaacacuaacaaacaccucaauaauaaaucauaaauucugcaacuuauccgacgcacaccguaaaaacuuauaugaucacgcucucaugucaauuauaucaacauuccaccuaucaauaccaaauuuuaaccaauaugaagccaugucuugugacuucaacggcggaaaaauaucaguacaauacaaucuaucucacacauacgcgguagaugccgcaaaccacugcggaacaauagcaaacggaguacuacaaacauuuaugagaauggcauggggcggcucuuauauugcacuugacuccggcaaaggauccugggacugcauaaugacuucuuaccaauaccuaauaauacaaaacacaacaugggaagaucacugccaauucucaagaccaucccccauaggcuacuuaggauuauuaucacaaagaacaagagacauauacauaucuagaagauuacuaggcacuuuuacauggacccucucagacuccgaagggaaugaaaccccaggaggauacugccuaacaagauggauguuaauagaagcagaacuaaaaugcuuuggaaacaccgccguagcaaaauguaacgaaaaacaugacgaagaauuuugugacauguuaagacuauucgacuucaauaaacaagcuauaagaagacuaaaaacagaagcccaaaugucaauacaacuaauaaacaaagccguaaacgcauuaauaaacgaccaacuaauaaugaaaaaccaccuuagagauauaaugggaaucccauacuguaacuacuccaaauauugguaucuaaaccacacuguaacaggaaaaacaucacuucccagaugcuggcuaguuuccaacggauccuaucuuaacgaaacacacuuuuccgacgacauagaacaacaagccgacaauaugauaaccgaacuuuuacaaaaagaauauauagauagacaaggcaaaacuccacuaggauuaguagauuuauucgucuucucuacuuccuuuuaccuaauaucaauauuucuucaucuaguuaaaauaccaacacacagacacguaauagguaaacccugcccaaaaccacauagauuaaaucacaugggaauauguagcugcggacuauauaaacacccaggaguaccaguaaaauggaaaagauaa

SEQ ID NO: 2725 - RNA, 1473 nt, Artificial Sequence
  derived and/or modified CDS sequence (opt6) from Lassa virus__AIT17474__GPC
augggacaaauuauaaccuuuuuccaagaaguaccucacgucaucgaagaaguaaugaauauaguacucauagcauuauccuuauuagcaauauuaaaaggcauauauaacguagcuacaugcgguuuauuuggucuaguauccuuucuucuccuuuguggaagauccugcucaaccacauacaaaggaguauacgaacuacaaacauuagaacucgauauggccucacuaaauaugacaaugccauuaucauguaccaaaaacaacucacaucauuacauaaugguaggcaacgaaacaggacuagaacuaacacuaacaaacacauccauaauaaaucacaaauucuguaaccucucagacgcccacaaaaaaaauuuauacgaccacgcauuaaugucaauaauaucaacauuccaccuuucaauacccaacuuuaaccaauaugaagccaugucuugcgauuucaacgguggaaaaauaucaauacaauauaaccuaucccauacuuacgccguagaugccgcaaaucacugugggacaauagccaauggaguucuacaaacuuucaugcgaauggcauggggaggaucauacaucgcacuagacuccggaaaagguucuugggauugcauaaugacuucauaucaauaccuaauaauucaaaauacaacaugggaagaccacugccaauucucaagaccaucaccaauaggcuauuuaggacuacuaucacaaagaacccgagacauuuacauaucaagacgauuacucggaacauuuacuuggacacuaucugacucagaaggaaaugaaacaccaggaggauacugucuaacaagauggauguuaauagaagcagaacuaaaaugcuucggaaacacagcaguagcaaaaugcaaugaaaaacacgacgaagaauuuugugauaugcuacgauuauucgacuuuaauaaacaagcaauaagaagacucaaaacagaagcucaaaugucaauacaacuaauaaacaaagcaguaaaugcauuaaucaaugaccaacuaauaaugaaaaaccacuuaagagacauaaugggaauacccuacuguaacuacuccaaauauugguaccucaaccacacaaucacaggaaaaacaucauuaccaagaugcuggcuaguaucaaauggcucauaccuaaaugaaacacauuucucugacgacauagaacaacaagcagacaauaugauaacagaacuccuccaaaaagaauacauagacagacaaggaaaaacaccucuaggucuaguagacuuauuuguauuuucuacaucauucuaccuaauuucaaucuuccuacaccuaguaaaaaucccaacucaccgacacauaacaggaaaaccaugucccaaaccacaccgccuaaaucauaugggaauauguucaugcggacucuacaaacaccccggcguaccaguaagauggaaacguuaa

SEQ ID NO: 2726 - RNA, 1473 nt, Artificial Sequence
  derived and/or modified CDS sequence (opt6) from Lassa virus__AIT17478__GPC
augggacaaauaauaaccuucuuucaagaaguaccgcacguaauagaagaaguaaugaacaucguacuaaucgcauuauccuuauuagcaauacuaaaaggaaucuacaacgucgcaacuugcggcuuauucggacuaguaucauuccuucuauuaugcgguagaucuugcucaacaaccuacaaaggaguauaugaacuacaaaccuuagaacuagacauggccucacuuaacaugacaaugccauuaucuugcacaaaaaacaacucucaccacuauauaaugguaggcaacgaaacaggacuagaauugacacuaacaaacacaucaauaauuaaucauaaauucuguaaccuaucagacgcccacaaaaaaaaucuuuacgaucacgcucucaugucaauaaucucaacauuucauuuaucuauacccaauuucaaccaauacgaagcaaugucaugcgacuucaacggcggcaaaauaucaguccaauacaacuuaucacacacuuaugccguagacgcagcagaccacugcggaaccauugcaaacggagucuuacaaacauucaugcguauggcauggggaggaucauacauagcgcuagacucaggaaaaggaucaugggacugcauuaugacaucauaucaauaccuaauaauacaaaacacaacaugggaagaucacugccaauucucgagaccaagcccaauugguuaccuaggauuacuaucacaaaggacaagagacauauacauaucccgacgacuauuaggaacauuuacauggacacuuucagacucugaaggaaaugaaacaccaggaggauauugccuaacacgauggaugcuaauagaagccgaacuaaaaugcuucggaaauacagcaguagcaaaaugcaacgaaaaacaugacgaagaauucugcgacauguuaagacuauucgacuucaacaaacaagcaauaagcagacuaaaaaccgaagcacaaaugucaauucaauuaaucaacaaagcuguaaaugcauuaauuaacgaccaacuaauaaugaaaaaccacuuacgagacauaaugggcaucccauacugcaacuauucaaaauacugguaccuaaaccauacaguaacaggaaaaacaucacucccaagaugcuggcuuguuucaaacgguucauaucuaaacgaaacacacuuuucugaugacauagaacaacaagccgauaacaugauuaccgaaaugcuacaaaaagaauacauagacagacaaggaaaaacaccacuaggauuaguagaucuauucguauucucaacaaguuucuauuuaauuucaauauuccuacaucuagucaaaauaccaacccauagacacguaauaggaaaacccugcccaaaaccacauagacuaaaccacaugggcauaugcucaugcggacuauacaaacaccccggagucccugucaaauggaaaagauaa

SEQ ID NO: 2727 - RNA, 1473 nt, Artificial Sequence
  derived and/or modified CDS sequence (opt6) from Lassa virus__AIT17482__GPC
augggacaaaucauaacauucuuucaagaaguaccacacguaauagaagaaguaaugaacaucguccuuauagcacuaucacucuuagcaauauuaaaaggaauauauaauguagcaacaugcggccuauucggauuaguuaguuuccuacuccuaugcggaagaucaugcagcacaacauacaaaggaguauacgaacuucaaacucuagaauuagauauggcaucucuaaauaugaccaugccauuaucauguacuaaaaauaacucucaucauuacauaaugguaggaaacgaaacaggauuagaauuaacauuaacaaacacaucaauaauuaaucacaaauuuuguaaccuauccgaugcacauaagaaaaacuuauacgaucacgcauuaaugagcauuauuucaacauuucaucuaagcauccccaauuucaaccaauaugaagcaaugucaugcgauuuuaacggaggaaaaauaucaguacaauacaaccuaucacaugccuacgcaguugacgccgccaaccacugcggaacaaucgcaaauggaguacuccaaaccuucaugagaauggcauggggaggauccuauauagcucuagacuccggaaaaggaucuugggacugcauaaugaccucauaccaauacuuaauaauacaaaacauaaccugggaagaucacugccaauucucuagaccaucucccauuggauaccuaggacuacuaucccaacgaacaagagacauauacauaucuagacgauuauuaggaaccuucacauggacacucucugacucugaaggaaacgaaacuccaggaggauauugccuaacaagauggaugcuaauagaagcagaacuaaaaugcuuuggaaacacagcaguagcaaaaugcaacgaaaaacacgacgaagaauuuugcgauauguuaagauuauucgacuucaacaaacaagcaauaagaagauuaaaaaccgaagcacaaaugucuauacaacuaauaaauaaagcaguaaaugcacuaauaaacgaccaguuaauaaugaaaaaucacuuaagagauauaaugggaauacccuacuguaauuauucuaaauacugguaccucaaucacacaguaacaggaaaaacaucacuacccagaugcuggcuaguuucaaacggaucauaccugaacgaaacucacuucucagacgacauagaacaacaagcugauaauaugauuaccgaacuacuacaaaaagaauacauagacagacaaggaaaaacuccauuaggccuaguugaucucuucguauucucaaccuccuucuaucuaaucucaaucuuuuuacauuuaguaaaaauaccaacacacagacauguaguaggaaaaccaugcccaaaaccacaccgcuuaaaucacaugggaauaugcucaugcggacucuacaaacacccaggcguaccaguaaaauggaaaagauaa

SEQ ID NO: 2728 - RNA, 1473 nt, Artificial Sequence
  derived and/or modified CDS sequence (opt6) from Lassa virus__AIT17486__GPC
augggacaaauaaucacauucuuucaagaaguaccacacguaauagaagaaguaaugaacaucguacuaauagcauuaucauuacuagcaauccuaaaaggaauauacaacgucgcaacuugcggccuuuucggccuaguauccuuucuacuacucugcggaagaucaugcucaacaacauauaaaggaguauacgaacuucaaacacuagaauuagacauggcaucacucaauaugacuaugccacuaaguugcacuaaaaacaacucacaccacuauauaaugguaggaaaugaaacaggacuagaauuaacacuaacaaacacaucaauuauaaaccacaaauucugcaacuuauccgacgcacauaagaaaaaccuauaugaccacgcauuaauguccauaauuucaacauuccaccuaucaauaccuaauuuuaaccaauacgaagcaaugucuugcgacuuuaacggaggaaaaauaucuguacaauacaaccuaucccacacauacgcagucgacgcagcaaaccacugcggaacaauagcaaauggaguccuacaaacauucaugagaauggccuggggaggaucauauauugcauuagacucaggaaaaggauccugggauugcauaaugacaucauaccaauaccuaauuauacaaaacacaacaugggaagaccacugccaauucucaagaccaucaccagucggcuaccuaggcuuauuaucccaacgaacaagagauaucuacauaucacgcagacuauuaggaacauucacauggacacucucagacucagaaggaaacgaaacaccaggcggauacugccuaacaagauggaugcuaaucgaagccgaacuaaaaugcuuuggaaauacagccguagcaaaaugcaaugaaaaacaugacgaagaauuuugcgauauguuaagacucuucgacuuuaauaaacaagcaauaagacgacuaaaaacagaagcacaaaugucaauacaacucauaaauaaagcaguaaacgcucuaauaaacgaccaauuaauaaugaaaaaucaccucagagauauaaugggaaucccauacugcaacuacucuaaauacugguacuuaaaccauacaguaaccggaaaaacuucuuuaccaagaugcuggcucguaucuaacggcucuuacuuaaaugaaacccacuucucagacgacauagaacaacaagcagacaacaugauaacagaacuccuccaaaaagaauauauagacagacaagguaaaacaccauuaggacucguagaccuauuuguauuuucaacaucauucuaccuaauaucaauauucuuacacuuaguuaaaauaccaacacauagacacguaaucggaaagccauguccaaaaccacacagacuuaaccacaugggaauaugcucuuguggacucuacaaacacccagguguuccaguaaaauggaaaagauaa

SEQ ID NO: 2729 - RNA, 1473 nt, Artificial Sequence
  derived and/or modified CDS sequence (opt6) from Lassa virus__AIT17490__GPC
augggacaaauaauuacauucuuccaagaaguaccacauguaauagaagaaguaaugaacauuguacuuauaacucucucacuacuagcaauauuaaaagguaucuacaacguagcaacaugcggacuuuuuggcuuaguaucauuccuacuacuuugcggccgaucuuguucuacaacauacaaaggaguauacgaacuacaaacacuugaauuagauauggccaaccuaaacaugacaaugccccuaucuugcacaaaaaauaacucccaccauuacaucauggucggaaacgaaacuggacuagaacuaacacuaacaaacaccucuauaauaaaucacaaauucugcaauuuaucagacgcacacaaaaaaaaccuauacgaccacgcacuaauguccauaauauccacauuccaucuaucaauaccaaacuucaaccaauaugaagcaauguccugcgacuucaacggaggcaaaauauccguacaauacaauuuaucucacacauuugcaguagacgcagcaaaccauugcggaacaauagcaaacggaguacuacaaacauucaugagaauggcauggggaggauccuacaucgccuuagacucaggaaaaggaucuugggacugcauaaugacuucauaccaauacuuaaucauacaaaacacaacaugggaagaccacugucaauucucaagaccauccccaauaggauaucucggucuauuaucucaaagaacaagagacauauauaucucuagacgucuauuaggaacauucacauggacucuauccgacucagaagguaacgaaacccccggaggauauugucuaacacgauggaugcuaauugaagcagaacuaaaaugcuuuggaaacacugcaguugcaaaauguaaugaaaaacacgacgaagaauucugcgauaugcuuagacuuuucgacuucaauaaacaagcaauaagaaggcuaaaaacagaagcacaaauguccauacaauuaauaaacaaagccguuaaugcacuaauaaacgaucaacuaauaaugaaaaaucaucuccgagacauaaugggaauaccauauugcaauuacucaaaauacugguauuuaaaccacacaguaaccggaaaaacaucuuuaccuagaugcugguuaguauccaacggaucauaccuaaaugaaacccacuucucagaugacauagaacaacaagcagauaacaugauuacagaauuacuccaaaaagaauacauggacagacaaggaaaaaccccauuaggacuaguagaccucuuuguauucucaacuuccuuuuaccuaaucucaauauuccuacauuuaguaaaaauacccacucauagacauauaauaggaaaaccaugcccaaaaccacacagacuaaaucauaugggaaucuguuccuguggacuauauaaacacccuggaguaccaguaaaauggaaacgauaa

SEQ ID NO: 2730 - RNA, 1473 nt, Artificial Sequence
  derived and/or modified CDS sequence (opt6) from Lassa virus__AIT17494__GPC
augggacaaauaauaacauuuuuucaagaaguuccucauguaauagaagaaguaaugaauauaguucuuaucgcacuaucccuauuagcaauccucaaaggaguauacaacguugcaacaugcggacuauucggauuaguaucauuccuucuacuuuguggaagaucaugcucaaccaucuauaaaggcguauacgaacuacaaacccucgaauuagauauggcauccuuaaauaugacaaugccacuaucuuguacaaaaaacaacagucaucacuauauaauggucggcaacgaaacaggacuagaacuaacacuaacaaacacaagcaucauaaaccacaaauuuugcaacuugucugacgcacacaaaaaaaacuuauaugaccacgcacuaaugucaauaauaucaacauuccaccucuccauaccuaauuucaaucaguacgaagcaaugucaugcgauuucaacggaggaaaaauaucaguacaauauaaccucucacauacuuaugccguagacgcugcuaaucacugcggaacaauagcaaacggcguacuacaaacauucaugagaauggcauggggaggcucuuacauagcauuagacuccggaaaaggaucaugggauugcauaaugacuucauaucaauaccuaauaauucaaaauacaucuugggaagaccacugccaauucagcagaccuucaccaauaggauaucuaggccuacuaucacaacguaccagagacauauacauauccagaagacuucuaggaacauucacauggacauuaucagacucugaaggaaacgaaacccccggaggauacuguuuaacaagauggaugcuaauagaagccgaauuaaaauguuucggaaacacagccgucgcaaaauguaacgaaaaacaugacgaagaauucugcgacaugcucagacuauuugacuucaacaaacaagcaauaagaagacuaaaaacagaagcacaaaugucuauucaacucauaaacaaagccguaaaugcauuaaucaacgaccaauuaauaaugaaaaaccaccuacgagacauaaugggaaucccauacugcaauuacucaaaauacugguaucucaaccauacaguaacaggaaaaacuucacuuccaagaugcuggcuaguuuccaacggaucauaucuaaacgaaacacacuuuucugacgauauagaacaacaagcagacaacaugauaacagaacuauuacaaaaagaauacauagacagacaaggaaaaacaccacucggacuaguagaucuuuucguuuucagcacuucauucuacuuaauauccauauuccuacaccuaguaaaaauaccaacucaccgccacguaaucggaaaaccaugcccaaaaccccauagacuaaaccauauggggauaugcagcugcggacuuuacaaacacccaggaguaccaguaaaauggaaacgauaa

SEQ ID NO: 2731 - RNA, 1473 nt, Artificial Sequence
  derived and/or modified CDS sequence (opt6) from Lassa virus__AIT17498__GPC
augggacaaauaauaaccuucuuccaagaaguaccacauguaauagaagaaguaaugaauauuguacuaaucgcacuaucauuauuagcuauacucaaaggaauauacaacguagcaacaugcggacuauucggacuaguuucauuucucuuacuaugcggaagaucaugcucaacaacauacaaaggcguauacgaacuucaaacauuagaacuagacauggcaucuuuaaacaugaccaugccacuaucauguacaaaaaacaauucacaucauuauauaaugguaggaaacgaaacaggccucgaacucacccuaacaaauacuucaauaauuaaucauaaauucuguaauuuaucugacgcccacaaaaaaaaccuauaugaccacgcauuaaugucaauaauaucaacauuccaccuaucaauacccaacuucaaucaauacgaagccaugucaugcgauuucaacggaggaaaaauaucaguacaauauaauuuaucacacaccuacgcaguagaugcagcaaaccacugcggaaccauagcaaauggcguacuacaaacauucaugagaauggcauggggaggcucauacauagcauuagacucaggaaaaggaaauugggacuguauaaugacuuccuaucaauaccuaauaauacaaaacacaacaugggaagaccacugccaauucaguagaccaucacccauaggauaccuaggacuacuaagucaaagaacuagagacauauacaucagcagaagacuacucggaacuuucacauggacuuuauccgacucagaagguaacgaaacaccaggaggauacugccuaacacgcuggauguuaauagaaaccgaacuaaaauguuucggaaauacagccguagccaaaugcaacgaaaaacaugacgaagaauucugcgacauguuaagacucuucgacuucaauaaacaagcaauaucaagacuaagaucagaagcacaaaugucaauacaauuaauaaauaaagccguaaacgccuuaauaaaugaucaauuaauaaugaaaaaccaucuacgagacauuaugggaauccccuacugcaacuacagcaaauauugguaucuaaaccacacaguaacaggcaaaacaucucuaccuaaaugcuggcuagucucaaacggcucauauuuaaacgaaacacacuuuucagacgacaucgaacaacaagcagacaauaugauaacugaaauguuacaaaaagaauacauagaccgacaaggcaaaacaccccuaggacugguagaccuauuuguauucucaacauccuuuuaccuaauaucaauuuuucuacauuuaguaaaaauccccacacaccgacauauaacaggcaaaccaugcccuaaaccucaccgacucaaccauaugggaaucugcaguugcggacuauacaaacacccaggcgucccaguaaaauggaaacgcuaa

SEQ ID NO: 2732 - RNA, 1473 nt, Artificial Sequence
  derived and/or modified CDS sequence (opt6) from Lassa virus__AIT17502__GPC
augggccaaauaauaacauuuuuccaagaaauaccacacguuauagaagaaguaaugaacauaguacuaaucacauuaucacuacuagcaauauuaaaaggaauauacaacguugcaacaugcggauuauucggccuaguaucauuccuacuacuaugcgguaaauccuguuccaccacauacaaaggaguauacgaauuacaaacucuugaauuagacauggccagccuaaauaugacaaugccauuaucaugcaccaaaaauaauucacaucauuacaucaugguaggaaacgaaaccggccuagaacucacauuaaccaauacaucaauaauaaaucacaaauucugcaaccuaagcgacgcucaccguaaaaaccuauacgaccacacauuaaugucaauaauaucuaccuuccacuuaucuauccccaacuuuaaccaauacgaagccauguccugugacuuuaauggagguaaaauaucaguccaauacaaucucucccacgccuacgccauugacgcagccacacacugcggaacaaucgccaaugguguccuacaaacauucaugagaauggcauggggaggaucauacauagcccuagacucuggaaaaggaggaugggauuguauaaugacaaguuaucaauaucuaauaauucaaaacacaacaugggaagaccacugucaauucucuagaccaucaccaauaggcuacuuaggacuacuaucacaacgaacccgagauaucuauauauccagaagauuacuaggcacauucacauggacacuaucugacucagaaggaaacgaaacaccaggcggauacugcuuaacuagauggaugcuaauagaagcagaacuuaaauguuucggaaacacagcagucgccaaaugcaacgaaaaacacgacgaagaauuuugcgauaugcuaagauuauucgacuucaacaaacaagcaauacgucgacuuaaaaccgaagcccaaaugucaauucaacuaauaaacaaagcaguaaacgcacuaauaaacgaucaauuaauaaugagaaaccaccuacgagacauaaugggaaucccauacuguaacuacucuaaauauugguaccuaaaucacacaguaacagguaaaacuucacuaccuaaauguuggcuaguaucaaacggcaguuaccuaaacgaaacacacuucucugacgacaucgaacaacaagcagacaacaugauaacagaauuacuacaaaaagaauacauggacaggcaaggcaaaacaccucuuggacuuguagaccuauucguauucucaacaucauucuaccuuauauccauuuuccuacaccuagucaaaauuccaacccaccgacacguaauagguaaacccugcccaaaaccacacagauuaaaucauaugggaguaugcucuugcggacuauauaaacauccaggcgucccaguaaaauggaaaagauaa

SEQ ID NO: 2733 - RNA, 1473 nt, Artificial Sequence
  derived and/or modified CDS sequence (opt6) from Lassa virus__AIT17506__GPC
augggucaaauaaucacauucuuccaagaaguaccacacguaauagaagaaguaaugaauauaguacuaauugcacuaucauuauuagcaauacuaaaaggaauauauaacguagcaacaugcggacuauuuggccuaguaucuuucuuacuauuaugcggucgaucaugcucaaccacuuauaaaggaguauacgaauuacaaacacucgaauuagacauggcaucauuaaacaugacuaugccacuuuccugcaccaaaaacaacucacaccacuauauaaugguaggaaacgaaacaggacuagaauuaacacuuacaaacaccuccaucauaaaucauaaauucugcaaccucucagacgcacacaagaaaaaucucuacgaccaugcccuuaugucaauaauaucaacauuccacuuaagcauacccaacuucaaucaauacgaagcaaugucaugcgauuucaacggaggaaaaauauccguucaauacaauuuaagucacgcauacgcaguugacgcagcagaacacugcggcacaaucgcaaacggaguauuacaaacauuuaugcgaauggcuuggggcggauccuacauagcucucgacucaggcaaaggaucaugggauugcguaaugaccucauaccaauacuuaauuauacaaaauaccacaugggaagaucacugccaauucucacgaccaucaccaauaggauaucuaggacuauuaucacaacgaacuagagauauuuacaucagcagaagacuacuaggcacauucacuuggacccuaucagauucugaaggcaaugaaacaccaggaggauacuguuuaacaagauggauguuaauagaagcugaacuaaaaugcuucggaaacaccgcaguagcaaaaugcaacgaaaaacacgacgaagaauuuugcgauauguuaagauuauucgacuucaauaaacaagccauagaacgacuuaaaacagaagcucaaauguccauccaacuaauaaacaaagcaguaaacgcauuaauaaacgaccaauuaauaaugaaaaaccaccuaagagauauaaugggaauaccauacuguaauuacucaaaauacugguauuuaaaccauacagucacaggaaaaacaucacuaccuagaugcuggcuaguaucaaauggaagcuacuuaaacgaaacccauuucucagaugacauagaacaacaagcugauaacaugauaacagaaaugcuacaaaaagaauacauagauagacaaggaaaaacaccacuaggauuaguagaucuauuugucuucuccacauccuucuaucuaaucucaauauuucuccaccuaguaaaaauaccaacacacagacacguaauuggaaaaccaugcccaaaaccacacagauuaaaccauaugggcauaugcucaugcggauuauacaaacacccaggaguaccaguaaaauggaaaagauaa

SEQ ID NO: 2734 - RNA, 1473 nt, Artificial Sequence
  derived and/or modified CDS sequence (opt6) from Lassa virus__AIT17510__GPC
augggacaaauaauaaccuuuuuucaagaaguaccacacguaauagaagaaguaaugaacauagucuuaauagcacuaagccuacuagcuauacuaaaaggaauauauaauguagcaaccugcggacuauuuggauuaguaucauuccuauuacugugcggccgaucuugcagcacaacauacaaaggagucuacgaauuacaaacauuagaacuagacauggcaucauuaaacaugaccaugccacuaucuuguacuaaaaauaauagccaccacuacauaauggucgguaaugaaacaggcuuagaacuaacauuaacaaacacaucuaucauuaaccauaaauucugcaaccuauccgaugcccacaaaaaaaaccuauacgaccacgcauuaaugucaaucauauccacauuccaucuaucaaucccaaauuucaaccaauaugaagcaaugaguugcgauuuuaacggaggaaaaauaucaguacaauacaaucuaucucacacauacgcaguagacgcugcuaaccacugcggaacaauagcaaacggaguacuacaaacauucaugagaauggccuggggaggauccuacauagcauuagacuccggaaaaggaucaugggacuguauaaugaccucauaccaauaucuaauaauacaaaacacaacaugggaagaccacugccaauuuucacgaccauccccaauaggauaccuaggacuauuaucccaaagaacaaaagacauauauauauccagacgccuauuaggaacauucacauggacacuauccgacuccgaaggaaacgaaacacccggaggcuacugcuuaacaagauggaugcucauagaagccgaacuaaaaugcuucggaaauacagcagucgcaaaauguaacgaaaaacacgacgaagaauucugcgacaugcuucgucucuucgacuucaacaaacaagcuaucagacgccucaaaacagaagcacaaaugucaauacaauuaaucaacaaagccgucaacgcccuaaucaacgaccaacuaaucaugaaaaaucaccuacgagacauaaugggaaucccauauugcaauuacucaaaauacugguaucuaaaccacacaguaacuggaaaaacaucuuuaccaagaugcuggcuagucucaaacgguucauaucuaaaugaaacacacuuuucagaugacauagaacaacaagcugauaauaugaucaccgaacuacuacaaaaagaauauauagacagacaagguaaaaccccacuuggacuagucgaccuauucguauuuucaacauccuucuaccuaauauccauauuccuccauuuaguaaaaauaccaacacaccgacauguaauaggcaaaccauguccuaaaccacauagauuaaaucacaugggaauaugcucaugcggauuauauaaacauccgggcguacccguaaaauggaaaagauaa

SEQ ID NO: 2735 - RNA, 1473 nt, Artificial Sequence
  derived and/or modified CDS sequence (opt6) from Lassa virus__AIT17514__GPC
augggucaaaucauaaccuucuuccaagaaguuccacacgucauagaagaaguaaugaacauaguucuaauagcacuuucucuacucgcaguauuaaaaggaauauauaacguagcaacaugcggacuauuuggcuuaguaucauuccuccuauuaugcggaagaucuugcucuacaacauauaaaggaguauaugaauuacaaacccuagaacucgacauggcaucucuaaacaugacaaugccacuaucuugcacaaaaaauaacucacaccacuacaucaugguaggaaacgaaacaggacuagaacuaacacuaacaaacacaucaauaauuaaccacaaauucugcaaccucuccgacgcacacaaaaaaaacuuauaugaucacgcauuaaugucaaucaucucuacauuccaucucuccauacccaacuucaaucaauacgaagccaugucaugcgauuuuaacggcggaaaaauauccguacaauacaaccuaucucacacauacgccguagacgccgcaaaucacugcggcacaauagcaaacggaguacuacaaacauuuaugcgaauggcaugggguggcucauacaucgcuuuagauucaggaaaaggauccugggauugcauaaugaccucauaccaauaucuaauaauacaaaauacuaccugggaagaccacugccaauucuccagaccaucuccuaucggauaccuaggccuauuaucucaacgcacacgagacauauacauauccagaagacuauuaggaacauucacauggacacuaucugacucagaaggcaacgaaaccccaggaggauacugcuuaacaagauggaugcuaauagaagcagaacuuaaaugcuuuggaaacacagcuguagcaaaauguaacgaaaaacacgacgaagaauucugcgauaugcuaagauuauuugauuuuaauaaacaagcaauaagacgacuaaaaacagaagcacaaaugucaauacaauuaauaaacaaagccguaaaugcacucauaaacgaccaauuaauaaugaaaaaucaccuaagagacaucaugggaauaccauacuguaacuacucuaaauauugguaccuaaaccacacaguuacaggcaaaacauccuuaccacgcuguuggcuuguaucaaacggcucauaccuuaacgaaacucacuuuucagacgauauagaacaacaagccgauaacaugauaacagaacucuuacaaaaagaauauauagacagacaaggaaaaacaccacuaggacuaguugaccuauucguauuuucuacuucauucuaucuaauaucaauauuucuacaucucguaaaaaucccaacacauagacacguaauaggcaaaccauguccaaaaccucauagacuaaaccacaugggcauuuguuccuguggacuauacagacacccaggaguaccaguaaaauggaaaagauaa

SEQ ID NO: 2736 - RNA, 1473 nt, Artificial Sequence
  derived and/or modified CDS sequence (opt6) from Lassa virus__AIT17518__GPC
augggacaaaucaucacauucuuucaagaaguaccacacguaauagaagaaguaaugaacaucguccuaauagcacuuucacuauuagcuauacuaaaaggaauauacaacguggcaacaugcggccuauucggauuagucagcuuucuccuccuaugcggacgaucauguucaacaacauacaaaggaguauacgaacuccagacauuagaacuagauauggcaucauuaaacaugacaaugccauuaagcugcacaaaaaauaacucccaccauuauauaaugguuggaaaugaaaccggacuagaauuaacauuaacaaauaccucuauaauaaaucauaaauucuguaaccuaucugaugcccauaaaaaaaaucuauacgaccacgcauuaaugucuauaauaucaacauuccaccucuccauaccaaacuucaaccaauacgaagcuaugucaugcgauuuuaacggaggaaaaauauccguacaauacaacuuaagucaugccuaugcaguugacgccgcaaaccauugcggaaccauagcaaauggaguacuacaaaccuucaugagaauggcauggggaggaucauauauagcauuagacucaggcaaaggcucaugggacuguaucaugacauccuaccaauaccuaaucauacaaaacacuacaugggaagaccacugccaauucucuagaccauccccaauaggauauuuaggacuccuaagccaaagaacaagagacauauacauaucaagaagacuauuaggcacauucaccuggacacuaucagacucagaaggaaacgaaacaccaggaggauauugccuaacaagauggaugcuaauagaagcagaacuaaaaugcuucggaaauacagcagucgcgaaaugcaaugaaaaacacgacgaagaauucugcgacauguuaagacuauucgacuucaacaaacaagccauaagaagauuaaaaacagaagcacaaaugucuauacaauuaauaaacaaagcuguaaaugccuuaauaaaugaccaacuaauaaugaaaaaccacuugcgagacauaaugggaauacccuauuguaacuacuccaaauacugguaccuaaaucacacaguuacuggaaaaaccucacuaccaagauguuggcuaguaucaaacggaucauaucuaaaugaaacacacuucucagacgacauagaacaacaagcagauaauaugauaacagaauuacuacaaaaagaauacauggauagacaaggaaaaacuccacuaggacuaguagaccucuucgucuucuccacauccuucuaccuaauaagcaucuuucuacaccuagucaaaauaccaacacauagacacguuauaggaaaacccugcccaaaaccacauagauuaaaccauaugggcauaugcagcugcggauuauauaaacauccaggaguuccaguaaaauggaaaagauaa

SEQ ID NO: 2737 - RNA, 1473 nt, Artificial Sequence
  derived and/or modified CDS sequence (opt6) from Lassa virus__AIT17524__GPC
augggacaaauaauaacauuuuuucaagaggucccacacguaaucgaagaaguaaugaacauaguccucauagcucuaagccuucuagccauacucaaaggcauauacaacguagcaacaugcgguuuauuuggacucguuucauuccuacuacucugcggcagaaguugcucaaccacauacaaaggaguauaugaacuacaaacacucgaacuagauauggcaucacuaaacaugacaaugccauuaaguuguaccaaaaauaauucacaucacuacauaaugguaggaaacgaaacaggacuugaacuaacauuaacaaauacuucaauaauaaaccacaaauucuguaacuuaucagacgcacacaaaaaaaaccuauacgaccacgcacuaaugucaauaauaucaaccuuccauuugucaauuccuaauuucaaucaauacgaagcuaugucaugugacuuuaauggcggcaaaaucucaguacaauacaaucuuucacacaccuacgcaauagacgcagcaaaccacuguggaacaauagcaaauggaguacuacaaacauucaugagaauggcauggggaggcucauauauagccuuagacucaggaaaaggaucaugggacugcauaaugacaucauaucaauaucuaaucauacaaaauacaaccugggaagaccauugucaauuuucuagaccaucaccaauaggauaccuaggacuacuaucacaaagaacaagagacauauacauuucaagaagauuacuaggaacauucacuuggacuuuaucugacucagaaggcaaugaaaccccugguggauacugccuaacaagauggauguuaauagaagcagaauuaaaaugcuucgguaacacagcaguagcaaaaugcaacgaaaaacaugaugaagaauucugugacauguuaagacuauucgacuucaacaaacaagcaauacguagauuaaaaacagaagcucaaaugucaauccaauuaauaaacaaagcaguuaacgcauuaauaaacgaccaacuaauaaugaaaaaucaccuaagagacauaaugggcauaccauacugcaauuacuccaaauauugguaccugaaccacacaguaaccggaaaaacaagcuuaccacgaugcuggcuaguaucaaacggaucauacuuaaacgaaacacacuucucagacgacauagaacaacaagcagacaacaugauaacagaaauguuacaaaaagaauacauggacagacaaggaaaaacaccacuaggauuaguagaucuauucguauucucuaccuccuucuacuuaaucucaauauuccuccacuuaguaaaaauaccaacccaccgacauguaauaggaaaaccaugcccaaaaccacaccgacuaaaucacaugggaauaugcuccugcggacucuacaaacaccccggaguaccuguaaaauggaaaagauaa

SEQ ID NO: 2738 - RNA, 1473 nt, Artificial Sequence
  derived and/or modified CDS sequence (opt6) from Lassa virus__AIT17528__GPC
augggccaaauaauaacauucuuucaagaaguaccacacguaaucgaagaaguaaugaauaucguauuaauagcacuaucacuacuagcaaugcuaaaaggaaucuacaacauagcuacaugcggucuuuucggacuaauaucuuuccuauuauuaugcggacgaucauguucaaccacauacaaaggaguauacgaauuacaagcauuagaauuagacauggcaaaucuuaacaugaccaugccacuaucauguacaaaaaacaauucucaccacuacaucauggucggaaaugaaaccggauuagaauuaacacuaacaaauacauccauuaucaaucacaaauuuuguaaucuaucagaugcacacaaaaaaaacuuauacgaccacgcauuaaugucaauaauaucaacuuuucaccuuucaauaccuaauuucaaucaauacgaagcaauguccugcgauuucaauggaggaaaaaucucuguacaauacaaucuaucccauaccuacgcaggagacgcagcaaaacacugcggaaccauagcaaauggaguacuucaaacauucaugcgaauggccuggggaggaucauacauagcauuagacucagguaaagguaauugggacuguauaaugacuucauaucaauaucuaauaauacaaaauacaaccugggaagaccacugccaauucucuagaccaucaccaauaggauacuuaggccuacuaucacaacgaacacgugacauauacauaucaagacgauuacuaggaacauuuacauggacacuaucugacucagaaggcaacgaaacuccaggugguuauugccuaacaagauggaugcuaaucgaagcagaacuaaaauguuucggaaauaccgccguagcaaaaugcaacgaaaaacaugacgaagaauucugcgacaugcuucgacuauuugacuucaacaaacaagcaaucagaagacuaaaaacugaagcucaaaugucaauacaauuaaucaacaaagcagucaaugcccuaauaaacgaccaacuaauaaugaaaaaucaucuaagagacauaaugggaauaccauacugcaacuacucaaaauacugguacuuaaaccacucaguaacaggacgaacaucucuuccacgaugcuggcucguaucaaacggauccuaccuaaacgaaacacaauucucagacgacauagaacaacaagcagacaacaugaucacagaaauguuacaaaaagaauacauagacagacaaggaaaaacaccacuaggacuaguagaccucuucguauucucaacuucauucuaccuuauaucaauauuucuccacuuaauaaaaauaccaacacauagacauauagucggaaaaccauguccaaaaccccaucgacuaaaccacaugggaaucuguucauguggauuauauaaacacccuggaauaccaguaaaauggaaacgcuag

SEQ ID NO: 2739 - RNA, 1473 nt, Artificial Sequence
  derived and/or modified CDS sequence (opt6) from Lassa virus__AIT17538__GPC
augggccaaauaauaacauucuuucaagaaguaccucacguaauagaagaagucaugaacauuguacuaauagcacuaucauuacuagcaauacuuaaaggaauauacaacauagccacuugcggauuauuuggacuaauauccuuccuauuauuaugcggaagauccuguucaaccaccuauaaaggaguuuacgaauuacaaacucucgaacuagacauggcaaaccuaaauaugaccaugccuuuaucauguaccaaaaacaacucacaccacuacauaaugguaggaaaugaaacaggauuagaacucacauuaacaaacacaucaauaauaaaucacaaauucugcaaccuaucagaugcucacaagaaaaauuuauacgaccacgcacuaaugucaauaauuucaacauuucauuuaucuauaccaaacuucaaccaauacgaagcaaugucaugugacuucaaugaaggaaaaauaucaguacaauauaaccuaucacacucuuaugcuauagacgcagcuggacacuguggaacaaucgcaaacggaguacuacaaaccuucaugagaauggcauggggaggcagcuauauagcccucgauuccggcaaaggaaacugggacuguauaaugacaucauaucaauaucuuauaauacaaaacaccacaugggaagaucauugccaauucucacgaccaucacccaucggauacuuaggccuacuaucacaaagaaccagagauauuuacauaucacgcagacuacuaggaaccuucacauggacccuaucagacucugaaggaaacgaagcuccaggagguuauugucuaaccagauggauguuaauugaagcagaacuaaaaugcuucggaaacacugcaauagcaaaaugcaacgaaaaacacgacgaagaauuuugcgauaugcuccgauuauucgacuuuaauaaacaagcaaucaaacgacuaaaagccgaagcacaaaugucaauacaccuaaucaacaaagccgucaacgcacuaauuaaugaccaacuaaucaugaaaaaccaccucagagacauaaugggcaucccauacuguaauuacucaaaauacugguaccuuaaucacacaguaacuggcaaaacaucucuaccaaaaugcuggcuaguuuccaacggaucauaccuuaacgaaacccacuuuucagaugacauugaacaacaagcagauaauaugauaacggaacuauuacaaaaagaauacauggauagacaaggaaaaacaccccuaggacucgucgaucuauuuguauuuucaaccucauucuaccuaauaucaauuuuccuacacuuaguaaaaauacccacacauagacauauaguaggaagaccaugucccaaaccacauagacucaaccacaugggaauauguucaugcggccucuacaaacauccuggaguaccaguaaaauggaaaagauaa

SEQ ID NO: 2740 - RNA, 1473 nt, Artificial Sequence
  derived and/or modified CDS sequence (opt6) from Lassa virus__AIT17540__GPC
augggacaaauuguuacauucuuucaagaaguaccacauguaauagaagaaauaaugaacauaguacucauaacacucucucuacucgcaauauuaaaaggcaucuacaacuuugcaacaugcggacucauaggauuaaucacauuucucuuccucugcggucgaucaugcuccacaauauacaaaggauccuaccaacuacaaacacuagaacuaaacauggaaacacucaacaugacaaugccauuaucaugcaccaaaaacaacucacaccacuacauaagaguaggaaacgaaacuggauuagaacuaacacuaacaaacacaucuauaauaaaucauaaauucugcaacuuaucagaagcacacaagaaaaaccuauaugaccacgcauuaaugucaauaaucucaacauuucaucuauccauaccaaauuucaaccaauacgaagcaaugucaugugacuucaauggaggaaaaauaagcguacaauacaaucuaucacacucauacgcaguagaugcugcaaaccauuguggaaccguagccaacggcguacuucaaacauucaugagaauggcauggggaggaucauacauagcacuagacuccggaagaggcaacugggacuguauaaugacaucauaccaauaucuaaucauacaaaacacaacaugggaagaucauugucaauucucacgacccucaccaauaggauaccuuggcuuacucucucaacguacaagagacaucuauauuucaagacgauuauuaggcacauuuacauggaccuuauccgacucagaaggcaaagaaacuccaggaggcuacugcuuaacccgauggaugcuaaucgaagcugaacucaaauguuucggaaauacagcaguugcaaaaugcaacgaaaaacacgacgaagaauuuugugacaugcuaagacuauuugacuucaauaaacaagcaauacaacgucuaaaaaccgaagcccaaaugucaauucaacuaauaaauaaagcaguuaaugcauuaauaaaugaucaacugauaaugaaaaaccacuuacgagacauuauggguauucccuacuguaacuacucaaaauacugguaccuaaaucacacaucaacaggaagaacuucauuaccaaaaugcugguuaguaucaaacggaucauaccuaaacgaaacacacuuuucagaugacauagaacaacaagcagacaacaugauaacugaaauguuacaaaaagaauacauagauagacaaggaaaaaccccucuaggauuaguagaccuauucguauucuccaccucuuucuauuuaauauccauauucuuacacuuaguaaaaauuccaacccacagacauauaguaggaaaaucaugccccaaaccacaccgcuuaaaccacaugggaaucuguucauguggacuauacaaacaaccaggaguuccagucaaauggaaaagauaa

SEQ ID NO: 2741 - RNA, 1473 nt, Artificial Sequence
  derived and/or modified CDS sequence (opt6) from Lassa virus__AIT17544__GPC
augggacaaauaauaacuuucuuccaagaaguaccccaugucauagaagaaguaaugaacauagucuuaauagcacuaucacuacuagcaauucuaaaaggaauauacaauguagcaaccugcggauuauucggccuagucucauuccuacuacuauguggacgaucauguuccaccaccuacaaaggaguauacgaacuacaaacacucgaauuagacaugggaucauuaaacaugaccaugccuuuauccuguacuaaaaacaauucccaucacuacauaauggucggaaacgaaacaggauuagaacuaacacuaacaaauacaucuaucauaaaccacaaauucugcaacuuaucagacgcacacaagaaaaaucuauacgaccacgcccucaugagcauaauauccacauuucaucuaucaauacccaacuucaaucaauacgaagcaauguccugugacuucaauggaggaaaaauuucuguacaauacaaccuaucccauucauaugcuguugaugcagcaaaccauuguggaacaauugcaaacggcguacuacaaaccuucaugcgaauggcauggggaggaucuuacauagcacuagacucaggaaaaggcuccugggacugcauaaugacaucauaccaauaccuuauuauacaaaacacaaccugggaagaccacugucaauuuucaagaccaaguccaauaggauaucuaggacuacuaucacaacgcacaagagauauauauauaucuagaagauuacuaggaacuuuuacuuggacacuauccgacucugaaggaaacgaaaccccuggaggauacugucuaacaagauggaugcuuauagaagcagaacuaaaaugcuucgguaacacagcaguagcaaaaugcaacgaaaaacaugacgaagaauuuugcgacauguuaagacuauucgauuucaauaaacaagcaauaagaagacuaaaaacagaagcacaaauguccauacaacuaauaaacaaagcuguaaaugcccuaauuaacgaccaacuaauaaugaaaaaccacuuaagagacauaaugggcauuccauacuguaacuacucaaaauacugguacuuaaaccacacaguaacaggaaaaacaucauuaccaagauguuggcuuguaucaaauggcucuuacuuaaacgaaacacacuucucagaugacauagaacaacaagccgacaauaugauaacagaauuacuacaaaaagaauauauggacagacaaggaaaaaccccacuuggucuaguagaucucuucguauucagcacaucauucuaucuaauaucaaucuuccuacaccuaguaaaaauucccacucaccgacauauaaucggaaaaccaugcccaaaaccccauagacuaaaccauaugggaaucugcucauguggacuauacaaacacccaggaguaccagucaaauggaaacgauaa

SEQ ID NO: 2742 - RNA, 1473 nt, Artificial Sequence
  derived and/or modified CDS sequence (opt6) from Lassa virus__AIT17548__GPC
augggccaaaucaucacauucuuucaagaaguaccccaugucauagaagaaguaaugaacauaguacuuauugcuuuaucauuacucgcaauacuaaaagguauauacaaugucgcaacauguggauuauucggauuaguauccuuccuguuccuuugcgguagaucaugcaguacaaccuacaaaggaguauacgaacuucaaacacuagaacuagauauggcaucucugaauaugacaaugccccucucuugcaccaaaaacaacucacaucacuacauaaugguuggaaacgaaacaggacuagaauuaacacuaaccaacacuucaauaauaaaccauaaauucugcaaucuaucagaugcccacaaacguaacuuauacgaucacgcauuaaugucaauaauauccacauuccauuuaucaauccccaauuucaaccaauacgaagcaaugucaugugauuucaacggaggaaaaauauccguccaauacaacuuaucacaugccuaugcaggagacgcagcaaaacacugcggaacaauagcaaauggcguauuacaaacauucaugagaauggcauggggcggcucauacauagcacuagacucaggaaaagguucaugggacuguauaaugacaucauaccaauaccuaauaauacaaaacacaacaugggaagaucauugccaauuuucaagacccuccccaauagguuaucuaggucuacuaucacaaagaacacgugauauauacauaucuagacgcuuacuaggaacauuuacauggacauuauccgauucagaaggaaacgaaacaccaggaggauacugucuaacccgcuggaugcuaauagaagcggaauuaaaaugcuucggaaacacagcagucgcaaaauguaacgaaaaacacgacgaagaauuuugcgacaugcuaagacuuuucgacuuuaauaaacaagcaauaagaagacuuagaacugaagcacaaaugucaauacaacuaauaaacaaagcaguaaacgcauuaauuaacgaccaacuaauaaugaaaaaccauuuaagagauauaaugggaauacccuacugcaacuacucuaaauauugguauuuaaaucauacaguaaccggaaaaacaucacuaccaaaaugcuggcucguauccaacggaucauaccuaaacgaaacccacuucucugacgacauagaacaacaagcagauaacaugauaacagaaaugcuucaaaaagaauacauagaccgacaaggaaaaacuccacuaggucuaguugacuuauuugucuuuucaaccagcuucuauuuaauuucaauauuucuacaucuaguaaaaauaccuacacacagacacguaauaggcaaaccaugcccuaaaccccacaggcuaaaccauaugggcauuuguuccugcggacuauauaaacacccaggaguaccaguaaaauggaaaagauaa

SEQ ID NO: 2743 - RNA, 1473 nt, Artificial Sequence
  derived and/or modified CDS sequence (opt6) from Lassa virus__AIT17552__GPC
augggucaaaucauuacauucuuccaagaaguaccacacguuauagaagaagucaugaacauaguccuaaucgcauuaucauuauuagcaauucucaaaggaauauacaacgucgcaacuugcggacucuucggacuugucucauuucuacuccucugcggaagaucaugcagcaccacauacaaaggaguauaugaacuacaaacauuagaacuagacauggcauccuuaaacaugacaaugccccuaucaugcacaaaaaacaauucacaccacuacaucaugguaggaaacgaaacaggauuagaauuaacauuaaccaauacauccaucauaaaccacaaauucugcaaccuaucagacgcacacaaaaaaaacuuauacgaccacgccuuaaugucaauaauuucaaccuuccauuuaucaauaccaaacuuuaaccaauacgaagcaaugucuugcgacuucaacggaggaaaaauuagcguacaauacaacuuaucucacgcauacgccguaaaugccgcaaaccauugcggaacaauagcuaauggaguacuacaaacauucaugcgaauggcuuggggcgguucuuacauagcacuagauuccggaaaaggaucaugggauugcauuaugacaucuuaucaauaccuaauaauucaaaacacaacaugggaagaccauugucaauucucccgaccaucccccauaggauaucuaggacuauuaucacaaagaaccagagauauauacauaucacgaagacucuuaggaacauuuacauggacauuaucagauagugaaggaaaugaaacaccaggagguuacugcuuaacacgauggaugcuuauagaagcagaacuaaaauguuucggaaauacagccguagcaaaauguaacgaaaaacacgacgaagaauucugcgacaugcuuagauuguucgacuucaauaaacaagcaauuagaagauuaaaaaccgaagcacaaaugucaauacaacuaauuaauaaagcaguaaacgcacuaauaaacgaccaacuaauuaugaaaaaccacuuaagagauauuaugggaauaccauacuguaacuacucaaaauauugguaccuaaaccacacaguaacaggaaaaacaagucuaccaagaugcuggcucguaucaaacggaucuuaccuuaacgaaacacacuuuucagaugauauagaacaacaagcagacaacaugauaacagaauuauuacaaaaagaauauauggauagacaaggaaaaacaccucuagguuuaguagauuuauucgucuucucaacauccuucuaccuaauaaguauauuccuacacuuagucaaaauaccaacccauagacacguaauaggcaaaccaugcccuaaaccccauagauuaaaccauaugggaauuugcucaugcggauuauacaaacaccccggagucccaguaaaauggaaaaaauaa

SEQ ID NO: 2744 - RNA, 1473 nt, Artificial Sequence
  derived and/or modified CDS sequence (opt6) from Lassa virus__AIT17556__GPC
augggacaaauaauuacauuuuuucaagaaguaccccauguaaucgaagaaguaaugaacauaguauuaauagcacuaucucuccucgcaauacuuaaaggaauauauaacguagcaaccuguggauuauuuggauuaguaucauuccuccuacuaugcgguagaucaugcucaacuacauacaaaggagucuacgaacuccaaacacuagaacuugacauggcaucacuaaacaugaccaugccacuaucaugcacaaaaaacaauucacaucacuacauaauggucggcaaugaaacaggacuagaauuaacauuaacaaacacaucuauaauaaaccacaaauucugcaaccuaucagacgcucacaaaaaaaaucuauacgaccaugcacucauguccauaauaagcacauuucacuuaucaauaccaaauuucaaccaauacgaagcaaugucaugugauuucaacggcggaaaaauaucuguacaauacaaccucucacacacauacgcaguagaugcagcaaaccauuguggaacaauugcuaauggaguacuacaaacauucaugagaauggcauggggaggaucauacauugcuuuagacuccggcagaggaucaugggacugcauaaugacaucauaccaauauuuaauaauacaaaacacaacaugggaagaucauugccaauucuccagaccaucaccaaucggauaucuaggauuacuaucacaaagaacacgagauauauacauaucaagaagacuauuagguacauucacauggacauuaucugacagugaaggaaacgaaacacccggaggauacugccuuaccagauggaugcuaaucgaagcagaacuaaaauguuuuggaaacacagccguagccaaaugcaacgaaaaacacgacgaagaauuuugcgauauguuaagauuauuugauuucaauaaacaagcaaucagaagacuaaaaacagaagcacaaaugagcauacaauuaaucaacaaagcuguaaacgccuuaauaaacgaucaacuaauaaugaaaaaccauuuacgagacauaaugggaauaccauacuguaacuauucaaaauauugguaucucaaccauaccauaacaggcaaaacaucauuaccaagauguugguuaguaucaaacggaucauauuuaaaugaaacacacuucucagacgacauagaacaacaagcagacaacaugauaacagaacuauuacaaaaagaauacauagacagacaaggcaaaaccccccuaggauuagucgacuuauuuguauucucuacuucauucuaucuaauuucaauauucuuacacuuaguaaaaauuccaacacaucgacacauaacaggaaaaccaugccccaaaccacaccgccucaaucauaugggaauaugcucauguggccucuacaaacacccaggaguaccaguucgauggaaacguuaa

SEQ ID NO: 2745 - RNA, 1473 nt, Artificial Sequence
  derived and/or modified CDS sequence (opt6) from Lassa virus__AIT17560__GPC
augggacaaauaauaacauucuuccaagaaguaccacacguaauagaagaaguaaugaacaucguacuuauugcacuaucacuccuugcaguauuaaaaggaauauacaacguagcuaccugcggacuauuuggucuaguaucauuucuccuauuauguggacguucauguucuacuacauauaaaggcguauacgaacuccaaacgcuagaauuagauauggcuucacuaaacaugaccaugccauuaucaugcacaacaaacaacucacaucacuauauaauggucggaaacgaaacaggauuagaacuaacauuaacuaacacuucaauaaucaaucacaaauucugcaauuuaucagaugcacacaaaaaaaaucuuuacgaucaugcuuuaauguccaucauaucaaccuuccacuuaucaauaccaaacuuuaaccaauacgaagcuauguccugcgacuucaacggaggaaaaauaucuguacaauauaauuuaucacaugcauaugcaggagaagcagcaaaccacugcggaacaauagcaaacggaguauuacaaacauucaugcgcauggcauggggaggcuccuauaucgcccuagacucaggaaaaggaaguugggacuguauaaugacaucauacaaauaucuaauaauacaaaacacaacauggggagaccauugccaauuuucacgacccucaccaauaggauaccuaggacuacuuucacaacgaacuagagacauauauauuucaagaagacuucuaggaacauucacuuggacauuaucagacuccgaaggaaaugaaacuccaggaggauauugcuuaacaagauggauguuaauagaagcagaacuaaaaugcuucggcaacacugcaguagcaaaauguaacgaaaaacaugacgaagaauucugcgacaugcuaagacucuucgacuucaauaaacaagcaauacgaaaacugaaaacagaagcacaaaugucaauacaacuaauaaacaaagcaguaaaugcccuaaucaacgaccaacuaauaaugaaaaaccauuuaagagauauaaugggcauacccuacuguaauuacucccgauacugguaccuaaaucauaccgucacaggaagaacaucauuaccacgaugcuggcuaguaucaaacgguuccuauuuaaaugaaacacacuucuccgacgauauagaacaacaagcagacaauaugauaacagaauuacuacaaaaagaauacauagaccgucaaggaaaaacaccauuaggacucgucgaccuauucguauucucaacaucauucuaccuaauaucaauauuccuacaccucgucaaaauaccaacacauagacacaucauaggaaaaccaugucccaaaccacacagacuaaaccacaugggcauaugcucauguggccuauacaaacaucccggaguaccaguaaaauggaaaagauaa

SEQ ID NO: 2746 - RNA, 1473 nt, Artificial Sequence
  derived and/or modified CDS sequence (opt6) from Lassa virus__AIT17564__GPC
augggacaaauaauaaccuucuuccaagaaguaccacacguuauagaagaagucaugaacauaguauuaauagcucuuucccuacucgcaaucuuaaaaggcauauacaauguagcaacaugcggacuauucggacuccucucuuuccuguuauuaugcggacgaucaugcaguacaacuuacaaaggaguauaugaacuacaaacacuagaacuagacauggcaucacuaaacaugacaaugccacuaucuugcacaaaaaacaacucacaccauuacauaaugguaggaaacgaaaccggacuagaacuaacauuaaccaacacaucaauaauaaaccacaaauuuugcaaccuaucagaugcccacaaaaaagaccuauaugaccacgcacuaaugucaauaauaucaaccuuccauuuauccauaccaaacuucaaccaauacgaagcaaugaguugcgauuucaacggaggaaaaauaucuguacaauacaaccuaucccacgcauacgcaguugaugcagcaaaacacuguggcacaauagcaaacggaguucuacaaaccuucaugcgaauggccuggggaggaucauacauagcacucgacucagguaaaggcucaugggacugcauaaugacauccuaucaauaccuaaucauacaaaacacaucaugggaagaucauugccaauuuagcagaccaucaccaauaggauauuuaggacuacuaucucaaagaacuagagauauauacaucucacgaagacuccuaggaacauucacauggacacucucagacucagaaggaaacgaaacacccggaggcuacugcuuaaccagauggauguuaauagaagccgaacuaaaaugcuucggaaacaccgccguagcaaaauguaacgaaaaacacgacgaagaauucugcgauaugcuaagauuauuugacuuuaacaaacaagcaauaaaaagacuaaaaacugaagcucaaaugucaauacaacuaauaaauaaagccguaaaugcacucaucaacgaccaacuaauaaugaaaaaccaucuaagagacauaaugggaauaccauauugcaacuacucuaaauacugguacuuaaaccacacaguaaccggaaaaacaucccuaccaagaugcugguuaguaucaaacggcagcuaccuaaaugaaacacacuuuucagacgacauagaacaacaagcagauaacaugauaacugaacuucuccaaaaagaauacaucgacagacaagguaaaacaccacucggauuagucgaucuauucguauucuccacaagcuuuuacuuaauaucaauuuuuuuacaucuaguaaaaauacccacacaccgacauguaauaggaaaacccugccccaaaccacaucgccuaaaccacaugggcauaugcucauguggauuauacaaacacccaggagucccaguaaaauggaaacgcuaa

SEQ ID NO: 2747 - RNA, 1473 nt, Artificial Sequence
  derived and/or modified CDS sequence (opt6) from Lassa virus__AIT17572__GPC
augggacaaauaauaacauucuuucaagaaguaccacacguaauagaagaaguaaugaacauaguacuaauagcacuaucccuacuugcaauacuaaaaggcaucuauaauguagcaacaugcggauuauucggauuaguauccuucuuacuacuaugcggacgaagcugcaguaccacauauaaaggaguauacgaauuacaaacacuagaacuugacauggcaaaccuaaacaugacaaugccacuaucaugcacaaaaaacaacucacaccacuacauaauggucggaaacgaaacaggacuagaauuaacacuaacaaacacaucaauaauaaaccacaaauucugcaacuuaucagaugcacacaaaaaaaaccuauacgaucacgcacuaaugucaauaauaucaacauuucaucuguccauaccaaacuucaaccaauacgaagcaaugucaugcgacuucaacgguggaaaaauaucaguucaauauaauuuaagccacaacuacgcaguagacgccgccaaccacugcggaacaauugcaaacggagucuuacaaacauuuaugcgcauggcauggggaggaucauacauagcauuagacucuggaaaaggaaacugggauugcauaaugacaagcuaccaauaucuaauaauacaaaacacaacaugggaagaccacugccaauucucccgaccuagccccauaggauaucucggauuacuuucacaaagaacccgcgacauauacauauccagacgauuauuaggcacauuuacauggacauuaucagacuccgaaggaaacgauaugccaggaggauauugccuaacccguuggauguuaauagaagcagaauuaaaaugcuucggaaacaccgcaguagcaaaaugcaacgaaaaacacgacgaagaauucugugacaugcuuagacuauucgacuuuaacaaacaagcaaucagaagauuaaaaacagaagcacaaaugaauauacaacuaauaaacaaagcaguaaacgcauuaauaaaugaccaauuaauaaugaaaaaccaucuacgagacauaaugggcauaccauauuguaacuauucaaaauacugguaucuaaaccacacaguaacaggaaaaacaagucuaccuagaugcugguuaguauccaacggauccuaucuaaacgaaacacauuuuucugacgacauagaacaacaagcugauaacaugaucacagaacuauuacaaaaagaauauauggacagacaaggcaaaacaccccuaggacuaguagaucuauucguauuuagcacaucauucuaucuaauaaguauauuccuucaccuaguuaaaauaccaacccacagacauauaauaggcaaaccauguccaaaaccacaccgacuaaaccacaugggaauaugcucauguggccuauacaaacacccaggaguaccaguaaaauggaaaagauaa

SEQ ID NO: 2748 - RNA, 1473 nt, Artificial Sequence
  derived and/or modified CDS sequence (opt6) from Lassa virus__AIT17576__GPC
augggucaaauaauaacauucuuucaagaaguaccccauguaauagaagagguaaugaacauaguccuaauagccuuaucauuauuagcaauacucaaaggaauauacaacguagcaacuugcggauuauuuggacuaguauccuuccuauuacucugcggccgaucuugcucuacaacauauaaaggaguauacgaauuacaaacacucgaacuagacauggcaucucuaaauaugacaaugccacuaucauguacuaaaaauaacucacaucacuauauaaugguaggaaacgaaaccggucucgaauuaacacuaaccaauacaagcauuaucaaccauaaauucugcaaccuaucagacgcacacaaaaaaaacuuauacgaccacgcacuaauguccaucauaucaacauuccaccucucaauaccaaacuucaaucaauaugaagcaaugucaugcgacuucaauggcggaaaaauaucaguucaauacaaccuaucccacacuuacgcaguagacgcagcaaaucauuguggaacaauagcuaauggcguucuacaaacauucaugcguauggcaugggguggaucuuacauagcuuuagacucuggaaaaggcaacugggacugcauaaugacauccuaucaauaccucauuauacaaaacacaacaugggaagaucacugccaauucucacgaccuucaccaauaggauaucuaggacuauuaucccaaagaacaagagacaucuauauaucaagaagauuacucggaaccuucacuuggacucuaucugacucagagggaaacgaaacaccaggaggauauugcuuaacaagauggaugcuaauagaagcagaauuaaaaugcuucggaaauacggcaguagcuaaaugcaaugaaaaacacgacgaagaauucugcgacauguuacgacuauucgacuucaacaaacaagcaauuucaagauuaaaaacagaagcacaaaugucuauacaacuaauaaacaaagcaguaaaugcccucaucaaugaucaauuaauaaugaaaaaccaccuuagagacauaaugggaauaccauauugcaacuacucaaaauacugguaucuaaaccacaccguaacaggcaaaaccucacucccaagaugcuggcuuguaucaaacggaucuuacuuaaaugaaacccacuucucagaugacauagaacaacaagcagacaacaugauuacagaaaugcuacaaaaagaauauauagauagacaaggaaaaacuccacuaggacuaguagaccuuuuuguuuucucaacaucauucuaccuaauaucaauuuucuuacaucuaguaaaaauccccacacacagacacauaacagguaaaccaugccccaaaccacacagacucaaccauaugggaauaugcucauguggacuuuauaaacauccaggcgucccaguuaaauggaaaagauga

SEQ ID NO: 2749 - RNA, 1473 nt, Artificial Sequence
  derived and/or modified CDS sequence (opt6) from Lassa virus__AIT17580__GPC
augggacaaauuauaacauucuuccaagaaguaccacacguaauagaagaaguaaugaauauaguacuaauagcacuauccuuauuagcaauacuaaaagguauauauaacguagcaacauguggccuauuuggucuaguaucauuccuauuacuaugcggcagaucuugcucaacaacauauaaaggaguauacgaacuacaaacacuagaacuagacauggccucauuaaacaugacaaugccacuauccuguaccaaaaauaauagucaccauuacauaaugguaggaaacgaaacaggauuagaauuaacacuaacaaacacaucaauaauaaaccacaaauucugcaacuuaagugaugcccacaagaaaaauuuauacgaccaugcacuaaugucuauaaucagcacuuuccaccuaucaauaccaaauuucaaucaauacgaagcaaugucaugcgacuuuaacggaggaaaaauaucaguacaauauaaccuaucccacacauacgccguagaugcagccaaucacuguggaacaauagcaaacggagucuuacaaaccuuuaugagaauggcuuggggcggaucauauauagcacuagacuccgguaaaggaucuugggacugcauuaugacauccuaccaauaccuaauaauacaaaauaccacaugggaagaucauugccaauucucaagaccaucaccaauaggauacuuaggcuuauuaucacaaagaaccagagacauauacauuucacgaagacuacuaggaacauucacauggacauuaucugacucagaaucaaacgaaacacccggagguuacugcuuaacaagauggaugcucauagaagcagaacuaaaaugcuucggaaauaccgcaguagcaaaaugcaaugaaaaacacgacgaagaauuuugugacaugcuaagauuauuugacuucaauaaacaagcaauaagaagacuaaaagcagaagcacaaaugucaauccaauuaauuaacaaagccguaaacgcacucauaaaugaccaauuaauaaugaaaaaucaucucagagauaucaugggaauaccuuacuguaauuacuccaaauacugguacuuaaaccacacaguaacuggccgaaccucucuacccagaugcuggcuaguauccaacggaucauaccucaacgaaacacauuucucagacgacauagaacaacaagccgauaacaugauaacagaauuauuacaaaaagaauauauggacagacaaggcaaaacaccacuaggucuaguagaccuauucguauucuccaccucauucuaccuaauaucuauauucuuacaccuuguaaaaauaccaacacaucgacacguuaucggaaaaccaugcccaaaaccacacagacuaaaucacaugggaauaugcucuuguggacuauauaaacacccaggaguaccggucaaauggaaacgauaa

SEQ ID NO: 2750 - RNA, 1473 nt, Artificial Sequence
  derived and/or modified CDS sequence (opt6) from Lassa virus__AIT17584__GPC
augggacaaauaauaacauucuuccaagaaguaccacaaguaaucgaagaagucaugaauaucguauuaauagcacucucacuacuagcaauacuaaaagguaucuacaacguagcaaccuguggauuauucggucuagucucauuccuucuccucuguggaagaucauguucaacaacuuauaaaggaguauacgaacuacaaacucuugaacuugacauggcaucauuaaacaugacaaugccacuaucaugcaccaaaaacaacucacaucacuacauuauggucggaaacgaaacaggauuagaauuaacacucacaaaccaaucaauaauaaaccacaaauuuugcaaucucucagaugcacacaagaaaaaccuauacgaccacgcauuaaugucuauaauaucaacauuccauuuaucaauuccaaacuucaaucaauacgaagcaauguccugugacuuuaacggaggaaaaauuucaguacaauacaacuuaucacacucauuugcuguagaugcagcaaaccacugcgguacaauagcaaauggaguuuuacaaacauucaugagaauggcuuggggaggauccuacauagcccuagacuccggaaaaggaucaugggacuguauaaugaccagcuaccaauaccuaauaauacaaaacacaacaugggaagaccauugucaauucucaagaccuucaccaauagguuaucuaggacuccucucacaaagaacaagagacauauacauaucaagacgacuauuaggaaccuucacuuggacacuaucagauucugaagguaacgaaacaccaggaggauacugccuaaccagauggaugcuaauugaagcagaauuaaaauguuucgguaauacagcaguagccaaaugcaacgaaaaacacgaugaagaauuuugcgauaugcuacgccuauucgacuucaacaaacaagccauaagaagacuaaaaacagaagcacaaauguccauacaauuaaucaauaaagccguuaacgcauuaauaaacgaccaauuaauaaugaaaaaccaccuacgagacauaaugggcaucccauacuguaauuacucaaaauacugguaccuaaaccacaccaaaacagguaaaacaagccuacccagaugcugguuaguaucuaacggaucauauuuaaacgaaacccacuucuccgacgacaucgaacaacaagcagacaauaugauaaccgaacuacuccaaaaagaauauauggaccgucaagguaaaacaccccuaggucuaguagaccuauucguuuucucuacuucauucuaccuaauaucaauauuucuucaucuaguuaaaauaccaacacacagacacguaauaggaaaaccaugcccaaaaccacauagacuuaaccacaugggaauuugcuccuguggacuauacaaacacccagguguacccgucaaauggaaaagauaa

SEQ ID NO: 2751 - RNA, 1473 nt, Artificial Sequence
  derived and/or modified CDS sequence (opt6) from Lassa virus__AIT17588__GPC
augggacaaaucauaacauucuuucaagaaguaccacacguaauagaagaaguaaugaacauagucuuaauagcauuaucucuacuagcaauauuaaaaggaauauacaacgucgcaacauguggucuauucggacuaguuucauucuuauuacuaugcggacgaucauguucaacaacuuacaaaggcguuuacgaacuucaaacacuagaacuugauauggcaucacuaaacaugacaaugccacuaucaugcacuaaaaacaauucccaccacuacauaauggucggaaacgaaacaggacuagaauuaacacuaacaaauacaucaauaauaaaccauaaauucuguaauuuauccgaugcacauaaaaaaaaccuuuacgaccaugcauuaaugucuauaauaucaacuuuccaccuauccauccccaacuucaaccaauaugaagcaaugucaugcgauuucaacggcggaaaaauaucuguccaauauaaucuaucacacgcauacgcaguagacgccgcuaaccacugcggaacaauagcaaacggcguacuacaaacauucaugagaauggcuuggggaggcucauacauagcacucgauucuggaaaaggauccugggacugcauaaugacaucauaucaauaccuaauaauacaaaacacaacuugggaagaucauugccaauucucacgcccaucuccaauugguuaccuaggccuacuaucacaacguacuagagacauuuacauuuccagacgcuuauuaggcacauucacauggacacuuucagacucugaaggaaaugaaacaccaggaggauacugccucacaagauggaugcuaauagaagccgaacuaaaaugcuucggaaacacagcaguagcuaaaugcaacgaaaaacacgaugaagaauucugugauaugcuuagauuauucgacuucaacaaacaagccaucagacgauuaaaagcagaagcucaaaugucuauacaauuaauaaacaaagcaguaaacgccuuaauuaacgaucaauuaauaaugaaaaaccacuuaagagacauaaugggaauaccauacugcaauuacucuaaauacugguacuuaaaccacaccguaacuggcaaaacuucacuaccacgaugcugguuagucucuaacggaucauaucuuaaugaaacacauuucucagacgacauagaacaacaagccgacaacaugaucacagaauuacuccaaaaagaauacauagacagacaaggaaaaacaccccuaggacucguagacuuauucguauucucaacuucuuucuaccuuaucucaauuuuccuacacuuaguaaaaauaccaacacacagacacguaauuggcaaaccauguccaaaaccucaccguuuaaaucacaugggaauaugcuccuguggacuauacaaacacccaggaguaccagucaaauggaaaagauaa

SEQ ID NO: 2752 - RNA, 1473 nt, Artificial Sequence
  derived and/or modified CDS sequence (opt6) from Lassa virus__AIT17592__GPC
augggccaaauaauaacauucuuucaagaaguaccacacgucaucgaagaggucaugaacauaguacuaauagcacuuucuuuauuagcuauacuaaaaggcauauacaacguagcaacuugcggacucuucggacuaguaucuuuccuccuccucuguggucgauccugcucaaccacuuacaaaggagucuacgaacuacaaacacuagaacuagacauggcuucacucaauaugacaaugccacucucauguacaaaaaacaacucccaucacuacauaaugguaggaaacgaaaccggcuuagaauuaacacuaacaaauacaucuauaauaaaucacaaauucuguaacuuaucagacgcacacaaaaaaaaccuauaugaucacacucuaauguccauaauauccaccuuccauuuaucaauaccaaacuuuaaccaauaugaagcaaugagcugcgacuuuaauggaggcagaauauccguacaauauaaucuaucucacgccuacgcuguugaugcagcaaaccacuguggaacaauagcaaauggaguauuacaaacauucaugagaauggccugggguggcuccuacauugcacuagauuccggcaaaggauccugggauugcauuaugaccuccuaccaauaccuaauaauacaaaacaccacaugggaagaccauugucaauucagccgaccaucaccaauaggauacuuaggcuuacuuucacaacgaacaagagacauauauauaucacgccgauuacucggaaccuucacauggaccuuaucugacucugaaggcaacgaaacaccaggaggauacugucuaaccagauggaugcuaauagaagcagaacuaaaauguuuuggaaacaccgccguagcaaaaugcaacgaaaaacacgaugaagaauucugcgauauguuaagauuauucgacuucaauaaacaagcuaucagacgacuaaaaacagaagcacaaaugucaauacaacuaauaaauaaagcagucaacgcacuaauuaaugaucaacuaaucaugaaaaaccacuuaagagacauaaugggaauaccauauuguaacuacucaaaauacugguacuuaaaccacacaauuaccggaaaaacaucacuaccaagauguugguuagucucaaacgguagcuaucuaaaugaaacacacuuuucagacgacaucgaacaacaagcagacaacaugauaacagaacuauuacaaaaagaauauauagauagacaaggaaaaacaccuuuaggacuaguagaccucuucguuuucucaacaucauucuaucuaauaucaauauuccuacacuuaguaaaaauacccacacauagacacguaguaggaaaaccaugcccaaaaccacaucgauuaaaccacaugggaaucuguagcuguggauuauacaaacaccccggaguaccaguuaaauggaaaagauaa

SEQ ID NO: 2753 - RNA, 1473 nt, Artificial Sequence
  derived and/or modified CDS sequence (opt6) from Lassa virus__AIT17596__GPC
augggucaaauaauaacauucuuccaagaagugccacauguaauagaagaaguaaugaauaucguauuaaucgcauuaucauuacucgcaauacuaaaagguauauauaacguagccacuugcggauuauuuggccuaguaaguuuccuuuuacuaugcggaagaucgugcucaacaacauacaaaggagucuacgaauuacaaacacuugaacucgacauggcuucuuuaaacaugacaaugccauuaucaugcacuaaaaauaacucacaucauuauauaaugguuggaaaugaaacaggauuagaacuuacacuuacaaacacaucaauaaucaaucauaaauuuugcaauuuaucagaugcacacaagaaaaaccuauaugaccacgcauuaaugucaauaauaucaacauuccauuuaucuauuccaaauuuuaaccaauaugaagcaaugucaugugacuucaacggaggaaaaauauccguccaauacaacuuaagccacacauacgcaguagacgccgcaaaucacugcggaacaauagcaaacgguguacuacaaacuuucaugagaauggcauggggcggaucuuacauagcgcuugauucuggaaaaggcucuugggauugcaucaugacaucuuaccaauacuuaauuauacaaaacaccuccugggaagaccacugccaauuuucaagaccaucaccuaucggauaucuaggauuauuaucccaaagaaccagagauauauauauaucuagaagacuccucggcacauuuacauggacauuaucagacuccgaaggaaacgaaacccccgggggauacugucuaacaagauggaugcuaauagaagcagaauuaaaauguuuuggaaacacugcaguagcaaaaugcaacgaaaaacacgacgaagaauuuugcgauaugcuaagacuauucgacuucaacaaacaagccauucgcagacuaaaaaccgaagcacaaaugucaauacaacuaauaaacaaagcaguaaacgcacucauaaacgaccaauuaauaaugaaaaaccaccuaagagacauuaugggaauaccauacugcaacuacucaaaauauugguacuuaaaucacaccguaacaggaaaaacaucccuaccaagauguuggcuaguaucaaacggauccuaccuaaaugaaacacacuucucagacgacauagaacaacaagcagacaacaugauaaccgaacuauuacaaaaagaauauauagaccgacaaggaaaaaccccacuaggacugguugaccuuuucguauucagcacaucauucuaccuaauaucaaucuuccuacaccuaguaaagaucccaacacauagacacguaauaggaaaaccauguccuaaaccacacagauuaaaucacaugggcauauguaguugcggacucuacaaacacccaggagucccaguaaaauggaaaagauaa

SEQ ID NO: 2754 - RNA, 1473 nt, Artificial Sequence
  derived and/or modified CDS sequence (opt6) from Lassa virus__AIT17600__GPC
augggucaaaucauaacauuuuuucaagaagucccacacguaaucgaagaaguaaugaauauaguacuaaucgcacucucacuacuagcaauacuaaaagguauauauaacgucgccaccugcggacuauucgguuuagucucauuccuccuuuuauguggucgaucauguucaacaacauacaaaggagucuacgaauuacaaaccuuagaauuagacauggccucauuaaauaugaccaugccacuaucaugcacaaaaaacaacucccaccacuacauaauggucggaaaugaaacuggacuagaauuaacacuuacaaauacaucaauaauuaaccauaaauucuguaaucucucagacgcacauaaaaaaaaucuauacgaccaugcacuaaugucaauaauaucaaccuuccacuuaaguauaccaaauuucaaucaauaugaagcaaugucaugcgauuucaaugguggaaaaaucucaguacaauauaacuuaucucacgccuaugcaggagaugcagcaaaccacugcggaaccauagccaacggaguacuacaaacuuucaugcgaauggcauggggcggauccuacaucgccuuagacucaggaaaaggaaguugggauugcauaaugaccucauaccaauaucuaauuauacaaaacacgacaugggaagaucacugucaauucucaagaccauccccuauaggauauuuaggucuacuaucacaaagaacucgagacauauauauaucaagaagacuacuagguacuuuuacauggacacuauccgacucagaaggaaacgaaacccccggaggauacugccucacuagauggauguuaauagaagcagaacuaaaaugcuuuggcaauacugccgucgcuaaauguaaugaaaaacaugaugaagaauucugcgauaugcuuagacuauucgacuuuaauaaacaagcaauuagaagauuaaaaacagaagcacaaaugucaauucaauuaaucaacaaagcaguaaacgcucucauaaacgaccaauugaucaugaaaaaucaccuuagagacauaaugggaauaccauacugcaacuauuccaaauacugguaccuaaaccacaccguaacaggaaaaaccucacuacccagaugcuggcucgucucaaacggaucauacuuaaacgaaacacacuucucagaugacauagaacaacaagcagacaacaugauaacagaacuacuucaaaaagaauacauagacagacaaggaaaaacaccucuaggacuuguagaccuuuuuguauuuuccacaagcuuuuaucuaauaaguauuuucuuacaccuaguaaaaauaccuacacaucgucacguaauaggaaaacccugccccaaaccacauagacuaaaccacauggguaucugcagcugcgguuuauacaaacaccccggagucccaguaaaauggaaaagauaa

SEQ ID NO: 2755 - RNA, 1473 nt, Artificial Sequence
  derived and/or modified CDS sequence (opt6) from Lassa virus__AIT17604__GPC
augggacaaauuaucacauucuuucaagaaguaccucauguaauagaagaaguaaugaacauaguacucauagcacuaucacuacuagcaauacucaaaggaaucuauaacguagccacaugcggauuauucggacucguaucuuuucuauuauuauguggacgaucauguucaaccaccuacaaaggcguauacgaauuacaaaccuuagaacuagacaugacuucuuuaaacaugacaaugccauuauccugcaccaaaaacaacagccaucacuacauaaugguaggaaaugaaacaggcuuagaacuaacccuaacuaacacaucaauaauaaaucacaaauuuugcaauuuaucagacgcacacaagaaagaucuauacgaccaugcucuaaugucaauaauauccaccuuccauuuaucaaucccaaacuucaaccaauacgaagcaaugucaugcgacuucaacggaggaaaaaucuccguacaauacaaccuaucccacacauaugcaguagacgcagcaaaacauugcggcacaaucgcuaauggaguacuacaaacauucaugagaauggcuuggggaggaucauacauagcacuagacucaggaaaaggaucuugggacugcauaaugacaucuuaccaauaucuaauaauccaaaacacaacaugggaagaccacugccaauucucaagacccuccccaguaggauacuuaggguuacuaucucaaagaacaagagacauauacauauccagaagauuauuaggaacauucaccuggacacuauccgacucagaaggcaacgaaaccccaggagguuacugccuaaccagauggaugcuaaucgaagccgaauuaaaaugcuucggaaauacagcagucgcaaaauguaacgaaaaacacgacgaagaauuuugcgacaugcuuagacuauucgacuuuaacaaacaagcaauuagaagacucaaaacugaagcacaaaugucaauacaauuaauaaauaaagcaguaaaugcacuaauuaacgaccaauuaauaaugaaaaaccacuuaagagacaucaugggcauaccauauuguaauuacucaaaauacugguaccuaaaccauacuguaacaggaaaaacaucacuaccaagaugcuggcucgucuccaacgguucauaucuaaacgaaacacauuuuucagacgacauagaacaacaagcagauaacaugaucaccgaauuacuacaaaaagaauacuuagaccgacaaggaaaaaccccacuaggccuaguagacuuauucguauucucaacaucauucuaccucauaucaauauuccuacaccucguaaaaauuccaacccaccgacauguaauaggcaaaccaugcccaaaaccacacaggcuaaaccacaugggcauaugcucuugcggacuuuauaaacacccaggaguaccuguaaaauggaaaagauaa

SEQ ID NO: 2756 - RNA, 1473 nt, Artificial Sequence
  derived and/or modified CDS sequence (opt6) from Lassa virus__AIT17608__GPC
augggacaaauaauaacuuucuuccaagaaguaccacacguaauagaagaagucaugaauaucguauuaauagcccucagcuuauuagcuauacuaaaaggaauauacaacgucgcaaccugcggucuauucggauuaguaucuuuccuacuacuauguggcagaagcugcucuacaacauauaaaggaguauaugaacuacaaacacuagaacucgacauggcaucacuaaacaugacaaugccuuuaucuugcacuaaaaacaauucacaccauuauaucauggucggaaacgaaacaggcuuagaacucacauuaacaaauacaucaauuaucaaucacaaauucugcaaucuaucggacgcccacaaaagaaaccuauacaaccaugcacuaaugucaaucauaucuacuuuccauuuaucaaucccaaacuucaaccaauacgaagcuaugucaugcgacuucaacggaggaaaaauauccguccaauauaaucuuucacacaccuaugcuguagacgccgcuaaccacuguggaacaaucgcaaauggaguccuacaaacauuuaugagaauggcaugggguggcagcuauauagcacuagacagcggaaaaggaucaugggauuguaucaugacauccuaccaauaucuaauaauacaaaacacaacaugggaagaccacugccaauucucuagacccucaccaauaggauaccuaggauuacuaucucaaagaacacgagacauauacauaucaagaagauuacuaggaacauuuacauggacccuaucagacagugaaggaaacgaaacaccaggaggauacugucucacacgauggaugcuuauagaagcugaacuaaaaugcuucggaaacacagcaguugccaaauguaaugaaaaacacgacgaagaauuuugcgauauguuaagauuauuugacuucaauaaacaagcaauaagaagacuaaaaacagaagcacaaaugagcauacaacuaauaaacaaagcaguaaaugcucuuauaaacgaccaacuuauaaugaaaaaucaucucagagacaucaugggaauaccuuacugcaacuacuccaaauacugguaccuaaaucacacuguaacaggaaaaacaucccuaccccgauguuggcuagucucaaacggcucauaccuaaaugaaacccacuucucagaugacauagaacaacaagcagauaacaugauaacagaauuauuacaaaaagaauacauagacagacaaggaaaaacaccccuaggccuaguugauuuauuugucuucuccacaucauucuaccucaucuccaucuucuuacaccuaguaaaaauaccaacacauagacacauaauaggaaaaccaugcccaaaaccacacagauuaaaucauaugggaauaugcuccuguggacuauacaaacauccaggaguaccaguaaaauggagaagauaa

SEQ ID NO: 2757 - RNA, 1473 nt, Artificial Sequence
  derived and/or modified CDS sequence (opt6) from Lassa virus__AIT17612__GPC
augggacaaauaauaacauuuuuucaagaagucccacauguaauagaagaaguuaugaauaucguacuaauagcacuaagccuacucgcaauauuaaaaggaauauauaauguagcaaccugcggucuauuuggacuagucucauuccuacuauuauguggaagauccugcucaaccacauacaaaggaguauacgaacuacaaacacuagaauuagacauggccucacucaacaugaccaugccccuaucauguacaaaaaauaacucacaccacuauauacgaguuggaaaugaaacaggucuagaacuuacauuaacaaacacaucaauuauaaaucacaaauucugcaacuuaucagacgcacacaaaaaaaauuuauacgaccauucauuaaugucaauaauaucaacauuucacuuauccauaccuaacuuuaaccaauacgaagcaaugucaugugacuucaacggcggaaaaauauccguccaauacaaccuaucccacacauaugccguagaugcagccaaccacugcggaaccauugccaauggaguacuacaaacauucaugagaauggcauggggaggaucauacauagcacuagauucuggcaaaggaaacugggacugcauaaugaccucauaccaauacuuaaucauacaaaacacaacaugggaagaucacugccaauucucucgaccaucucccauaggauaccuaggacuauuaucccaaagaacacgagauauauauauaaguagacgccuacucggaacauucacauggacacuaucagacuccgaaggaaaugaaacuccaggagguuacugccuaaccagauggaugcuaauagaagcagaauuaaaaugcuucggaaacacagcaguagcuaaaugcaaugaaaaacaugacgaagaauucugcgauauguuaagauuauuugacuucaacaaacaagcaaucagacgacuaaaaaccgaagcccaaaugucaauccaacuaauaaacaaagcaguaaacgcacucauaaacgaucaacuaauaaugaaaaaccaccuacgcgauauaauggguauaccauacugcaacuauuccaaauacugguaccucaaucauacaguaacaggaaaaacaucucucccacgaugcugguuaguaucaaauggcucauaucuuaacgaaacccacuuuucagacgauauagaacaacaagcugacaacaugaucacugaacuccuacaaaaagaauauauagauagacaaggaaaaacaccucuaggauuaguagaccucuucguuuucucaaccucauucuacuuaauaucaauauucuuacaccuuguaaaaauccccacacacagacauguuguaggaaaaccauguccaaaaccccacagauuaaaccacauggguauaugcuccugcggacuauacaaacacccaggaguaccagucaaauggaaacgauaa

SEQ ID NO: 2758 - RNA, 1473 nt, Artificial Sequence
  derived and/or modified CDS sequence (opt6) from Lassa virus__AIT17616__GPC
augggucaaauuauaacuuucuuccaagaaguaccccacguaauagaagaagucaugaauauaguacuaauagcauuaucacuauuagccaucuuaaaaggcauauacaauguagcaacaugugguuuauucggccuaguauccuucuuacuacuuugcggaagaucaugcucaacaacauacaaaggaguauacgaacuacaaacauuagaacuugacauggcuucacuaaacaugacaaugccuuuaucuugcacaaaaaacaacucucaccacuacauaaugguaggaaacgaaacaggacuugaacuaacacuaacaaacacaucaauaauaaaccauaaauuuuguaaccuaucagacgcacauaaaaaaaacuuauacgaccacgcacuaaugucaauaauuucuacauuccaccuaaguaucccaaauuucaaucaauaugaagccaugucaugcgacuucaacgguggaaaaauaucaguacaauacaaucucucucaugccuacgcaguagaugcagccaaucacuguggaacaauugcaaacggaguccuccaaacauucaugagaauggcaugggguggaucauacauagcucuagacuccggaaaagguucaugggacuguauaaugacauccuaccaauauuuaauaauacaaaacacaacaugggaagaucacugccaauucucaagaccaagcccaauaggauacuuaggacuacuaucccaacgaaccagagacauauacauaucaagaagacuacuagguacuuucacauggacauuaucagacucagaaggaaaugaaacacccggaggauauuguuuaacaagauggaugcuaauagaagcagaacucaaaugcuucggaaacacugccguugccaaaugcaaugaaaaacaugacgaagaauuuugcgacauguuaagauuauuugacuucaauaaacaagcaauaagaagacuaaaaacagaagcacaaaugaguauacaacuaaucaacaaagcaguaaacgcucuaauaaaugaucaacuaauaaugaaaaaccaucuaagagauaucaugggaauuccauacuguaacuacuccaaauauugguaccuuaaccacacagucacaggaaaaacaucacuaccuagaugcuggcuaguaucaaauggaucuuaccuaaacgaaacacacuucucagaugacauagaacaacaagccgauaacaugauaaccgaauuacuacaaaaagaauacauagauagacaaggaaaaacaccacucggacuaguagaucucuucguuuuuucuacauccuucuaccuuaucucaauauuucuccaucuaguaaaaauaccaacccaccgucauguaauaggcaaaccaugcccuaaaccacauagauuaaaccacaugggaauaugcuccugcggauuauauaaacacccaggcguaccaguaaaauggaaaagauaa

SEQ ID NO: 2759 - RNA, 1473 nt, Artificial Sequence
  derived and/or modified CDS sequence (opt6) from Lassa virus__AIT17620__GPC
augggacaaauaauaacauucuuccaagaaguuccacacguaaucgaagaaguaaugaacauaguucuuauagcacucucacuucuagccauacucaaaggaauauauaacguagcaacaugcggacuauuuggguuagucuccuuucuauuauuaugcggaagauccuguucuacaaccuacaaagguguauacgaacuacaaacauuagaauuagacauggcaucccuaaacaugaccaugccccuaucaugcacaaaaaacaacucacaccauuauauaaugguaggaaaugaaaccggacuagaacuaacacucacaaacacaagcauaauaucucacaaauuuugcaaucuauccgacgcacacaaaaaaaauuuauaugaccaugcacuaaugucuauaauaucaaccuuccaccuaucuauaccaaacuuuaaccaauacgaagccaugucaugugacuucaacgguggaaaaaucuccguacaauauaaucucucccacgcauaugcuaucgaugccgcaaaccacugcggaacaguagcuaauggaguucuacaaacauucaugagaauggccuggggcggaucuuauaucgcacuagauucaggcaaaggaucaugggacugcauaaugacauccuaccaauaucucauaauacaaaauaccaccugggaagaccacugccaauucucaaggccaucuccaauuggauaucuaggacuauuaucacaaagaacccgcgacauuuauauaucaagacgucuccuuggaacauuuacauggacuuuaucagacucagaaggaaacgaaacuccaggaggauacugucuaacaagauggaugcuaauagaagcagaacuaaaaugcuucggcaauacagcagucgccaaaugcaacgaaaaacaugacgaagaauuuugcgacaugcuaagacuauucgacuucaauaaacaagcaauaagaagacuaaaagcagaagcacaaaugucuauacaauuaauaaacaaagcagucaacgcacuaaucaacgaccaacuaauaaugaaaaaucaucuaagagacauaaugggaauccccuacugcaacuauucaaaauacugguaucuaaaccacacaguaacaggaaaaacaucauuaccaagaugcugguuaguaucuaauggcucauaccuaaacgaaacucacuuuucagaugacauugaacaacaagcggacaauaugauaaccgaacucuuacaaaaagaauacauggacagacaaggcaaaacaccauuaggucuagucgacuuauucguauucucaacaucauucuaucuaauaucaauauuccuccaccuuguaaaaaucccaacacaccgacacgucauaggcaaaccaugucccaaaccacaccgauuaaaccacaugggaauauguucauguggacuuuauaaacacccaggaguaccaguuaaauggaaaagauaa

SEQ ID NO: 2760 - RNA, 1473 nt, Artificial Sequence
  derived and/or modified CDS sequence (opt6) from Lassa virus__AIT17626__GPC
augggacaaauaauaacauucuuucaagaagucccacaugucaucgaagaagucaugaauauaguacuaaucgccuuaucacuauuagcaauauuaaaaggaguauacaaugucgcuaccugcggauuauuuggauuaguaucuuuucuauuauuaugcggaagaucauguucaacaacauauaaaggcguauacgaacuacaaacucucgaauuagacauggcaucacuuaacaugaccaugccauuaucaugcaccaaaaauaacucacaccauuacaucauggucggaaaugaaacaggacuagaacuaacacuuacaaauacaucuauuauacaacacaaauucugcaaucuaucagacgcccacaagaaaaaccuauaugaccaugcacuaaugucaauaauaucaacauuucaccucucuauaccaaacuuuaaucaauaugaagcuaugucuugcgauuuuaacggcggcaaaauuacuguacaauacaacuuaucacacucauacgcaauagacgcagcaaaccauuguggaacaauagcuaauggcgucuuacaaacauuuaugagaauggcauggggaggaucauacauugcauuagauucaggcaaaggaucaugggacuguauaaugaccucuuaccaauaucucauaauacaaaacacaacaugggaagaucacugccaauucuccagaccauccccaaucgguuaccuaggccuccuaucacaaagaaccagagacauauacauaucuagacgacuacucggaacauucacuuggacucuauccgacucagaaggcaacgaaacaccaggaggauacugcuuaacaagauggaugcuaauagaagcagaacuaaaauguuuuggaaauacagccguugccaaauguaaugaaaaacaugaugaagaauuuugugacaugcuccgacuauuugauuuuaauaaacaagccauaagaagacuaaaaaccgaagcccaaauguccauacaacucaucaacaaagcagucaacgcucuaauaaacgaccaacuaauaaugaaaaaucaccuaagagacauaaugggaauaccauacugcaauuacuccaaauauugguaccuaaaucauacagucaccggcagaacaucauuaccaagaugcuggcuaguaucuaacggaucauaccuaaaugaaacacauuucucagacgacauagaacaacaagcagauaauaugaucaccgaacuacuccaaaaagaauauauggacagacaaggaaaaacuccacuaggccuaguagaccuuuuugucuuuucaacaucauucuaccuaauaucuauauucuuacaccuuguaaaaaucccaacacauagacacauaauaggaaaacccuguccaaaaccccacagacuaaaccacaugggaguauguucaugcggauuauauaaacacccaggaguaccaguaaaauggaaaagauga

SEQ ID NO: 2761 - RNA, 1473 nt, Artificial Sequence
  derived and/or modified CDS sequence (opt6) from Lassa virus__AIT17630__GPC
augggucaaauaauaacauucuuucaagaaguaccacauguuauugaagaaguaaugaacaucguucucauugcauuaucacuauuagcaaucuuaaaagguauauacaacguagcaacaugcggacucuucggacuacuaucauuccuacuacuaugcgguagaucaugcucaacaacuuauaaaggaguauacgaacuacaaacacuagaauuagacauggccagccuaaacaugacaaugccacuaucaugcacaaaaaauaacucacaccauuacauuaugguaggaaacgaaacaggauuagaacuuacauuaaccaacacaucaaucauaaaccacaaauuuuguaacuuaucagacgcccauaaaaaaaaccuauaugaccaugcccuaauguccauaauauccacauuccaucucucaaucccaaauuuuaaccaauacgaagcaaugagcugcgacuuuaaugguggaaaaauuucaguacaauacaaccuaucacaugcauaugcaguagacgccgccgaacacuguggaacaaucgcuaacggaguacuacaaacauucaugagaauggcauggggaggauccuauauagcacuugacuccggaaaaggaucaugggauugcguuaugacuucauaccaauacuuaaucauccaaaacaccucaugggaagaccacugucaauuuucacgaccaucaccaauaggauaccuaggacuacuaucacaaagaaccagagacaucuacauaucaagaagacuucuaggaaccuucacauggacacuaucugauucagaaggaaacgaaacaccaggaggauacugccuaacacgauggauguuaauagaagcagaauuaaaaugcuucggaaauacagccguagcuaaaugcaaugaaaaacacgaugaagaauucugugauaugcucagauuauuugacuucaauaaacaagccauaagacgacucaaaacugaagcacaaaugucaauucaacuaauaaauaaagcaguuaacgccuuaaucaaugaccaauuaauaaugaaaaaccaccuacgagauauaaugggaauaccauauugcaacuauucaaaauacugguauuuaaaccacaccguaacaggaaaaacaucacuaccaagaugcuggcuaguaucuaacggcucuuacuuaaacgaaacacauuucucagaugacauugaacaacaagccgacaacaugauaacagaacuucuccaaaaagaauacauagauagacaaggcaaaacuccccuaggacuaguugaccucuucguauuuucaacaucauucuaucuaauuucaauauuccuccaccuaguaaaaauaccaacacacagacacguuauaggaaaaccaugcccaaaaccacaucgucuaaaccauaugggcauauguucauguggacuauacaaacauccaggcguaccaguaaaauggaaaagauaa

SEQ ID NO: 2762 - RNA, 1473 nt, Artificial Sequence
  derived and/or modified CDS sequence (opt6) from Lassa virus__AIT17634__GPC
augggucaaauaauaacauucuuccaagaaguaccacaugucauugaagaaguaaugaacauaguacuaaucgcauugucauuacucgcaauauuaaaagguauauauaacguagcaacaugcggccucuucggacuaguuucauuucuacuauuaugcgguagauccuguucaacaauauacaaagacguuuacgaacuucaaacauuagaacuagacauggccucccuaaacaugaccaugccauuaucaugcacaaaaaauaacucccaucauuacauaaugguaggaaacgaaacaggcuuagaacuuacccuaacaaauacaucuauaauaaaccacaaauucugcaaucuauccgacgcucacaaaaaaaauuuauacgaucacgccuuaaugucaauaauaucaacauuccaucuaucaauaccaaauuucaaccaauacgaagcaauguccugcgacuucaacggcggaaaaauaucaguacaauauaaucuaucccacacauacgccauagaugcagccaaucauuguggaaccauagcaaacggaguacuacaaacuuucaugagaauggcauggggagguagcuacaucgcacuagacucaggcaaaggaucaugggauuguaucaugacaucauaccaauaucuaauaauucaaaauacuacaugggaagaucacugccaauucucuagaccauccccaaucggcuacuuaggacuccuaucacaaagaacuagagacauauauaucucaagaagacuacuaggaacauucacauggacacuaucagauucagaaggaaacgaaacaccaggaggauacugucuaacaagauggaugcuaaucgaggccgaacuaaaaugcuucggaaauaccgccguagcaaaaugcaacgaaaaacacgacgaagaauucugcgauauguuaagacuauucgauuucaauaaacaagcaauaagaagacuaaaaacagaagcucaaaugucuauacaacuaauaaauaaagcaguaaacgcacuaauuaacgaucaacuaauaaugaaaaaccacuuaagagauauaaugggaauuccauauugcaauuacucaagauacugguaccuaaaucauaccguaacaggacgaacaucauuaccuagauguugguuaguaucaaacgguucguaucuaaacgaaacccacuucuccgacgacauagaacaacaagcagacaacaugauaacugaacuacuccaaaaagaauauauggaccgucaaggaaaaacaccacuaggauuaguagacuuauucgucuucucaaccucauucuaccucauaucaauauuccuacaccuaguaaaaauaccaacacauagacacgucauugguaaacccuguccaaaaccacauagauuaaaccacaugggaauauguucauguggacuauacaaucaucccggaguuccaguaaaauggaaaagauaa

SEQ ID NO: 2763 - RNA, 1473 nt, Artificial Sequence
  derived and/or modified CDS sequence (opt6) from Lassa virus__AIT17638__GPC
augggacaaaucauaacuuucuuccaagaagucccucacguaaucgaagaaguuaugaacaucguacuaauagcacuaucauuauuagcuauacuaaaaggaauauacaacguagcaacaugcgguuuauucggauuaguauccuuccuacuauuaugcggaagaucaugcucuacaacauacaaaggaguauaugaauuacaaacauuagaauuagacauggcaucucuaaauaugacaaugccauuaucaugcaccaaaaacaacucacaucacuacauaaugguagguaacgaaacaggacuagaauuaacauuaaccaacacaucaauaauaaaccauaaauucugcaaccuaucugacgcccacaagaaagaccuauacgaccacgcacucaugucaauuauuuccacauuccaucuaucuauacccaacuuuaaccaauacgaagcaauguccugugacuucaauggaggaaaaauauccguccaauacaacuuaucacacacuuacgcaguagacgcagcaaaccacugcggaacaaucgcaaacggaguccuacaaacauuuaugcgaauggcauggggcggcucauauauagcccuggauucaggaaaaggcucaugggacugcauaaugacauccuaccaauacuuaauaauucaaaacacuacaugggaagaccacugccaauucucuagaccaucaccaauaggauacuuaggacuccuuucccaaagaaccagagacauauacauaucuagaagacuacuagguacauuuacuuggacacuaucagacuccgaaggcaacgaaacaccaggaggauacugccucacacgcuggaugcuuauagaagcagaacuaaaaugcuucggaaacacagcaguagcaaaaugcaacgaaaaacacgaugaagaauuuugcgacaugcuacgacucuucgauuucaauaaacaagccauaaggcguuuaaaaacagaagcucaaaugucuauacaacuaaucaauaaagcaguaaacgcauuaauaaaugaucaauuaauaaugaaaaaucacuuacgagacauaaugggaauaccauauugcaacuacucaaaauacugguaccuaaaccacacuguaacuggcaaaacaucacuaccacgauguugguuaguaucaaauggcucuuaccuaaacgaaacacacuucucagacgacauagaacaacaagcagacaacaugauuacagaacuacuacaaaaagaauauauggaccgccaaggcaaaacaccucuaggccuuguagaccuauucguauucucaacaaguuucuacuuaauuucaauauuuuuacaccuaauaaaaauacccacacauagacacauaaccggaaaaccaugccccaaaccccaccgccuaaaccauaugggaauaugcucauguggauuauacaaacacccaggaguuccaguaaaauggaaacgauaa

SEQ ID NO: 2764 - RNA, 1473 nt, Artificial Sequence
  derived and/or modified CDS sequence (opt6) from Lassa virus__AIT17642__GPC
augggccaaauaaucacauucuuccaagaaguaccccacguaauagaagaagucaugaacauaguauuaauagcauuaucauuauuagccauauuaaaaggaguauauaauguagccaccugcggauuauuuggacucguaucauuucuccuacuaugugguagaucauguucaacaacauauaaaggcguauacgaacuacaaacacucgaacuagacauggcaucacucaacaugacaaugccauuaucguguacaaaaaauaacucacaucacuacauaaugguuggaaacgacacaggcuuagaauuaacacucacaaacacaucaauaauaaaccacaaauucugcaacuuauccgacgcacacaaaaaaaacuuauaugaucacgcacuaaugucaauaauuucaacauuccaccuaucuauaccaaauuucaaccaauaugaagcaaugucaugcgauuucaacggcggaaaaaucucaguacaauacaaucuaucccaugccuacgcaguagacgcagcaucacauugcggaacaauagcaaacggcguacuacaaacauucaugagaauggcauggggaggaucauacauagccuuagacucaggaaaaggaucuugggauuguauaaugacauccuaccaauaccucaucauccaaaacacaacaugggaagaccacugccaauucucacguccaucacccauagguuaccuaggacuacuaucacaaagaacccgugacauauacauaagcagacgacuauuaggaacauucacauggacacuaucugauucagaaggaaacgaaacacccggaggcuacugucuaacacgauggaugcuuauagaagcugaacuaaaaugcuucggaaacacagccguagcaaaaugcaacgaaaaacacgacgaagaauuuugcgacaugcuaagacuauucgacuuuaacaaacaagcaauaagaagacucaaaacagaagcacaaaugagcauacaacuaauaaacaaagcaguaaacgcacucauaaacgaccaacuaauaaugaaaaaccacuuaagagauauaaugggcauucccuacuguaauuacucaaaauacugguaucuaaaccauacaguaacaggcaaaacaagucuaccaagaugcuggcuaguuuccaacgguucauaccuaaacgaaacccacuuuucugacgacauagaacaacaagcugauaauaugaucacagaacuauuacaaaaagaauauauggacagacaaggaaaaacaccccuuggacuagucgaccuauuuguauucuccaccucauucuacuuaauaaguauuuuuuuacauuuaguaaaaauaccaacucauagacauauaauaggaaaaccaugcccaaaaccccauagauuaaaccacaugggaauaugcucaugcggcuuauacaaacacccaggaguacccguuaaauggaaaagauaa

SEQ ID NO: 2765 - RNA, 1473 nt, Artificial Sequence
  derived and/or modified CDS sequence (opt6) from Lassa virus__AIT17646__GPC
augggucaaauaaucacauucuuccaagaaguaccacacguuaucgaagaaguaaugaauauaguauuaaucgcacucucacuauuagcaauauuaaaaggaauuuacaacguagcaaccugcggauuauucgguuuaguaucauuccuccuacuauguggaagaucaugcucaacuaccuacaaaggaguauacgaauuacaaacauuagaacuagacauggcaucacuuaacaugacaaugccacuuucuugcacuaaaaacaauucacaucacuacauaaugguaggaaaugaaacaggacuagaacuaacacuaacaaacacaucaauaaucaaucacaaauuuugcaacuuauccgacgcacacaagaaaaacuuauacgaccaugcauuaaugucaauaauauccaccuuccacuuaucaauaccaaacuucaaccaauaugaagcaaugucaugugacuucaacggaggaaaaauaucaguacaauacaaucuaucacaugcauacgcaguugaugccgcaucacauuguggaacaguagccaacggagucuuacaaacuuucaugagaauggcauggggaggguccuacaucgcauuagauuccggcaaaggaucaugggacugcauaaugacauccuaucaauaccuaauaauacaaaacacaacaugggaagaucauugccaauucucuagaccaucaccaauaggauaccuaggacuacuaucccaaagaacaagagauauauauauuucccgaagacuauuaggcacauuuacauggacauuaucagacuccgaaggcaacgaaacacccggaggauacugcuuaacacgcuggaugcuaauagaagccgaacuaaaaugcuucgguaacacagcaguagcuaaaugcaacgaaaaacaugacgaagaauuuugcgacauguuaagacucuucgauuucaacaaacaagcaauuagacgacuaaaaacagaagcacaaaugucaauacaauuaauaaacaaagcugucaacgcacuaauuaaugaccaauuaauaaugaaaaaccaccuaagagauauaauggguauacccuacuguaacuacuccaaauauugguacuuaaaccacacugucaccgguaaaacaucucuaccaagaugcuggcuaguaucaaauggaucauaccucaacgaaacacacuucucagacgauauagaacaacaagcagacaacaugaucacagaacuacuacaaaaagaauacauggaccgccaaggaaaaacaccacuaggcuuaguagaucuauucguauuuucaacaucauucuaucuuauuucaauauucuuacaccuagucaaaauaccaacacaccgacauguaauaggaaaaccuugccccaaaccccauagauuaaaccacaugggaauaugcuccugcgguuuauacaaacacccaggaguacccguaaaauggaaaagauaa

SEQ ID NO: 2766 - RNA, 1473 nt, Artificial Sequence
  derived and/or modified CDS sequence (opt6) from Lassa virus__AIT17650__GPC
augggccaaauaauaacauucuuccaagaaguaccacacguuauagaagaaguaaugaauauaguacucauagcauuaucuuuacuagcaauacucaaaggaaucuauaaugucgcaacauguggcuuguucggauuaguaucuuuccuuuuauuaugcggaagaucaugcucaacaaccuacaaaggcguauacgaacuccaaacacuugaacuagacauggcuucccucaauaugacaaugccauuaucauguacaaaaaacaacucucaucacuacauuaugguaggaaacgaaacaggacuagaacuaacacuaacaaacauauccauaauaaaucacaaauuuugcaaucuaucagaugcacacaaaaaaaaucuauacgaucacgcacucaugucaauaauauccacauuccauuuauccauacccaacuuuaaccaauaugaagcaaugucaugugacuuuaacggaggaaaaaucucaguacaauauaaccuaucucacacauacgccgucgacgcagcaaaccauugcgguacuauagcaaacgguguacuacaaacauucaugagaauggcauggggaggaucuuauauagcauuagauagcggaaaaggcucaugggauugcauaaugacaucauaccaauaccuuauaauacaaaacaccaccugggaagaccauugucaauucagcagacccuccccaauaggauaucucgguuuacuaucccaaagaacaagagacauuuacauaucuagaagauuacucggaacauuuaccuggacacucuccgacuccgaaggaaacgaaacaccaggcggauacugccucaccagauggaugcucaucgaagcagaacuuaaaugcuucggaaacaccgcaguagcaaaaugcaaugaaaaacacgacgaagaauucugcgauauguuacggcuauucgacuucaacaaacaagcaauacgaagacucaaagcagaagcacaaaugucaauacaacuaauaaauaaagcaguaaacgcuuuaauaaacgaccaacuaauaaugaaaaaccauuuacgugacauuaugggaauaccauacugcaauuacucuaaauauugguaccuaaaucacacagucacaggaagaaccucauuaccaagaugcuggcugguaucaaacggaucauaccuaaaugaaacacacuuuagugacgauauagaacaacaagcagacaauaugauaaccgaauuacuccaaaaagaauacauugacagacaaggcaaaacaccauuaggacuaguagacuuauucguauucucuacaucauucuaucuaauaucaauauuccuacaccuaguaaaaauccccacacacagacauauaaucggaaaaccuugcccuaaaccccaucgacuuaaccacaugggaaucuguucaugugguuuauacaaacauccaggaguaccaguaaaauggaaacgauaa

SEQ ID NO: 2767 - RNA, 1473 nt, Artificial Sequence
  derived and/or modified CDS sequence (opt6) from Lassa virus__AIT17658__GPC
augggccaaauaauaacauucuuucaagaagucccccacguaaucgaagaagucaugaauauaguauuaauagcccuaucacuauuagcaauacuuaaaggaguuuacaacguagcaacuugcggacuauucggucuaguaucuuuccucuuauuaugcggaagaucauguucuauaacauauaaagguguuuaugaacuacaaacccuugaacuagauauggcaaaucuaaauaugaccaugccauuaucauguaccaaaaacaauucacaccacuacauaaugguaggaaaugaaacaggauuagaauuaacacuuacaaacacaucuaucauaaaccacaaauucugcaauuuaucagaugcccacaagaaaaaccuauacgaucaugcucucaugucaauaauuucaacuuuccaccucucaauaccaaacuucaaucaauacgaagcaaugucaugcgacuucaacggaggaaaaauaagcguacaauauaaucucucacauacauaugcaggagacgcagcagaccacugcggaacaauagcaaauggaguacuacaaaccuucaugcgaauggcauggggagguucauacauagcauuagauucaggaaaaggaucaugggauuguauaaugacuuccuaccaauaccuaauaauacaaaauacaacaugggaagaccauugccaauucuccagaccaucccccaugggauaccucggauuacuaucacaaagaaccagagacauauacauaucaagaagacuucuaggaacuuuuacauggacccuaucugauucagaaggaaaugaaacccccggaggauacugcuuaacacgauggaugcuaauagaagcagaauuaaaaugcuuuggaaacaccgcaguagcaaaaugcaaugaaaaacaugacgaagaauuuugcgauauguuacgacuauucgacuuuaacaaacaagcaaucagaagacuaaaaacagaagcccaaauguccauacaacuaaucaauaaagcaguaaacgcacuaauaaacgaucaauuaaucaugaaaaaccaccuacgugauauaaugggcauacccuacugcaacuauucaaaauacugguaucuaaaccauacaauaaccggaaaaacaucacuaccccgaugcuggcuagucucaaacggcuccuaccuaaacgaaacacauuucucagaugacauagaacaacaagcagauaacaugauaaccgaacuacuacaaaaagaauacauugauagacaaggaaaaacaccauuaggauuaguagaccuauucguauuuucuaccucauucuacuuaauaucaauuuucuuacaccuuguaaaaauaccaacacauagacacauaacaggaaaaccaugcccaaaaccccaccgacucaaccacaugggaauaugcucaugcggacuguacaaacacccaggaguaccaguacgauggaaacgcuga

SEQ ID NO: 2768 - RNA, 1473 nt, Artificial Sequence
  derived and/or modified CDS sequence (opt6) from Lassa virus__AIT17666__GPC
augggacaaauaguaacauuuuuccaagaaguaccacacguaauagaagaaguaaugaacauaguacuaauagcauuaucccuacuagcaauauuaaaaggcauauauaacguugcaaccugcggccuauuuggacucguuucauuccuucuacuuugcggaagaucaugcucaacaacauacaaaggaguauacgaauuacaaacauuagaacuugauauggcaucacuaaacaugacaaugccauuaucauguaccaaaaacaauucacaccacuauauaaugguaggaaacgaaacuggauuagaacuaacacuaaccaauacaucaaucauaaaccacaaauucugcaaccuaucagacgcacacaaaaaaaaucuauacgaccacgcauuaaugucaauaauaucaacauuccauuuaucuauaccuaacuucaaccaauacgaagcaaugucaugcgacuuuaacggaggaaaaaucucaguacaauacaaucuaucacacacauacgcaguagacgcagcaaaucacugcggaacaauagcaaacggaguacuacaaacauucaugcgaauggcauggggaggaagcuauauagcccucgacucagggaaaggaucaugggacugcauaaugaccuccuaucaauaccucauuauacaaaauacaaccugggaagaucacugucaauuuucacgccccucaccaauaggauaccucggucuacucucccaacgaacaagagacauauacaucucuagaagauuacucgguaccuuuacauggacauuaucagacucagaagguaacgagaccccaggcggauacugccucacaagauggaugcuaauagaagcagaauuaaaaugcuucggaaacaccgcagucgcaaaaugcaaugaaaaacaugacgaagaauucugugacaugcuucgacuuuuugacuuuaauaaacaagcaauaagacgauuaaaaacagaagcacaaaugucaauacaacuaauaaacaaagcaguuaacgcacuaauaaacgaucaauuaauaaugaaaaaucaccuucgagauauaaugggaauaccauacugcaacuauuccaaauauugguaucuaaaccacacaguaacaggaaaaaccucccucccaagaugcuggcuaguuucaaauggaucauaccuaaacgaaacacacuucuccgaugacaucgaacaacaagcagauaacaugauaacagaacucuuacaaaaagaauacauggaucgacaaggaaaaacuccacuaggacuaguagauuuauucguauucucaacaucauucuacuuaauaucaaucuucuuacaccuaguaaaaauaccaacccacagacacauaacaggaaaacccuguccaaaaccacaccgacucaaccacaugggaauauguuccuguggacuauacaaacacccagguguaccaguuaaauggaaaagauaa

SEQ ID NO: 2769 - RNA, 1473 nt, Artificial Sequence
  derived and/or modified CDS sequence (opt6) from Lassa virus__AIT17670__GPC
augggacaaaucauaacauucuuucaagaaguaccacacguaauagaagaagucaugaauauaguacucauagcccuaucauuauuagcaauacucaaagguauuuacaacguugcuacaugcggauuauuuggacucguaucauuccuucucuuauguggaagauccugcucaacaacauacaaaggaguuuacgaacuacaaacacuagaauuagacauggcaucacuaaauaugaccaugccuuuaucuugcacaaaaaauaacagucaccacuacaucaugguaggcaacgaaacaggauuagaacuaacacuuacaaacacaucaaucauaaaccacaaauuuuguaaccuaucagacgcacacaaaaaaaaccuauaugaccacgcacuaaugucuauuauaucaacauuucaccuaucuauaccaaauuuuaaccaauacgaagcaaugucuugcgauuuuaacggaggcaaaauaucaguacaauauaacuuaucccauacauacgcaguagacgcagcaaaccacuguggcacaaucgcaaauggagucuuacaaaccuucaugcguauggcauggggaggaucauacaucgcacuugacucaggaaaagguagcugggacuguaucaugacaucuuaccaauauuuaauaauacaaaacaccacaugggaagaccauugucaauucucacgaccaucacccauagguuacuuaggauuacuaucacaaagaacaagagacauauauauuucacgacgacuacucggaacauucacauggacccuaucagacucagaagguaacgaaacacccggaggauacugcuuaaccagauggauguuaauagaagcagaacuaaaaugcuucgguaacacugccguagcaaaauguaacgaaaaacaugacgaagaauucugcgacaugcuacgauuauucgacuucaacaaacaagcaauaagaagauuaaaagcagaagcccaaaugucaauacaauuaauaaauaaagcaguaaacgcacuaauaaacgaccaauuaauuaugaaaaaucaucuuagagacauaaugggaauacccuauugcaauuauucuaaauacugguaucuuaaccacaccguaacaggaagaacaucucuccccagauguuggcuaguaucaaacggaucauaccucaaugaaacccacuuuucagacgauauagaacaacaagcagacaacaugauaacagaacucuuacaaaaagaauacauagaucgccaaggaaaaacaccacucggauuaguagaccuauucguauucuccacaucuuucuaccucaucuccaucuuuuuacacuuaguaaaaauaccaacccacagacacauaauaggaaaaccaugccccaaaccacaccgauuaaaucacauggguauaugcuccuguggauuauacaaacacccaggcgucccaguaaaauggaaaagauaa

SEQ ID NO: 2770 - RNA, 1473 nt, Artificial Sequence
  derived and/or modified CDS sequence (opt6) from Lassa virus__AIT17674__GPC
augggacaaauaauaacauucuuccaagaaguaccacauguaauagaagaaguaaugaacauaguacuaauagcacucagccuauuagccauauuaaaaggaauauacaaugucgcaaccugcggauuauucggauuaguaucuuucuuacuacuuugcggacgaucauguucaacaacuuauaaaggaguauacgaacuacaaacccuagaacuagacaugacaaaucuaaacaugaccaugccucuaucauguaccaaaaacaacucucaucacuacauaauggucggcaacgaaacaggacuagaauuaacacuaacaaacacauccauaauaaaccacaaauucuguaacuuaucugacgcccacaagaaaaaccuauauaaccacgcucuaaugucaauaauaucuacauuccacuuaucaaucccaaacuucaaccaauacgaagcuaugucaugcgacuucaacggcggaaaaauaucaguacaauacaaccuaucacacucauacgcuguugacgcagcaaaucacugcggaacgauagcuaacggaguauuacaaacuuucaugagaauggccuggggaggaucauacauugcauuagacuccggaaaagguaacugggacugcauaaugaccagcuaucaauaucuaaucauacaaaacacaacaugggaagaccacugucaauucuccagaccuucaccaauaggauaucuaggccuauuaucacaacgaacacgagacauauacauaucaagacgauuacuuggaacuuucacuuggacgcuauccgacucagaaggaaacgaaacaccaggagguuacuguuuaacaagauggaugcuuauagaagcagaacucaaaugcuuuggaaacacugccguagcaaaauguaacgaaaaacacgaugaagaauuuugcgacaugcuaagacuauucgacuucaacaaacaagcaaucagaagauuaaaaacugaagcucaagcaaacauccaacuaauaaacaaagcaguaaacgcauuaauuaacgaccaacuaauaaugaaaaaccaccuucgagacauaaugggaauaccauauugcaacuacucaaaauacugguauuuaaaccacacaguaacaggaaaaaccucacuaccaagauguuggcuaguuuccaauggaucauaccuaaacgaaacacacuucucagacgacauagaacaacaagcagauaacaugauaacagaauuacuacaaaaagaauauauggacagacaaggcaaaacaccuuuaggccuaguagaucuauucguauucucuaccagcuucuaccuaauaucaauuuuucuacacuuaguaaaaaucccaacacacaggcacgucauaggaaaaccauguccaaaaccacacagacuaaaccacauggguauauguucaugcgguuuauauaaacacccuggaguaccaguuaaauggaaacgcuaa

SEQ ID NO: 2771 - RNA, 1473 nt, Artificial Sequence
  derived and/or modified CDS sequence (opt6) from Lassa virus__AIT17678__GPC
augggacaaauaauaaccuucuuccaagaagucccucacgucaucgaagaaguaaugaacauaguauuaauaacacuaucauuauuagcuauauuaaaaggaauauacaauauagcaacgugcggacucuucggacuaguuuccuuucuauuacucugcggccgaucgugcagcaccaccuacaaaggaguauacgagcuccaaacacuagaauuagauaugacuucucucaacaugacaaugcccuuaaguugcacuaaaaacaauucacaucacuauauaauggucggaaaugaaaccggacuagaauuaacuuuaacaaauacauccauaauaaaccacaaauuuugcaaucuaagcgacgcacacaaaaaaaaccuauacgaucaugcauuaaugucaauuauauccacauuccaccuaucaauuccaaacuucaaccaauaugaagccaugagcugcgacuuuaauggcggaaaaaucucaguacaauauaaucuaucacacacauacgcaguagacgcagcaaaucacugcggaacaaucgcaaacggaguacuacaaacauucaugagaauggcauggggaggauccuacaucgcacucgacucaggaaaaggcuccugggauugcauuaugacaucauaccaauaucuaauaauccaaaacacaacaugggaagaucauugccaauucuccagaccaagcccaauagguuaccuaggacuacuaucacaaagaaccagagacaucuacauaucuagaagacuuuuaggaacauucacauggacacuaucagauucagaaggaaacgaaaccccaggaggauacugcuuaaccagauggaugcuaauagaagcagaacuaaaaugcuucggaaacacagcuguagcaaaaugcaaugaaaaacacgacgaagaauuuugcgacaugcuaagauuauucgacuucaacaaacaagccaucagaagauuaaaaacagaagcacaaaugaguauacaauuaauaaacaaagccguaaacgcccuaaucaacgaucaacuaauaaugaaaaaccacuuaagagacauaaugggcauaccauacugcaauuauucuaaauacugguauuuaaaccauacaguaaccggcaaaacaagccucccaagaugcuggcuaguaucaaacggaucauaucucaacgaaacacacuucucagacgacauagaacaacaagcagacaacaugauaacagaacuucuacaaaaagaauacauagacagacaaggaaaaacuccccuuggauuagucgaccuauucguauucucuacaucauucuauuuaauaucaaucuuccuacaccuaguaaaaauacccacucacaggcacaucauaggaaaaccuugcccaaaaccacacagacuuaaucacaugggaauauguuccuguggacuauauaaacacccaggaauaccaguaaaauggaaaagauaa

SEQ ID NO: 2772 - RNA, 1473 nt, Artificial Sequence
  derived and/or modified CDS sequence (opt6) from Lassa virus__AIT17686__GPC
augggacaaaucauuacauuuuuccaagaaguaccacauguaauagaagaaguuaugaauauaguacuaaucgcacucucauuauuagcaauauuaaaaggaauauauaacguagcaacaugcgguuuauucggauuaguaucauuccuauuacuaugugguagaucauguucaacaacauacaagggaguauaugaacuacaaacacuagaauuagacauggcaucauuaaacaugacuaugccauuaucaugcacuaaaaauaauucacaccacuacauaauggucggcaacgaaacuggauuagaacuaacauuaacaaacaccucaauaaucaaccauaaauucugcaaccuaagugaugcacacaagaaaaaucuuuaugaccacgccuuaauguccauaauaucaacauuccacuuaucaaucccaaacuuuaaccaauacgaagcaaugucaugcgacuuuaacgguggaaaaaucaguguacaauacaaccuaucacacacauaugccguagacgcagcaaaucauugcggaacaauagcaaacggaguacuacaaacauuuaugagaauggcauggggaggaucuuacaucgcacucgauuccagaaaaggcagcugggacuguauuaugacauccuaucaauaccuaauaauacaaaacacaaccugggaagaccacugccaauucuccagaccauccccaauaggcuacuuaggacuacuaucacaaagaacaagagauauuuacauaucuagacgauuacuaggaacauucacauggacauuaucagacuccgaaggaaacgaaacaccuggaggcuauugcuuaacuagauggaugcucaucgaagccgaacuaaaauguuuuggaaacacagcaguagcuaaauguaacgaaaaacaugacgaagaauuuugugacaugcucagacuauuugauuucaacaaacaagcaauaagaagguuaaaaacagaagcacaaaugucaauacaacuaauaaauaaagcaguaaacgcauuaauaaacgaccaacucauaaugaaaaaccacuuaagagacauaaugggcauuccauauugcaacuacuccaaauauugguauuuaaaucauacaguaacaggaaaaacuucauuaccaagaugcugguuaguaucaaauggaucuuacuuaaaugaaacacauuucucagacgauauagaacaacaagcagacaauaugauaacagaacuauuacaaaaagaauauauggaccgacaaggaaaaacaccacuaggucuagucgaucuauuugucuucuccacaucauucuaccuaauaucuauauuucuucaccuuauaaaaauuccaacacacagacauguaauaggaaaaccaugcccaaaaccacacagacuaaaccacaugggaauaugcucauguggauuauacaaacaccccggagucccagucaaauggaaaagauaa

SEQ ID NO: 2773 - RNA, 1473 nt, Artificial Sequence
  derived and/or modified CDS sequence (opt6) from Lassa virus__AIT17690__GPC
augggucaaaucauuacauucuuccaagaagucccacacguaauagaagaaguaaugaauauaguuuuaaucgcauuaucacuccuagcaauauuaaaaggaauauacaacguagcaacaugcgggcuuuucggacucgucucauuccuucuccuauguggcagaucaugcucuacaaccuacaaaggaguauaugaauuacaaacauuagaacucgacauggcaucacuuaauaugacuaugccucuaucauguacaaaaaacaacagccaucacuacaucaugguaggaaacgaaacaggauuagaacucacucuaacaaauaccucaaucauaaaccauaaauuuugcaaccuaucagacgcccacaaaaaaaacuuauaugaucacgcuuuaaugagcauaauuuccacauuccacuuaucuauaccuaacuucaaccaauacgaggcaaugucaugcgacuucaauggaggaaaaauuuccguacaauacaacuuaucccacgcauacgcaguagacgcugccucacauuguggcacagucgcuaacggcgucuuacaaacauucaugcgaauggcauggggcggaucauacauagcauuagacucuggaaaaggaucaugggauugcauaaugacaucguaccaauacuuaauaauacaaaacacuacaugggaagaucauugccaauucucacgaccauccccaauaggauaccuaggucuacuaucacagagaacuagagacauauacauaucuagaagacuauuaggaacuuuuacauggacccuauccgacucagaaggaaacgaaaccccaggaggauauugccuaacucguuggaugcuaauagaagcagaauuaaaaugcuucggaaacacagcaguagccaaaugcaacgaaaaacacgacgaagaauuuugugacaugcuaagacuauucgacuucaacaaacaagcuauaagaagacugaaaacagaagcacaaaugagcauacaauuaauaaacaaagcuguaaaugccuuaauuaacgaccaauuaaucaugaaaaaccaucuacgagauauaaugggaauaccauacugcaacuauuccaaauacugguacuuaaaucauacagucaccggaagaacaucacuacccagaugcuggcucguaucaaacggcucauaucuaaaugaaacacauuucucagacgacauagaacaacaagcagacaauaugauaacagaacuacuacaaaaagaauacauggacagacaaggcaaaacaccacuaggauuagucgacuuauucguauucuccacaucuuucuauuuaauaucaauauuccuacaccucguaaaaauaccaacacauagacaugucaucggcaaaccaugcccaaaaccucacagacuaaaccauaugggcauaugcucaugcggacuauauaaacacccaggaguuccuguaaaauggaaacgauaa

SEQ ID NO: 2774 - RNA, 1473 nt, Artificial Sequence
  derived and/or modified CDS sequence (opt6) from Lassa virus__AIT17694__GPC
augggacaaauaauaacuuucuuccaagaaguaccccacguaauagaagaaguaaugaacauaguccuuauugcacuuucacuacuagccauacuuaaaggaaucuacaacguagcaaccugcggauuauucggacuaguaaguuuccuauuacuaugcggcagauccugcuccacgauauacaaaggcguauaugaacuacaaacauuagaauuagacauggcaucucuaaacaugacaaugccacuauccugcacaaaaaacaacucacaccauuacauaaugguuggaaacgaaaccggacuagaauuaacacuaacaaacacaucuauaauaaaccacaaauucugcaaccuaucugaugcacacaaaaaaaaccuauaugaccaugccuuaaugucaauaauauccacauuccacuuaucaauaccaaacuucaaccaauaugaagcaaugucuugcgacuucaacggaggaaaaaucuccguacaauacaacuuaucacauacauaugccguagacgcagcaaaccacuguggaacaaucgccaacggaguuuuacaaacauuuaugcgcauggccuggggaggaucauacauagcacucgauuccggaaaaggauccugggauugcaucaugacaucauaccaauaucuaauaauacaaaacaccacuugggaagaucacugccaauuuucacgaccaaguccaauaggauaccuaggccuacuaucacaaagaacaagagacauauacauaucaagaagauuacuuggaaccuucaccuggacccuaucugauucagaaggaaacgaaacaccaggagguuauuguuuaacacgauggaugcuaauagaagcagaacuaaaaugcuuuggaaacacagccguagcaaaaugcaaugaaaaacacgacgaagaauucugugauauguuacgcuuauuugauuuuaacaaacaagcaauccgaagacuaaaaacagaagcccaaaugucaauccaacuuauuaacaaagccguuaaugcacuaauaaacgaucaacucauaaugaaaaaccaccuuagagacauaaugggaauucccuacugcaacuacagcaaauacugguaucucaaccacacaguaacuggcaaaaccucacuaccacgaugcuggcuaguaucaaauggaucauacuugaacgaaacacauuuuucugacgacaucgaacaacaagcagacaacaugauaacagaacuacuucaaaaagaauauauagacagacaaggaaaaacaccacuaggauuaguagacuuauuuguauuuuccacaucauucuaccuaauaucuauuuuccuacaccuuguaaaaauaccaacacaucgacacguagucggaaaacccugcccaaaaccacaucguuuaaaccacaugggcauaugcucaugcggacuauauaaacauccuggaguaccaguaaaauggaaaagauaa

SEQ ID NO: 2775 - RNA, 1473 nt, Artificial Sequence
  derived and/or modified CDS sequence (opt6) from Lassa virus__AIT17712__GPC
augggacaaauaaucacauucuuccaagaaguaccacacgucauagaagaaguaaugaacauaguauuaaucgcauuaucccuacuagcaauacuaaaaggaauauacaacguagcaacaugcggcuuauuuggauuaguaucuuucuuacuacuaugcggccgaucaugcucaacaacauacaaaggagucuacgaacuacaaacacuagaacuagauauggccucccuaaacaugacaaugccauuaucaugcacaaaaaacaacucacaccauuacauaaugguaggaaaugaaaccggccuagaauuaacacuaacuaacacauccauaaucaaucauaaauuuugcaaccuaucagaugcccauaaaaaaaaccucuacgaccaugcacuaaugucuauaaucucaacuuuccaucuauccauaccaaacuucaaucaauaugaagcaauguccugcgacuucaacggaggaaaaauaucgguacaauauaaucucucacacacauacgcuguugacgcagcaaaccacugcggaacuauagccaacggcguacuccaaacuuuuaugagaauggccuggggaggauccuacaucgcauuagacucaggaaaaggagcaugggacugcauaaugaccucauaccaauacuuaauaauacaaaacacaacaugggaagaucacugccaauucucaagaccaucacccauaggcuaccuaggccuacuuucucaacgaacaagagacauauauauaucaagaagauuacuaggaacauucaccuggacauuaucugacucagaaggaaaugaaacucccggagguuacugccuaacaagauggauguuaaucgaagcagaauuaaaaugcuuuggcaauacagcagucgccaaauguaacgaaaaacaugacgaagaauuuugcgacaugcucagacuauucgacuuuaacaaacaagccauaaugcgacuaaaaacagaagcacaaauguccauacaauuaaucaauaaagccguaaacgcacuaauaaacgaucaacuaauaaugaaaaaccaccuaagagacauaauggguauacccuacugcaacuacucaaaauacugguacuuaaaccauacaguaaccggaaaaacuucacuacccagaugcugguuaguaucaaaugguuccuaccuaaaugaaacccacuucucagaugauauagaacaacaagcagauaauaugauaaccgaaaugcuacaaaaagaauauauagaccgccaaggcaaaacaccauuaggacuaguagacuuauuuguauuuuccacaucauucuacuuaauaucaauauuccuucaccuaguuaaaauaccaacacacagacacgucauaggaaaacccuguccaaaaccacacagauuaaaucauaugggaauauguucauguggacuauauaaacacccaggaguccccgucagauggaaacgauaa

SEQ ID NO: 2776 - RNA, 1473 nt, Artificial Sequence
  derived and/or modified CDS sequence (opt6) from Lassa virus__AIT17718__GPC
augggacaaauaauaacauucuuccaagaaguaccccacguaauagaagaaguaaugaacauaguacucauagcacuaucacuacucgcuauacuaaaaggaauauacaaugucgcaacauguggauuauucggcuuaguaucauuccucuuacucugcggaagaucaugcucaacaacauacaaaggaguauacgaacuccaaacacuagaauuagacauggcuucuuuaaauaugaccaugccauuaaguugcacaaaaaacaacagccaccacuauauaagaguaggaaacgaaacaggacuagaacuaacauuaacaaacgcaagcauaauaaaucauaaauucugcaaccuaucagaugcacauaaaaaaaaucuauaugaucaugcauuaauguccauuaucucaacauuucacuuauccauaccaaacuuuaaccaauacgaagcuaugucaugcgauuucaauggaggaaaaauaucuguacaauacaaccuaucccaugcauacgcaauagacgcagccaaucacugcgguacaguugccaacggaguacuccaaaccuucaugagaauggcauggggaggaaguuacauagcccuagacucaggacgaggaaacugggacuguauaaugacuucauaccaauacuuaauaauacaaaacacaacaugggaagaucauugccaauuuucaagaccaucaccaauagguuaccuaggcuuauuaucacaaagaacaagagacauauacauaagccgacgauuauuaggaacauuuacauggacacucucagauucagagggaaacgaaacacccggaggauauugucuaacaagauggauguuaauagaagcagaacuaaaauguuuuggaaacacagcaguugcaaaauguaacgaaaaacacgacgaagaauucugcgacaugcuaagacuuuucgacuucaacaaacaagcaauaagacgccuaaaaacagaagcacaaaugaguauacaacuuauaaauaaagcaguaaaugccuuaauaaacgaccaauuaauuaugaaaaaccaccuccgagacauaaugggaauuccauacuguaauuacucaaaauauugguaccuaaaccauacagucacaggaaaaacaucccuaccacgcugcuggcuaguaucaaacggaucauaccuaaacgaaacacacuucucagacgauaucgaacaacaagcagacaauaugauaaccgaacuacuacaaaaagaauacauggacagacaaggaaaaacaccucucggacuagucgaucuuuuuguauucucaacauccuucuaccuaaucucaauauuucuucaccuaguaaaaauaccuacacaccgacauguuauaggcaaaccauguccaaaaccacacagauuaaaccauauggguauaugcucaugcggauucuacaaacacccaggcgucccaguaaaauggaaaagauaa

SEQ ID NO: 2777 - RNA, 1473 nt, Artificial Sequence
  derived and/or modified CDS sequence (opt6) from Lassa virus__AIT17724__GPC
augggccaaaucauaacauucuuccaagaaguaccccacguaauagaagaaguaaugaauauaguacucauagcacuaucacuauuagcaauacuaaaaggaauauacaacguagcaacuugcggacuauucggacuagucucauuccucuuauuaugcgguagaaguuguucaacuacauacaaaggaguauacgaacuacaaacacuagaacuagauauggcaaaucuaaauaugacuaugccauuaucaugcaccaaaaauaacucacaucacuauauaaugguaggaaaugaaaccggacuagaacucaccuuaacaaacacauccaucauaaaucauaaauucugcaauuuaucagacgcccacaaaaaaaaccuauacgaccacgcauuaaugucaauaauuucuacauuccaccuaucaauacccaacuucaaucaauacgaagcaaugucaugugauuucaacggaggaaaaauaucaguacaauacaaccucucucauacauaugcaguagacgcagcaaaccauugcggaacaguagcaaacggcguacuacaaacauucaugagaauggcauggggaggaucauauauagcacuagacucaggaaaaggaucaugggacugcauuaugaccucauaucaauaucuaaucauacaaaacacaacaugggaagaccacugccaauucucaagaccaucuccaauaggauaccuaggccuacuaucacaaagaacaagagauauauauaucuccagaagacuauuaggcacauuuaccuggacacuaucugacuccgaaggcaacgaaacaccaggaggauacugccuuacaagauggaugcuaaucgaagccgaacuaaaaugcuucgguaauaccgcagucgcgaaauguaaugaaaaacaugacgaggaauucugcgacauguuacgauuauuugacuucaauaaacaagcaauucgcagacuaaaaacagaagcacaaauguccauacaauuaauuaauaaagcagucaaugcauuaauaaacgaccaauuaauaaugaaaaaccaccuaagagacauaaugggcaucccauauugcaacuacucuaaauauugguaucuaaaccacaccgucacaggaaaaaccucucucccaagaugcuggcuaguaucaaacggauccuacuuaaacgaaacacauuuuucagacgacauagaacaacaagccgacaauaugauaacagaacuacuucaaaaagaauacauggacagacaaggaaaaacaccacuaggauuagucgaccuauucguauucuccacauccuucuaccuuaucuccauauuucuccaccuaguaaaaauacccacacaucgacacauaaugggaaaaccaugcccaaaaccacacagacuaaaccacaugggaauauguucaugcggacuauauaaacacccaggaguacccgucaaauggaaaagauga

SEQ ID NO: 2778 - RNA, 1473 nt, Artificial Sequence
  derived and/or modified CDS sequence (opt6) from Lassa virus__AIT17728__GPC
augggacaaauaauaacauuuuuccaagaaguaccacauguaauagaagaaguaaugaacauaguccucauagcacuaucacuacucgcuauacuaaaaggaauauacaacguagccacuugcggauuauucggacucguaaguuuccuacuacuauguggacgcucauguaguacaacauacaaaggcguauacgaauuacaaacacuagaacuagacaugggaucauuaaacaugacaaugccauuaaguuguaccaaaaauaacucacaccacuacauaaugguaggaaaugaaacaggauuagaauuaacauuaacaaacacaucaauaauaaaucacaaauucugcaaucuaucagaugcacauaagaaaaaccuauacgaccacgcacuaauguccauaauaucaacauuccaccuaucaauaccaaacuucaaccaauacgaagccaugucuugcgacuucaacggcggaaaaauaucaguacaauacaaccuaucacauacuuaugcaguagacgcagcaaaccacugcggaacuauagcaaacggaguauuacaaacauucaugcgcauggcauggggcgguuccuacauagcuuuagacagcggaaaaggaucaugggacugcauaaugacaucuuaccaauaccuaauaauacaaaacacaacaugggaagaccacugucaauucucacgaccaucaccaauaggauaccuuggacuacuaucccaaagaacucgagacauauacauauccagaagacuuuuaggaacauucacauggacauuauccgacucagaaggaaacgaaaccccuggagguuauugcuuaacuagauggaugcuaauugaagcagaacuaaaauguuucggaaacacagcaguagcaaaaugcaacgaaaaacaugaugaagaauuuugugacaugcuacgacuauucgauuucaacaaacaagcuaucagaagacuaaaaacagaagcacaaaugucuauacaauuaauuaauaaagcaguaaacgcccuaauaaacgaucaauuaaucaugaaaaaccaucuuagagauauaaugggcauaccauacuguaacuacucaaaauacugguacuuaaaucacacaguuaccggaaaaaccucauuacccagaugcugguuaguaucaaacggaucauacuuaaacgaaacacacuucucagaugacauagaacaacaagccgauaauaugauaacagaacuauuacaaaaagaauacauggacagacaaggcaaaacacccuuaggacucguagacuuauucguauucucuacaucuuucuacuuaauaucaauauuccuacaucuaguaaaaauacccacacacagacacguaauaggaaaaccauguccaaaaccccacagauuaaaccauaugggaauauguagcuguggacuauauaaacacccaggaguaccaguaaaauggaaaagauaa

SEQ ID NO: 2779 - RNA, 1473 nt, Artificial Sequence
  derived and/or modified CDS sequence (opt6) from Lassa virus__AIT17732__GPC
augggacaaauaauaaccuucuuucaagaaguaccccacguaauagaagaaguaaugaacauaguacucauagcauuaucuuuacuagcaauacucaaaggcauauacaaugucgcaacaugcggauuauuuggauuagucucauucuuacuauuaugcggccgaucauguucuaccaccuacaaagguguuuacgaauuacaaacccuagaacuagacauggccucuuuaaacaugacaaugccucucucauguacaaaaaacaacucacaucacuacauaaugguaggaaacgaaacaggucuagaauuaacauuaacaaacaccuccauaauaaaccauaaauucugcaaccucucagaugcacauaaaaaaaaucuauacgaucaugcucuaaugucaauaauaucuacuuuccacuuaucuauaccaaacuucaaucaauacgaagcaaugucuugugacuucaauggaggaaaaauuucaguacaauacaacuuaucccacacauaugcaguagacgcagcuaaccacuguggaaccauagcaaacggaguacuccaaacauucaugagaauggccuggggaggaucauacauagcauuagauucuggcaaaggauccugggauugcauaaugaccucauaccaauaccuaauaauacaaaacacaacuugggaagaucacugccaauucucuagaccaucacccauagguuaucuaggauuauuaucacaacgaacaagagacauauacauaucacgucgacuacuaggaacauucacauggacacuaucugacucagaaggaaacgaaacccccggaggauacuguuuaacucgauggauguuaauagaagccgaacuaaaauguuucggaaacacagcaguagcaaaaugcaacgaaaaacaugacgaagaauuuugugauaugcuaagacuauucgacuucaacaaacaagcuauaagaagauuaaaaacagaagcacaaaugucuauacaauuaauaaacaaagcaguaaacgcacuaauaaaugaucaacuaauaaugaaaaaucaccuacgagacaucaugggaauuccuuacugcaacuauucaaaauauugguaccuaaaccacaccguaacaggaaaaacauccuuaccacgaugcuggcuaguaucaaacgguucauaccuaaacgaaacacauuucuccgacgauauugaacaacaagcugacaauaugauaacugaacuccuacaaaaagaauauauagaccgucaaggcaaaacaccucuaggacuaguagaucuauucgucuuuucuaccucauucuaccuaaucucaaucuucuuacaccuaguaaaaauaccuacccaccgacauaucgucggaaaaccaugcccaaaaccacaccgacucaaucacaugggaaucugcagcugcggccucuauaaacacccaggaguaccaguaaaauggaaaagauaa

SEQ ID NO: 2780 - RNA, 1473 nt, Artificial Sequence
  derived and/or modified CDS sequence (opt6) from Lassa virus__AIT17736__GPC
augggacaaauaguaacauucuuccaagaaguaccucauguaauagaagaaguuaugaacauaguauuaauagcccuaucacuuuuagccauauuaaaaggaauauacaacguagcaaccugcggcuuauucggccuaguuucuuuccuucuacuaugcggacgauccugcagcacaacauacaaagguguauaugaacuccaaacccuagaacuagauauggcaucacuaaauaugacaaugccauuaucaugcacaaaaaacaacucacaccacuacauaaugguaggcaacgaaacaggccuagaacuaacacuaacaaacacaucaauaauaaaccauaaauucugcaaccucucagacgcacacaaaaaagaccuauacgaccacgcauuaaugucaauaaucuccaccuuucaucucucaauaccaaacuuuaaccaauacgaagcaaugucuugcgacuucaacggaggaaaaauaaguguccaauauaaccuaucacacaccuacgcaguggacgcagcaaaccacuguggaaccauagcaaauggaguacuacaaacuuucaugcgaauggcuuggggaggaaguuauauagcccucgacucuggaaaaggauccugggacugcaucaugaccucauaucaauaccuaauaauacaaaacacuacaugggaagaccacugccaauuuucacgaccuucaccuaucggauaucuagguuuauuaucacaacgaaccagagacaucuacaucucaagaagauuacuaggaacauucacauggacuuuaucagauuccgaaggcaaugaaacaccuggaggcuauugccuuacaagauggauguuaauagaagccgaacuaaaauguuucggcaauacagcaguagcaaaaugcaacgaaaaacaugacgaagaauucugcgauaugcuaagacuauucgacuucaacaaacaagcaaucaugagacuaaaaacagaagcacaaaugucaauacaacucauaaacaaagcaguaaaugccuuaauaaacgaucaacuaauaaugaaaaaccaccuuagagauauuaugggaauacccuacugcaacuauuccaaauauugguaccuaaaccauacaguaacaggaaaaacaucucuaccuagaugcugguuaguaucaaacggcucauaucuaaacgaaacaagauuuucagacgacauagaacaacaagcugacaauaugauaacagaaauguuacaaaaagaauacuuagaucgacaaggcaaaacaccacuaggcuuagucgaccuauuuguauucucaacaucauuuuaccuaauaucaauauuccuacaucuaguaaaaauacccacacacagacauauaauaggaaaaccaugcccaaaaccucacagacuaaaccauaugggaauaugcagcuguggucucuauaaacaccccggaguaccagucaaauggaaaagauaa

SEQ ID NO: 2781 - RNA, 1473 nt, Artificial Sequence
  derived and/or modified CDS sequence (opt6) from Lassa virus__AIT17744__GPC
augggacaaauaauaacauucuuccaagaagucccucacgucauagaagaaguaaugaacauagucuuaauagcacuaucacuauuagcaauacucaaaggaaucuacaacguagcaacaugcggcuuauucggcuuaauguccuuccuacuacuauguggaagaucaugcucaacaacauauaaaggaguauacgaauuacaaacacucgaauuagacauggcuaaucuaaauaugacaaugccacuaucaugcaccaaaaacaacagccaccauuauauaaugguaggaaaugaaacagguuuagaacuaacccucacaaacacaucaauaauaaaucacaaauucugcaaccuaucagacgcacauaaaaaaaauuuauaugaccacgcccuaaugagcaucauaucaacauuccaccuaucuaucccaaauuucaaccaauaugaagcaaugaguugcgacuuuaacggcggaaaaauaucaguccaauauaacuuaucacacgcauacgcaguagaugcagccaaccacugcggaaccaucgcaaacggaguacuacaaacuuucaugagaauggcauggggcggaucuuacauagcacuagacucagguaaaggaucaugggacugcauaaugaccagcuaucaauaucuaauaauacaaaauaccucaugggaagaccacugccaauucucaagaccaucaccaauuggcuaccuaggucucuuaagccaaagaacuagagauauauauauaucaagaagacuacuaggaacauucacauggaccuuaagugacagugaaggaaacgaaacaccagguggauacugccuaacuagauggaugcuaauagaagcagaacuaaaaugcuuuggcaacacugcuguagcaaaaugcaacgaaaaacaugaugaagaauuuugugacauguuaagacuauuugacuucaauaaacaagccaucagaagacuaaaaacagaagcacaaaugucaauacaacuaaucaacaaagccguaaacgcacuuauaaaugaccaauuaaucaugaaaaaccaccuacgagacauaaugggaauaccauacugcaauuauucuaaauauugguacuuaaaccacacaguaacaggcaaaacuucucuuccacgaugcuggcuaguaucaaacggaucuuaccuaaacgaaacacacuucucagacgacauagaacaacaagccgacaacaugaucacagaauuacuacaaaaagaauauaucgacagacaagguaaaacaccacuaggacuagucgaccuauucgucuucucaacaucauucuaccuaauaucaaucuucuuacauuuaguaaaaaucccaacccaucgacauguaauaggaaaacccuguccuaaaccacaccgauuaaaccacaugggaauauguagcugcggacuuuacaaacauccaggcguaccaguaaaauggaaaagauaa

SEQ ID NO: 2782 - RNA, 1473 nt, Artificial Sequence
  derived and/or modified CDS sequence (opt6) from Lassa virus__AIT17752__GPC
augggacaaauaauaaccuuuuuucacgaaguuccucauguaauagaagaaguaaugaacaucguauuaauagcauuaucauuauuagcaauacuaaaaggcauauacaacgucgccacuugcggacuauucggauuaguaucauuucuacuacuaugcggcagaucaugcucaacuaccuacaaaggcguauaugaauuacaaacacuugaauuagacauggcaucccuaaauaugacaaugccacuaucaugcacaaaaaauaacucucaccauuauauaauggucgguaaugaaaccggacuagaacuaacauuaacuaacacaucaauaauaaaccacaaauucuguaaccucucagacgcccacaaaaaaaaccuauacgaucacgcauuaaugucaauaauaagcacauuccaccucucuauaccuaauuucaaccaauacgaagcaaugucaugugacuucaacggaggaaaaauaagcguucaauauaaucucucacacaccuacgcuauagacgcagcaaaccauugcggaaccauagcaaacggaguccuacaaacauuuaugcguauggcauggggaggaucauacaucgcauuagacucuggaagaggcucuugggacugcauaaugacuucauaucaauauuuaauaauccaaaacaccacuugggaagaccacugucaauucucaagaccaucaccaauuggauauuuaggauuauuaagucaacgaacaagagacauauacauuucacgaagauuacuaggaacauucacauggacacuaucagacucagaagguaaugaaacacccggaggcuacugccuaacaagauggaugcuaaucgaagcagaacuaaaauguuuuggaaauacagcaguagcaaaaugcaacgaaaaacaugacgaagaauucugcgacaugcuccgacuuuucgauuucaacaaacaagccauaagaagauuaaaaacagaagcccaaaugucaauacaauuaauaaauaaagccguaaacgcauuaauaaacgaccaacuaauaaugaaaaaccaccucagagacauaaugggaauaccauacugcaacuacucaaaauacugguaucuaaaucacaccguuacaggaaaaacaucacuaccacgaugcugguuaguaucuaacggaucuuaucuaaacgaaacucauuuuucagacgacaucgaacaacaagcugacaacaugauaacagaauuauuacaaaaagaauauauagauagacaaggaaaaacaccacuaggacuuguagaccuauucguauucagcacaucauucuacuuaaucucaauauuccuacacuuaguaaaaauacccacacaucgacacguuaucggaaaaccaugcccaaaaccccacagacuaaaccacaugggaauaugcucaugcggauuauacaaacauccaggaguacccguaaaauggaaacguuga

SEQ ID NO: 2783 - RNA, 1473 nt, Artificial Sequence
  derived and/or modified CDS sequence (opt6) from Lassa virus__AIT17756__GPC
augggucaaauuauaacuuucuuucaagaaguaccacacgugauagaagaaguaaugaacauaguccucauagcacuaucauuacuugccauauuaaaagguauauacaacguagcaaccugcggccuauucggacucgucucauucuuacuauuaugcggacgaucuugcucuauaacauacaaaggaguauacgaauuacaaacauuagaacuagacauggcuucacuuaacaugacaaugccccuaucuugcacaaaaaacaacucccaccacuacauaauggucggaaaugaaacaggacuagaacuaacauuaacaaacaccucaauaaucaaccauaaauuuugcaaccuuucagacgcacacaaaaaaaaccuauacgaccacgcauuaaugucuauaauaucaaccuuccauuuaucaauaccaaacuuuaaucaauaugaagcaaugucaugcgacuuuaacggaggaaaaauaucaguacaauacaaccuaagccauaccuacgccguugaugcagcaaaccacugcggaacaauagcaaauggcguccuacaaacauuuaugcgaauggcaugggguggaucuuauauagcauuagacucaggaagaggaucaugggacugcauaaugaccucauaccaauauuuaauaauccaaaacacaacaugggaagaccacugccaauuuucuagaccauccccaauuggauaccuaggauuauuaucacaaagaaccagagauauauauauuucaagaagacuacuuggaaccuucacauggacacuaucagacucagaaggaaaugaaacaccaggcggauacugccuaacacgcuggauguuaauagaagcagaauuaaaauguuuuggaaauacagcuguagcuaaaugcaacgaaaaacacgacgaagaauucugugacauguuacgacuauucgauuuuaacaaacaagcaauaagaagacuaaaagccgaagcccaaaugucaauacaauuaauaaacaaagcaguaaacgcacuaaucaacgaucaacuaauaaugaaaaaucaccuaagagacauaauggguauaccauacuguaacuacuccaaauacugguaucuaaaucauaccguuacuggaagaacaucauuaccaagaugcugguuaguaucaaauggaucauaccuaaacgaaacucacuucucagacgacauugaacaacaagcagacaacaugauaacagaacuacuacaaaaagaauauauagauagacaaggaaaaacaccauuaggcuuagucgacuuauucguuuucucaacauccuucuauuuaaucucaauauuccuacaccucgucaaaauacccacccauagacacaucaucggcaaaccaugccccaaaccccauagacuaaaucacaugggcauaugcuccugcggacuauacaaacauccugguguuccaguaaaauggaaaagauaa

SEQ ID NO: 2784 - RNA, 1473 nt, Artificial Sequence
  derived and/or modified CDS sequence (opt6) from Lassa virus__AIT17758__GPC
augggucaaaucaucacauuuuuccaagaagucccucauguaauagaagaaguaaugaauaucguguuaauagcacuuucucuccuagccauacuaaaaggaauauauaacguagccacaugcggacuauucggacuuguaucauuccuauuauuauguggaagaucuugcuccaccacauauaaaggaguuuacgaacuacaaacacuagaauuaaacauggcuucacuaaacaugacaaugccacucucaugcacuaaaaauaauucacaccacuauauaaugguaggcaacgaaaccggauuagaacucacacuaacaaauacaucaauaauaaaccacaaauucuguaaucuaucagacgcacacaaaagaaacuuauaugaccacgcauuaaugucaauuauaucaacauuccaucuaucaauaccaaacuucaaucaauaugaagcaaugucaugugauuucaacggcggaaaaauaucaguacaauacaaccuaucacacacauaugcaguagacgccgccaaacacugcggaacaauagcaaacggaguccuccaaaccuucaugagaauggcauggggaggaucauauauagcacuagacaguggaaaaggauccugggauugcauaaugacuucauaccaauaccuuauaauacaaaacacaacaugggaagaucacugugaauuuuccagaccaucacccauaggcuauuuaggacuauuaucccaaagaacaagagacauauauauauccagacgacuacucggaaccuucacauggacacuaucugauucagaagguaacgaaacaccuggaggcuacugcuuaacacgauggaugcuaauagaagcagaacuaaaauguuucggaaauaccgcugucgccaaaugcaaugaaaaacacgacgaagaauuuugcgacaugcuaagauuauuugauuucaauaaacaagcaauacguagacuaaaagcagaagcccaaaugucaauacaacuaauaaacaaagcagugaacgcccuaauaaacgaucaauuaauaaugaaaaaucaccucagagauauaaugggaauaccuuacugcaacuacuccaaauacugguacuuaaaccacacagucaccggcaaaacaucucucccaagaugcuggcuaguuucuaacggaucauacuuaaacgaaacacacuucucagacgacauagaacaacaagcagacaacaugaucaccgaacuacuacaaaaagaauacauagacagacaagguaaaacaccccuaggccuaguagaucuuuuugucuuuucaaccuccuucuacuuaauaucaauauuucuccaccuggucaaaauaccaacacacagacacguaauaggaaaaccaugccccaaaccucauagacucaaccacaugggaauaugcucaugcggacuauacaaacacccaggaguaccuguaaaauggaaaagauaa

SEQ ID NO: 2785 - RNA, 1473 nt, Artificial Sequence
  derived and/or modified CDS sequence (opt6) from Lassa virus__AIT17762__GPC
augggacaaauuauaacauucuuucaagaagucccacacguaauagaagaaguaaugaacauaguauuaauagcuuuaagcuuacuagcuauauuaaaaggaauauauaacguagcaacaugcggucuauucggacucgucucauuccuccuauuaugcggucgaucauguucaacaacauacaaaggaguauacgaauuacaaacucuagaauuagacauggcaucacuaaacaugaccaugccauuaagcuguacaaaaaacaacucacaccauuacauuaugguaggaaaugaaacaggauuagaacuaacacuaacaaacacuucaauaaucagccacaaauuuugcaaccucuccgacgcacauaaaaaaaaccuuuacgaucacgcauuaaugucuauaauaucaacuuuccaccucucuauaccaaacuucaaccaauacgaagcaaugucaugcgacuuuaacggcggcaaaaucucaguacaauacaaccuaucccauacauacgcaguugaugcagcuaaccacugcgguacaaucgcaaauggagucuuacaaacauuuaugagaauggcauggggcggaucauauauagccuuagacucaggaaaaggaaguugggacuguaucaugacaucauaucaauauuuaauaauacaaaacacaacaugggaagaucauugccaauuuagccgucccucaccaauaggauaccuaggacuauuaucucaacgaacacgagauaucuauauaucacgcagacuucuaggaacauucacauggacacuaucugacagcgaaggaaacgaagcaccuggcggguacugcuuaacaagauggaugcuaauagaagcagaacuaaaauguuuuggaaauacagccguagccaaaugcaacgaaaaacacgaugaagaauuuugcgauaugcucagacucuucgacuucaauaaacaagcaauacgaagacuaaaaacagaagcccaaauguccauacaacuaauaaacaaagcaguaaacgcacucauaaaugaucaauuaauaaugaaaaaucaccuaagagacauaaugggaauuccauacuguaauuacucacgauauugguaucuaaaccacaccguaacaggcaaaacaucacuaccaagaugcuggcucguaucuaacggaucauaccuaaaugaaacacauuucucagacgacauagaacaacaagcagauaacaugauaacagaacuacuucaaaaagaauacauggacagacaaggaaaaacaccacuaggacuugucgaucuauuuguauucuccacaucuuucuaucuaauaucaauuuuucuacaucuaguaaaaauaccaacacacagacacguaaucggaaaacccugcccuaaaccacauagacuaaaucacaugggaauauguucauguggauuauacaaacauccaggagucccaguaaaauggaaaagauaa

SEQ ID NO: 2786 - RNA, 1473 nt, Artificial Sequence
  derived and/or modified CDS sequence (opt6) from Lassa virus__AIT17770__GPC
augggacaaaucguaacauuuuuccaagaaguaccacacguaauagaagaagucaugaacauaguacuuauagcacuaucucuauuagcaauacuuaaaggaauauacaacgucgccacaugcggacuauuuggacuaguauccuuccucuuauuaugcggaagaucaugcucaacaacauacaaaggaguauaugaauuacaagcacuagaguuagacaugucaucucuaaacaugacgaugccccuauccugcaccaaaaauaacucacaccacuauauaaugguaggaaacgaaacaggacucgaacuaacauuaaccaacacaagcaucauacaccacaaauucugcaaucuaucagaugcacauaaaaaagaccucuaugaucaugcacuaaugucaauaauaucuacauuucaccugucaauaccaaauuucaaccaauaugaagcaaugucaugcgacuuuaacggaggaaaaauauccguccaauauaaucuaucacacaccuacgcaguagacgcugccaaucauugcggaaccauagcaaauggaguacuucaaacauuuaugagaauggcuugggguggaucauacauagcuuuagacuccggaaaaggaggaugggacugcaucaugacaucauaccaauuccuaaucauacaaaacacuaccugggaagaccauugccaauuuucucgucccucuccaauaggcuauuuaggacuauuaucucaaagaacaagagacauauacauaucaagaagacucuuagguacauucacauggacauuaucagacucagaaggaaacgaaaccccaggaggauacugccuaacaagauggauguuaauagaagcagaacuaaaauguuucgguaacacagcaguagcaaaauguaaugaaaaacacgacgaagaauucugcgacaugcuaagauuauucgauuucaacaaacaagcaaucaaacgacuaaaaacagaagcacaaaugagcauacaccuaauaaacaaagcugucaaugcauuaaucaacgaccaacuaauaaugaaaaaucaccuaagagacaucaugggaauacccuauuguaacuacucaaaauacugguaccuaaaucacacagucacaggcaaaacauccuuaccaagaugcuggcuaguaucuaauggauccuaucuuaacgaaacacacuuuucagacgacauugaacaacaagcagauaauaugaucacagaacuacuacaaaaagaauacaucgacagacaaggcaaaacacccuuaggauuaguugaccuauuugucuucucuacaucauuuuauuuaauaucaauauuucuacaccuaguaaaaauacccacacaccgacauguaaucggaaaacccugcccaaaaccccacagauuaaaccacaugggaauaugcucauguggacucuacaaacauccaggaguaccaguuagauggaaacgcuaa

SEQ ID NO: 2787 - RNA, 1473 nt, Artificial Sequence
  derived and/or modified CDS sequence (opt6) from Lassa virus__AIT17778__GPC
augggccaaauaauuacauucuuucaagaaguaccacacguaauagaagaaguuaugaacauaguauuaauagcuuuaucauuacuagcaauauuaaaaggaauauauaacguugcuaccugcggucuauuuggccuaguaucauuccuauuacuaugcggccgcuccugcucaacaacauacaaaggaguuuacgaauuacaaacacuagaauuagauauggccaaccucaacaugacaaugccccucucuuguacuaaaaacaauucccaucauuacauuaugguaggaaaugaaacaggacuugaacucacacuaacaaacacaucaauaauaaaucacaaauucugcaaccuaucagacgcccacaagaaaaaccuauacgaccacgcacuaauguccauaauaucaacauuccaccuaaguauaccaaacuuuaaccaauacgaagcaaugucaugcgacuucaauggaggaaaaauaucaguucaauacaacuuaucccacaccuacgcaagagacgcugccaaccauuguggaacaauagcaaauggcguucuacaaaccuucaugagaauggcauggggaggaucauauauagcacuagauucaggcaaaggaucaugggauugcauaaugacaucauaucaauaccuaauaauacaaaauacuacaugggaagaccacugccaauucucacgaccauccccaauagguuaucuaggauuauuaucacaaagaacaagagacaucuacauaucacgacgacuauuaggaaccuucacauggacacuaucagauucagaaggcaaugaaacaccaggaggauacugccuaacuagauggaugcuaauagaagcugaacuaaaaugcuucggcaacaccgcagucgcaaaauguaacgaaaaacaugaugaagaauuuugugacaugcuacgauuauucgacuucaacaaacaagcuauaagaagauuaaaaacagaagcacaaaugaauauccaacucauaaauaaagcaguaaacgcccuaaucaaugaccaacuaauaaugaaaaaccaucuaagagacauaauggguauaccauacugcaacuauuccaaauauugguacuuaaaccacacuguaacaggcaaaaccucacuaccaagaugcuggcuaguauccaacggcucauaccuaaaugaaacacacuucucagacgacauagaacaacaagcagauaacaugaucacagaacuacuccaaaaagaauacauggaccgacaaggaaaaacaccccuaggucuugucgaccuauucguuuucuccacaucauucuauuuaaucuccauauuuuuacauuuaguaaaaaucccaacacaccgacacguuauaggaaaaccaugcccaaaaccacacagacuaaaccacaugggaauauguuccugcggauuauacaaacacccaggaguacccgucaaauggaaaagauaa

SEQ ID NO: 2788 - RNA, 1473 nt, Artificial Sequence
  derived and/or modified CDS sequence (opt6) from Lassa virus__AIT17782__GPC
augggccaaaucauaacauucuuccaagaagucccacaugucauagaggaaguaaugaacauaguucucauagcauuaucacuacuagcaauuuuaaaaggaauauauaacguagcaacaugcgguuuauucggacuaguuucauuccuauuacuauguggaagaucauguucaacaacuuauaaaggcguauaugaauuacaaacuuuagaacuugauauggcaucccuaaacaugacaaugccccuaucaugcacaaaaaacaauucacaccacuacauaaugguaggaaaugaaaccggacuugaauuaacccuaacuaacacauccauuauaaaucacaaauuuugcaaccuauccgacgcacacaaaaaaaaccuauaugaucacgcacuaaugucaauaauauccaccuuccauuuaucaauacccaauuuuaaccaauacgaagcaaugucaugcgacuucaacggcggaaaaaucucaguacaauacaauuuaucucacacauacgccguugacgcagccaaccacuguggaacaauagcaaauggaguauuacaaaccuucaugcgaauggcauggggagguagcuacaucgcacuagauuccggcaaaggaagcugggauugcauaaugacaucuuaucaauaucuaaucauacaaaauacuacaugggaagaccauugccaauuuucaagaccaagcccaauuggcuacuuaggacuauuaucacaaagaacaagagacauauacauaucaagacgauuacuaggcaccuuuacauggacuuuauccgacucagaaggaaacgaaacaccaggaggauacuguuuaacaagauggaugcuuaucgaagcagaauuaaaaugcuuuggaaacacagcaguggcaaaaugcaacgaaaaacacgacgaagaauucugugauaugcuaagacuauucgacuucaacaaacaagcaauaaaaagacuaaaaacagaagcacaaaugucuauacaauuaauaaauaaagcaguaaacgcucuaauaaacgaccaacuaaucaugaaaaaccacuuaagagacauaaugggaaucccauauugcaacuauucaaaauacugguauuuaaaucauacuguaaccggaaaaacaucucuacccagauguugguuagucuccaacggcucauaucuaaaugaaacacacuuuucagacgacauagaacaacaagcagauaacaugauaacagaauuauuacaaaaagaauacauagaucgacaaggcaaaacaccccucggauuaguagaccucuuuguauucucaacaucauucuaucuuauauccauauuucuucaccuuguaaaaauaccuacacaccgacacguaguugguaaaccuugcccaaaaccacauagacucaaccacaugggcauauguucaugcgguuuauacaaacacccaggagucccaguaaaauggaaacgcuaa

SEQ ID NO: 2789 - RNA, 1473 nt, Artificial Sequence
  derived and/or modified CDS sequence (opt6) from Lassa virus__AIT17786__GPC
augggacaaauaauaaccuucuuucaagaaguuccacacguuaucgaagaaguaaugaacaucguacuaauagcacuaucacuccuugcaauacuaaaaggcauauauaacguagcaaccugcggauuauuuggacuagucuccuucuuacucuuaugcggcagaucuugcucaaccacauacaaaggagucuacgaacuacaaacauuagaauuagauauggccucacuuaauaugacuaugccucuaucaugcacuaaaaauaacucucaucacuacauaaugguaggaaacgaaacaggauuagaacucaccuuaacaaauacaucaaucauaaaucacaaauucuguaaccugucugacgcacacaaaaaaaaccuauacgaucacgcccuaaugaguaucauaagcaccuuccaucuaagcauaccaaauuucaaucaauacgaagcaaugucaugugauuucaacggcggcaaaauaucaguacaauauaaccuaucacacgcuuacgcaauagacgcagcagaccacugcggaaccauagcuaacggaguccuacaaacauuuaugagaauggccuggggcggaucauacauugcacucgauucuggaaaaggaucaugggacugcaucaugacauccuaucaauauuuaauaauacaaaacacaacaugggaggaucacugccaauuuucacgaccuucaccaauaggauauuuaggacuacuaucacaaagaacacgugauaucuauauaucacgaagauuacuaggaacauuuaccuggaccuuauccgauuccgaaggaaaugagacaccaggcggauauugccuaacacgauggauguuaauagaagcagaacuuaaaugcuucggaaacacagccguagcaaaaugcaacgaaaaacacgacgaagaauucugcgacaugcuacgauuauucgacuucaacaaacaagcaauacgacgauuaaaaacagaagcacaaaugucuauacaacuaauaaacaaagcagucaaugcacuaauaaacgaccaacuaauaaugaaaaaccauuuaagagacauaauggguaucccauacugcaauuacucaaaauacugguaucuaaaucacacaguaacuggcaaaacaucccuaccaagauguuggcuaguaucaaauggaucauacuuaaacgaaacccacuucucagaugacauugaacaacaagcagauaacaugauaacagaacuccuacaaaaagaauauauggaccgacaaggaaaaacaccacucggacuagucgauuuauucguauuuagcacaaguuucuaccuaaucucaauauuuuuacauuuaguaaaaauccccacacacagacauaucacaggaaaaccauguccuaaaccacacagauuaaaucauaugggaauauguucauguggacucuauaaacacccuggaguaccagucaaauggaaacgauaa

SEQ ID NO: 2790 - RNA, 1473 nt, Artificial Sequence
  derived and/or modified CDS sequence (opt6) from Lassa virus__AIT17790__GPC
augggccaaauaauaaccuuuuuucaagaagucccacauguaauagaagaaguaaugaauauaguauuaauagcacucucauuacuagcuauccuuaaaggaauauacaacguagcaacuugcggucuauucggacuaguaucuuuccuacuauuauguggacgaucaugcucaacaacauauaaaggaguauacgaacuacaaacacuagaacuagacauggcaucacucaacaugacaaugccccuauccugcacuaaaaauaauucccaccauuacauaauggucggaaacgaaacuggauuagaacuaacauuaacaaacacaucuauaauaaaccacaaauuuugcaaccuaucagacgcccacaaaaaaaacuuauaugaccacgcccuaaugucaauaauaucuacguuccacuuaucuauuccaaauuucaaccaauacgaagcuaugucaugcgacuucaacggcggaaaaauauccguacaauacaacuuaucacacacauacgcaguagacgcagcuaaucacugcgguacuaucgcaaacggcguacuacaaacauucaugagaauggcauggggaggaucuuacauagcauuagauuccggaaaaggcucaugggacugcauaaugacaucauaucaauacuuaauaauacaaaacacuacaugggaagaccacugucaauuuucuagaccaucaccaaucggauauuuaggacuauuaucacaaagaacccgagauauauauauaucacguagacuacucgggacauucacauggacacuaucugauucagaaggaaacgaaacccccggaggauacugccuuacacgauggauguuaauagaagccgaauuaaaaugcuucggaaacacagcagucgcaaaaugcaacgaaaaacacgacgaagaauucugcgauaugcucagauuauucgauuucaacaaacaagcaauacgacgauuaaaaaccgaagcccaaaugaguauacaacucauaaacaaagcuguaaaugcucuaauaaaugaccaauuaauuaugaaaaaccacuuaagagacauaaugggaaucccauauugcaacuacucaaaauacugguacuuaaaccacaccguaacaggaaaaacaucucuaccucgaugcugguuaguauccaauggaucauauuuaaacgaaacacacuuuuccgacgacauagaacaacaagcugacaacaugauuacugaauuauuacaaaaagaauacauggacagacaaggaaaaacaccccucggacuaguagaucuauucguauuuuccacauccuucuaccuaauaucaauauuccuacaccuaguaaaaauacccacacacagacacauaacaggcaaacccugcccaaaaccacacagacuaaaccauaugggaauauguucuugcgguuuauacaaacaccccggagucccaguaaaauggaaaagauaa

SEQ ID NO: 2791 - RNA, 1473 nt, Artificial Sequence
  derived and/or modified CDS sequence (opt6) from Lassa virus__AIT17798__GPC
augggacaaaucauaacauucuuccaagaagugccacacguaauagaagaagucaugaacauaguccuaauagcacuauccuuacuagcaauacuaaaaggaauauacaacgucgccacaugcggccuauucggucuuguaagcuuccuccuccucugcggacguuccugcucaaccaccuacaaaggcguauacgaacuucaaacacuagaauuagacauggcaucacuaaauaugacuaugccucuuagcugcacaaaaaacaauucccaucacuauaucaugguaggaaacgaaacaggacucgaauuaacccuuaccaauacauccauaauaaaccacaaauucugcaaucuuucagacgcacacaaaaaaaacuuauacgaccacgcccuaaugucuauaaucucaacauuccacuuauccauaccaaauuuuaaccaauacgaagcaaugucaugcgacuucaacggaggaaaaaucucaguccaauacaacuuaucacacacauacgcaguagacgcagcuaaccauugcgguacuauagccaauggaguauuacaaacauucaugagaauggcauggggaggauccuauaucgcauuagacucaggaaaaggaucaugggacugcauaaugacuuccuaccaauacuuaauaauacaaaacaccacaugggaagaccauugucaauuuucacgaccaucaccaauaggauaccuuggcuuauuaucacaacgcacacgcgacauauauauaucaagaagacuacuuggaacuuucaccuggacacuuuccgauucagaagguaacgaaacaccaggaggauacugccuaacuagauggaugcuaauagaagcagaacuaaaaugcuuuggaaacacagccguagcaaaaugcaacgaaaaacacgacgaagaauucugcgacaugcucagacuauucgacuucaauaaacaagcaauaaugagacuaaaaacagaagcacaaaugucaauacaacuaauuaacaaagcaguuaacgcacuaauaaacgaccaauuaauaaugaaaaaccauuuacgagacauaaugggaauacccuacuguaacuacucaaaauauugguacuuaaaccacacuguaacaggaaaaacaucccuaccaagaugcuggcuaguaucaaacggaucuuaucuaaacgaaacacauuucuccgaugauauagaacaacaagcagacaauaugauaaccgaaaugcuacaaaaagaauaucuugauagacaaggaaaaaccccacuaggauuagucgacuuauucguauucucaaccucauuuuacuuaauaucuauauuccuacaucuaguaaaaauaccuacccacagacacauaauaggaaaacccuguccaaaaccacacagauuaaaucauaugggcauuugcucauguggauuauacaaacaccccggaguccccguaaaauggaaaagauaa

SEQ ID NO: 2792 - RNA, 1476 nt, Artificial Sequence
  derived and/or modified CDS sequence (opt6) from Lassa virus__AIT17802__GPC
augggacaaauaguaacauucuuccaagaagucccacaugucauagaagaaguaaugaacaucguacuaauagcacucucaauacuagcaguacuaaaaggacuauauaaccuagcaaccugcggacuagucggacuaguaacauucuuacuauuaugcggaagaucaugcaccacaucacuauauaaaggaguauacgaacuacaaacacuagaacuaaauauggaaacccuaaacaugacaaugccacuaucaugcaccaaaaacaacucccaucauuacauaauggucggaaaugaaacaggccuagaauuaacauuaacuaacacuucaaucaucaaucacaaauucuguaaccuaucagaugcacacaaaaaaaaucuauacaaccacgcauuaauguccauaaucucaacauuccacuuaucaauccccaacuuuaaccaauacgaagcaaugucaugugacuucaauggcggaaaaauaucaguacaauauaacuuaucacacucauaugcuggagaugcagcaaaccauugcggaacaguagcaaacgguguuuuacaaacauuuaugagaauggcauggggaggaucauauauagcuuuagacucuggacgcgauagaugggauuguauaaugacaucauaccaauauuuaauaauacaaaauacaacaugggaagaccacugccaauucucaagacccucaccaauaggauacuuaggccuauuaucacaaagaacaagagacauauauauauccagacgacuauuaggcacuuucaccuggacacuauccgacucugaagguaaagacaccccuggagguuacugccuaacaagauggaugcuaauagaagcagaauuaaaauguuucgggaacaccgccguagcuaaaugcaaugaaaaacacgaugaagaauucugcgacauguuacgacuauucgauuucaacaaacaagccauacaaagacuaaaagcagaagcacaaaugucaauacaacucauaaacaaagcgguaaaugcacucauuaaugaccaacuaauaaugaaaaaucacuuacgagacauaaugggaauaccauacugcaauuauucaaaauacugguaucuaaaccacacaacuacaggaaaaacaucauuaccaaaaugcugguuaguaagcaacggaucauaccuaaaugaaacccacuucucagaugacauugaacaacaagcugacaauaugauaacagaaauguuacaaaaagaauauauggaaagauuaggaaaaacaccauuaggucuagucgaucuuuucguuuucaguaccucuuuuuaucuaaucucaaucuuccuacaucuaguaaaaauacccacacacagacauauugucggaagaucaugcccaaaaccacaccgauuaaaucacaugggaauauguucuugcggauuauauaaacaacccggaguaccagucaaauggaaaagauaa

SEQ ID NO: 2793 - RNA, 1476 nt, Artificial Sequence
  derived and/or modified CDS sequence (opt6) from Lassa virus__AIT17806__GPC
augggacaaauagucacauucuuccaagaaguuccccauguaauagaagaaguaaugaacauaguauuaaucgcauuaucuauacuagcaguauuaaaaggacuguacaacuucgccacuugcggacuaauaggucuaguuacauuccuauuacuauguggacgcuccugcacaacaagucuauacaaaggaguauacgaacuucaaacacucgaacuaaacauggaaacccuaaauaugaccaugccacucaguugcaccaaaaauaacucucaccauuauauaauggucggaaacgaaacaggacuagaacuaacacuuacaaacacaucaauuauaaaucacaaauucuguaauuuaucagacgcccacaagaaaaaccuauacgaccaugcacuaaugucaauaauaucaacauuccacuuaucuauaccaaacuuuaaccaauacgaagcaaugucaugcgacuucaacggaggaaaaauaucaguacaauacaacuuaucacauuccuacgcaggagacgcagcuaaccacuguggaacagucgcuaauggaguacuacaaacauucaugagaauggcauggggcggauccuauauagcacuagauucuggcagaggaaaaugggacugcauaaugacaaguuaucaauaccuuauaauccaaaacaccacaugggaagaccacugucaauucucuagaccaagcccaauaggauaccucggauuacucucacaaagaacaagagacauauacaucucacgaagacuacuaggaacauucacguggacacuaucagacuccgaaggcaaagacacaccagguggauacugccuaacccgauggauguuaauagaagcagaacuaaaaugcuucggaaacacagccguagcuaaaugcaaugaaaaacaugacgaagaauuuugcgacauguuaagauuauucgacuucaacaaacaagccauacaaagacuaaaagcagaagcacaaaugucaauucaacuaauaaauaaagcaguaaaugcucuaauuaacgaucaacuaauaaugaaaaaccaccuuagagauauaaugggaauacccuacuguaacuacuccaaauacugguacuuaaaucacacaacaacaggcaaaaccucucuaccuaaauguuggcuaguaagcaauggauccuaucuaaaugaaacacacuucagugacgacaucgaacaacaagcagauaacaugauaacagaaaugcuacaaaaagaauacauggaaagacaaggcaaaacacccuuaggucuaguagaucuauuuguauuuucaacuuccuucuaccuaaucucaaucuuucuacaucuaguaaaaauuccaacacacagacauauaguaggaaaauccugcccaaaaccucacagacuaaaccauaugggaauaugcucaugcggacucuacaaacaaccaggaguucccguuaaauggaaaagauaa

SEQ ID NO: 2794 - RNA, 1476 nt, Artificial Sequence
  derived and/or modified CDS sequence (opt6) from Lassa virus__AIT17810__GPC
augggacaaauaguaacauucuuccaagaaguaccucauguaauagaagaaguaaugaauauaguacucauagcauuauccauacuagcaguacuaaaaggauuauauaauuuagcuaccuguggccuaguaggccuaguaacuuucuuacuauuaugcggaagaucuugcacaaccagcuuauauaaaggaguauacgaacuacaaacccuagaacucaauauggaaacacuaaacaugacaaugccauugucaugcacaaaagacaauagucaucacuauaucagaguaggaaacgaaacaggauuagaacuaacacucacaaauacaucaauauuaaaucacaaauucuguaaccucuccgacgcccacaagaaaaauuuauacgaccacgcacuuaugagcauaauaucaacauuucaccuaagcauaccaaacuuuaaccaauacgaagcaauguccugcgauuucaacggaggaagaauaucaguacaauacaaucuaucacacuccuacgcaggagacgccgcaaaccacugcggaaccguugcaaacggaguucuacaaacauucaugagaauggcauggggaggaucauacauagcauuagauucaggaagaggaagaugggauugcauaaugacuucauaccaguacuuaauaauacaaaauacaacaugggaagaccacugccaauucucucgaccaaguccaauaggauacuuaggacuacucucacaaagaacaagagauaucuacauauccagaagacuacuaggaacauuuacauggacauuaagcgauucugaaggaaaagacacacccggaggauacugucuaacaagauggaugcuaaucgaagcagaacuaaaauguuucggaaacacagcaguagccaaaugcaacgaaaaacacgaugaagaauuuugcgacaugcucagacuauucgauuucaauaaacaagccauacaaagacuaaaagcagaagcacaaaugagcauacaauuaauaaacaaagcaguaaacgcccuaauuaacgaucaacuaauaaugaaaaaccacuuaagagacauaaugggaauacccuauugcaacuacagcaaauacugguacuuaaaccacacuacaacuggcaaaacaucacuaccacgcugcuggcuaguaagcaacggaucuuaccuaaacgaaacacacuuuucugacgauauagaacaacaagcagauaauaugauaacagaaaugcuacaaaaagaauacauggaaagacaaggaaaaacaccccuaggcuuagucgaccuauucguauucucuacaucauucuaucuaauuucaauauucuuacaccuuguaaaaauaccaacacauagacacgucguaggcaaaccaugcccgaaaccacaccgacucaaucacaugggaauaugcuccugcggacucuacaaacaaccaggagucccaguaaaauggaaaagauaa

SEQ ID NO: 2795 - RNA, 1476 nt, Artificial Sequence
  derived and/or modified CDS sequence (opt6) from Lassa virus__AIT17814__GPC
augggacaaauaguaacauucuuccaagaaguaccgcacgucauagaagaaguaaugaacauaguacuaauagccuuaucaauucucgccgucuuaaaaggacuauacaacuuugcaacauguggcuuaguaggacucguaacauuucuacuacuaugcggaagaucauguacaacaucguuauacaaaggagucuacgaauuacaaacacuagaacuuaauauggaaaccuuaaacaugacaaugccacuaaguuguaccaaaaacaauucacaccacuauauaauggucggaaacgaaacaggacuugaauuaacccuaacuaacacaagcaucauagaccacaaauucugcaaccuuagugaugcacacagaaaaaacuuauacgaucacgcucuaaugucuauaaucucaacuuuucaccuaucaauaccaaacuucaaucaauaugaagcaaugucaugugacuucaacggaggaaaaauuaguguacaauacaaccuaagccauaguuaugcaaaagacgccgcagaucauugcggaacuguugcaaauggaguacuacaaacauucaugcgaauggcauggggugguucauauauagcccuugauuccggaagaggaagaugggacuguauaaugacaagcuaccaauaccuaauaauccaaaacacuacaugggaagaccauugccaauucuccagaccaucaccaauaggauacuuaggacuacucucccaaagaacucgugacaucuacauaucaagacgacuauuaggaacauucaccuggacacuaucagauagcgaaggaaaagacacucccggaggcuacugcuuaacaagauggauguuaauagaagcagaacuaaaaugcuucggcaacacagcaguagcaaaaugcaacgaaaaacacgacgaagaauucugcgacaugcuuagacuauucgacuucaacaaacaagccauacaaagauuaaaagcagaagcgcaaaugagcauacaauuaauaaacaaagcagucaacgcauuaauaaacgaccaauuaauaaugaaaaaccaccuacgagauauaaugggaauuccauacuguaauuacucaaaauauugguacuuaaaccauacaacaacuggcaaaacaagcuugccaaaaugcuggcuuguaaguaacggcucauauuuaaacgaaacccacuucucagacgacauagaacaacaagcagacaacaugauaacagaaaugcuucaaaaagaauacauggaaagacaaggcaaaacaccauuaggccuaguagaccuauucguauucucaacaaguuuuuacuuaauaucaauauuucuacauuuaguaaaaauaccaacacacagacacauagucggaaaaccaugcccaaaaccucaccgccuaaaccacaugggaauauguucaugcggacuauacaaacaaccaggaguuccaguaaaauggaaaagauaa

SEQ ID NO: 2796 - RNA, 1476 nt, Artificial Sequence
  derived and/or modified CDS sequence (opt6) from Lassa virus__AIT17820__GPC
augggccaaaucgucacauucuuucaagaaguaccacacguaauugaagaaguaaugaauauaguacuuauagcacuaagcauacuagcaguccuaaaaggcuuauauaauuuugcuacaugcggauuaguaggccuagucaccuuccucuuacuauguggaagaucauguacaacaucccuauauaaagguguauacgaacuacaaacacuagaauuaaacauggaaacauuaaacaugacaaugcccuuauccugcacuaaaaauaacagccaucauuacauuauggucggaaacgaaacaggacuagaacuaaccuuaacaaacacaucaauaauuaaucauaaauuuugcaaccuaucagaugcacacaagaaaaacuuauaugaccaugcacucaugucaauaauaaguaccuuccaucuuagcauaccaaacuucaaccaauacgaagcuaugagcugugacuuuaacggaggcaaaauaagcguacaauauaacuuaucccacucauaugcagaagacgcagcaaaucacuguggaacaguagcaaauggcguacuacaaacauucaugcgaauggccuggggcggaaguuauauugcacuagacucaggaagaggaaacugggacuguauaaugaccuccuaucaauauuuaauaauacaaaauacaacaugggaagaccauugucaauucucaagacccucaccaauaggcuacuuaggacuacuaucacaaagaacaagagacauauauauaucaagacgauuacuaggaacauuuacauggacacuaucagauucagaaggaaaagacacaccaggaggauauugucuuacuagauggaugcuuaucgaagcagaacuaaaaugcuuuggaaauacagccguagcaaaaugcaacgaaaaacaugacgaagaguucugcgacaugcucagacuauucgacuuuaauaaacaagcaauacaaagacuaaaagcugaagcucaaaugucaauacaacuaauaaacaaagcaguaaacgcacuaauaaaugaucaauuaaucaugaaaaaccaccuaagagacaucaugggaauaccauauuguaauuacucaaaauauugguaccuaaaccacacaaccacaggaaaaacaucacuaccaaaaugcuggcuuguauccaacggcucauacuuaaacgaaacacacuucucagacgacauagaacaacaagccgacaauaugauaacagaaauguuacaaaaagaauacauggaaagacagggaaaaacaccacuagggcuaguagauuuauuuguauucucaacuucauucuaccuaauaucuauauuucuucaccuaguaaaaauaccaacacacagacauauaguaggaaaaucaugcccaaaaccacaccgucuaaaccacaugggcauuugcucuugcggacuauacaaacaacccggaguuccaguaaaauggaaaagauaa

SEQ ID NO: 2797 - RNA, 1476 nt, Artificial Sequence
  derived and/or modified CDS sequence (opt6) from Lassa virus__AIT17824__GPC
augggacaaauaguaacauuuuuucaagaagucccacacguaauagaagaaguaaugaacauuguacuaauugcacuaucaauacucgccguauuaaaaggacuauauaauuucgccacauguggccuaguaggacuaguaaccuuucuauuacuaugcggaagauccugcacaacaaguguauacaaaggaguauacgaacuacaaacauuagaacuaaauauggaaacauuaaauaugacaaugccuuuaucuuguacaaaaaacaacucacaccacuauaucaugguaggaaacgaaacaggacuagaacuuacauuaacaaacacauccauaaucaaucauaaauuuuguaaucuauccgacgcacacaaaaaaaaucucuaugaccaugcacuaaugucuauaaucucuaccuuccaccuaagcauaccaaacuucaaccaauacgaagcuaugucaugugacuuuaacggaggcaaaauaucaguacaauauaaccuaucucacucuuacgcaggagacgcagcaaaccacugcggaacaguagccaauggcguucuacaaacauuuaugagaauggcuuggggugguucauacauagcguuagauucuggccauggaaaaugggacugcauuaugacuuccuaccaauaucuaauaauacaaaacacaacaugggaagaccauugucaauucucaagaccauccccaaucggauacuuaggacuauuaucacaacgaacaagagacaucuacauaucaagaagacuacuaggaacauuuacuuggacauuaucagauuccgaaggcaaagacacaccaggaggauacugucucacaagauggauguuaauagaagcagaacuaaaauguuucggaaacacagcaguagccaaaugcaacgaaaaacaugaugaagaauucugcgauaugcuucgacuauucgauuucaacaaacaagccauacaaagacuaaaagcagaagcacaaaugucaauacaacuaauaaacaaagcaguaaaugcacuaauaaacgaccaauuaauuaugaaaaaucaccuacgagacauaaugggaauacccuauugcaacuauagcaaauacugguauuuaaaccauaccacaaccggaaaaacuucacuaccuaaaugcuggcuagucucgaacggaucauaucuaaacgaaacacacuuuucugaugauaucgagcaacaagcagacaauaugauaaccgaaaugcuccaaaaagaauacauggaaagacaaggaaaaacuccauuaggacuuguugaccuauucguauucucaacaucauuuuacuuaauaucaauuuuccuacaccuuguaaaaauaccaacacacagacacauaguaggaaaaucauguccaaaaccacacagauuaaaucauaugggcauaugcaguugcggccuauacaaacaacccgguguuccaguaagauggaaaagauaa

SEQ ID NO: 2798 - RNA, 1476 nt, Artificial Sequence
  derived and/or modified CDS sequence (opt6) from Lassa virus__AIT17828__GPC
augggacaaauagucacauucuuucaagaaguaccacauguaauagaagaagucaugaauauuguacuaauagcauuaucaauacucgcaguacuaaaaggauuauacaacuucgcaacauguggccuaguaggccuaguaacauucuuauuacucugcggacgaaguugcacaaccucauuauacaaaggagacuaugaauuacaaacacucgaacucaacauggaaaccuuaaacaugacaaugccacucagcugcaccaaaaauaacucccaccauuauauuaugguaggaaacgaaacaggauuagaacuaacacuaacaaauaccagcauaauuaaccacaaauuuugcaaccuaucagaugcacacaagaaaaaccuauacgaucacgcauuaaugucaauaauaucaacauuccauuuauccauaccaaauuuuaaccaauaugaagcaaugucaugcgacuuuaacggaggaaaaauaucgguacaauacaaccuuucucacaguuacgcaggagaugcagcuaaucauugcggaacaguagcaaacggaguucuucaaacauucaugcgaauggcuuggggaggaucauacaucgcacuugacucaggaagaggcaauugggacuguaucaugacaucauaccaauaccucauaauacaaaauacaaccugggaagaucacugccaauucucaagaccaucaccaauaggcuauuuaggauuauuaucacaacgaacacgagauauauacauaucaagaagacuacuaggaacuuucacauggacccuaucagacucagaagguaaagauacacccggaggcuacugccuaacaagauggaugcuaauagaagcagaacuaaaaugcuucggaaacacagcaguagcaaaaugcaaugaaaaacacgacgaagaauuuugugacauguuaagacuauucgauuucaauaaacaagccauacaacgauuaaaagcugaagcacaaaugucaauccaacucauaaacaaagcaguaaacgcccuaauuaacgaccaauuaauaaugaaaaaucaucuacgagacauaaugggcauuccauacuguaacuacuccaaauacugguauuuaaaccacacaacaacaggaaaaacaucacuaccaaaaugcuggcuaguaucaaauggaucguacuuaaaugaaacacacuucucagacgacauugaacaacaagccgacaacaugauaacagaaaugcuacaaaaagaauauauggaaagacaaggaaaaacaccucuaggacucgucgacuuauucguauuuucaacaucauucuacuuaaucaguauauucuuacauuuaguaaaaauuccaacacauagacauauaguagguaaaucaugccccaaaccacauagacuaaaccacaugggaauauguuccugcggacuauacaaacaaccaggcguaccaguaaaauggaaaagauaa

SEQ ID NO: 2799 - RNA, 1473 nt, Artificial Sequence
  derived and/or modified CDS sequence (opt6) from Lassa virus__AIT17836__GPC
augggacaaauaauaacuuucuuccaagaaguaccacacguaauagaagaaguaaugaauaucguacuaauagcauuaucacuauuagcaauauuaaaaggacuauauaacaucgcuacauguggcauaauaggucuaguagcauuccuuuuucuaugcggaaaauccuguucacuaacacuaaaaggaggauacgaacuccaaacauuagaacuaaacauggaaacccucaacaugaccaugccuuuaucauguacuaaaaauucaagccaucacuacauuagaguuggaaaugaaacaggauuagaacuaacacuaacaaauacaucuauaauaaaucauaaauucugcaaccucucugaugcacacaagaaaaaccuauaugaccacgccuuaaugucaauaauaucaacauuccaccuaucaaucccaaacuucaaccaauacgaagcuaugaguugugauuucaacggaggaaaaaucucaguacaauacaacuuaucccacucauaugccggagacgcagccgaacacuguggaacuguagcuaacggcguacuacaaacauucaugagaauggcauggggcggaagauauauagcacucgacucaggaaaaggaaacugggacugcauaaugacaucauaucaauacuuaauaauacaaaacacaaccugggaagaccacugucaauucagcagaccauccccaauaggauaccuaggauuauuaucucagagaacucgugacauauauauaucuagacgacuacucggaaccuucacauggacccuaucugauucagaaggaaacgaaacacccggaggcuauuguuuaacaagauggaugcucauagaagcagaacucaaaugcuucggaaacacagcagucgcaaaaugcaaugaaaaacacgacgaagaauuuugcgacauguuaagacuauucgacuuuaacaaacaagcaauaagacgauuaaaagcagaagcucaaaugucuauacagcuaauaaacaaagcaguaaacgcauuaauaaacgaccaauuaauaaugaaaaaucaccuuagagacauaaugggaauaccauacugcaacuacucaaaauacugguacuuaaaccacacaucaucaggaagaacaagccuaccaaaauguuggcucauaucaaacggcucauaccuaaacgaaacacaauucagcgacgacauagaacaacaagcagacaauaugauaacagaaaugcuccaaaaagaauacauagaaagacaaggaaaaaccccacuaggccucguagacauauuuauauucucaacauccuucuauuuaauaagcauauuucuacauuuaauaaaaauaccuacacacagacauaucgucggaaaaccauguccaaaaccacaucgacuaaaucacaugggagucugcucuuguggacuuuauaaacacccaggaguacccacaaaauggaaaagauaa

SEQ ID NO: 2800 - RNA, 1476 nt, Artificial Sequence
  derived and/or modified CDS sequence (opt6) from Lassa virus__AIT17840__GPC
augggacaaauaguaacauucuuccaagaagucccccacguaaucgaagaaguaaugaacauaguauuaauagcuuuaucaauacucgccguacuaaaaggauuauacaacuucgcaacauguggacucguaggauuaguaaccuuccuacuauuauguggccgaucaugcacaauuucacucuacaaagguguauacgaauuacaaacacuugaacucaacauggaaacacuaaauaugacaaugccacuaucaugcacuaaaaauaacucacaccacuacauaaugguaggaaaugaaacaggacuagaauuaacacuaacuaauacaucaauaauuaaccauaaauuuuguaaccuaucagacgcucauaaaaaaaaucucuacgaccaugcuuuaaugucaauaaucuccacauuccaucuaucaauaccaaacuucaaccaauacgaagccaugucaugcgacuucaauggaggaaaaaucucuguucaauauaacuuaucccacuccuacgcaggagacgcagccaaccacugcggaaccguugcaaacggcguauuacaaacauucaugcgcauggcauggggaggaucauacaucgcacuagauucaggaagagacagaugggauugcauaaugacuuccuaccaauaccuaauuauacaaaauaccacaugggaggaccacugucaauuuagccgaccaucaccaauaggauaccuaggucuauuaucccaaagaacaagagacaucuauauuucuagacgacuacuaggaacauucacauggaccuuaagcgauagugaaggaaaagacacaccagguggauacuguuuaaccagauggauguuaauagaagcagaacucaaaugcuucggaaacacagcaguagcaaaaugcaacgaaaaacaugacgaagaauuuugcgacaugcuaagacuuuucgacuuuaacaaacaagcaauacaaagauuaaaagcagaagcacaaaugucaauacaacuaaucaacaaagcaguaaacgcccuaauaaacgaccaauuaauaaugaaaaaccaucuacgagacauaaugggcauaccuuacuguaacuacucaaaauauugguaccuuaaucacacaacaacuggaaaaacuuccuuaccaaaaugcuggcucguaucuaaugguucauacuuaaacgaaacacauuucucagacgacaucgaacaacaagcagacaacaugauaacagaaaugcuucaaaaagaauacauggaaagacaagguaaaacaccacuaggacugguugaucuauucguuuucucaacaucauucuacuuaauaucaauauucuuacaccuaguaaaaauaccaacacauagacacauagucgguaaaccauguccaaaaccacacagauuaaaccauaugggaauaugcucaugcggauuauauaaacaaccuggaguuccuguaaaauggaaaagauaa

SEQ ID NO: 2801 - RNA, 1476 nt, Artificial Sequence
  derived and/or modified CDS sequence (opt6) from Lassa virus__AIT17844__GPC
augggccaaauaguaacauucuuccaagaagucccacauguuauagaagaaguaaugaauaucguucucauagccuuaucaauccucgcuguccuaaaaggacuauauaauuucgccacaugcggacuagucggauuaguaacauuucuucuauuaugcggaagauccugcacuauaucccuauauaaaggagucuaugaacuacaaacacuagaacuaaacauggaaacacuaaacaugacaaugccauuauccugcacaaaaaauaacucucaucauuacaucaugguaggaaacgaaacaggacuagaacuuacacuaaccaacacaucaauaauaaaccauaaauucugcaaucuauccgaugcgcauaaaaaaaaccuuuacgaccacgcacuaaugucaauuauaucuacauuccaucuuucaauacccaacuucaaccaauaugaagccaugucaugcgacuucaacggaggaaaaauaucaguacaauauaaccuuagccacucauaugccggagaugcagcaaaccauugcggaacaguagcuaauggaguauuacaaaccuucaugcgcauggccuggggaggaagcuacauagcucuagauagcggaagagacagaugggacuguaucaugaccucauaccaauaccuaaucauacaaaacacaacuugggaagaucacugccaauucucaagaccauccccaauuggauacuuaggccuauuaucacaaagaaccagggauauauacauaucacgccgacuucuaggaacauucaccuggacccuaucagacuccgaaggaaaagauacaccaggcggauauugcuuaacaagauggaugcuaauagaagcagaauuaaaauguuucggaaacacagcaguagcuaaaugcaacgaaaaacacgaugaagaauucugcgacaugcuaagauuauucgacuucaacaaacaagcaauacaaagacuuaaagcugaagcacaaaugucaauacaauuaauaaacagagcugucaacgcauuaaucaaugaccaacuaauaaugaaaaaccaccuuagagacauuauggguauuccuuauugcaacuacucaaaauacugguaccuaaaccacacaaccacagguaaaacaucacuacccaaaugcuggcuuguaucaaauggaucauauuuaaaugaaacacauuuuucagacgauaucgaacaacaagcagacaacaugauaaccgaaaugcuacaaaaagaauauauggaacgccaaggaaaaacaccauuaggauuaguagaccuuuucguauuuucaacauccuucuaccuaauaucaauuuucuuacacuuaguaaaaauaccaacccacagacacauaguagguaaaccaugcccaaaaccacacagacuaaaucacaugggaaucuguucaugcggauuauacaaacaaccuggcgugcccguaaaauggaaacgauaa

SEQ ID NO: 2802 - RNA, 1473 nt, Artificial Sequence
  derived and/or modified CDS sequence (opt6) from Lassa virus__AMR44577__GPC
augggacaaauaauaaccuuuuuccaagaaguaccucacguaauagaagaaguaaugaacauaguacuaauagcacuaucacuacuagcaauacuaaaaggcguauacaauguagcuacaugcgguauaauaggauuaguaacauuucuauuccuauguggacgaucaugcucacugaucuacaaaggaucauaugaacuacaaacacuagaacuaaauauggaaacauuaaacaugacaaugccauuaucauguaccaaaaacucuucacaccacuauauaagagucggaaaugaaacaggacuagaacuaacauuaacuaauaccuccauaauaaaccauaaauucuguaacuuaucagacgcacauaaaagaaaccucuacgaucaugcacuuauguccauacuaucaacauuccacuuaucaauaccuaacuucaaucaauaugaagcaaugucuugcgauuucaauggaggaaaaaucuccguacaauauaaucuuucacacgcuuacgcaguugacgcagccgaacacuguggaacaguagcaaacgguguacuacaaacauucaugagaauggcauggggaggcucauacaucgccuuagacaguggacgaggaaacugggacugcauaaugacaucauaccaauaccuaauaauccaaaacacuacaugggaagaccacugccaauucuccagacccucuccaauuggcuaccuaggacuccucucacaaagaaccagagacauauacauaucacgcagauuacuaggaacauuuacguggaccuuaucagauucagaaggcaaugaaacucccggagguuacugcuuaacacgauggaugcuaauugaagcagaauuaaaauguuucggaaacacagcaguagcaaaaugcaacgaaaaacacgacgaagaauuuugcgacauguuacgacuauucgacuucaacaaacaagcaauacaaagauuaaaaucagaagcacaaaugucuauacaacuaauaaacaaagcaguaaacgcucuaauuaacgaccaacuaauaaugaaaaaccaccuacgagacaugaugggaauaccauacugcaacuauucaaaauauugguauuuaaaccauaccucaucuggacgcacaucucuaccaaaaugcuggcuugucucaaacggaucauaccuaaacgaaacacacuucucagaugacauagaacaacaagcagauaauaugauaacagaaauguuacaaaaagaauacaucgaucgacaaggaaaaacaccacuaggauuaguagaucuauucguauucucaacaucauucuacuuaauaucaaucuucuuacaucuaauaaaaauaccaacucauagacauauaguagguaaaccauguccaaaaccacacagacuaaaccauauggguauaugcucaugcggacuauacaaacaaccaggcguaccaacaagauggaaacgauaa

SEQ ID NO: 2803 - RNA, 1476 nt, Artificial Sequence
  derived and/or modified CDS sequence (opt6) from Lassa virus__ANH09722__GPC
augggccaaauagucacauuuuuucaagaaguaccacacguuaucgaagaaguaaugaauaucguacuuauagcacuaucaauacuugcaguacuaaaaggacuauacaacguagcaaccuguggauuaaucggccucguaacauuccuacuacuaugcggaagaucauguaccacaacacucuacaaaggaguauacgaacuccaagcauuagaacucaacauggaaacgcuaaacaugacaaugccccuauccuguacaaaaaauaacucucaucauuauauaagagucggaaaugaaaccggauuagaauuaacccuaacaaacacaucacuaauaaaccacaaauucuguaacuuauccgacgcacauaaaaaaaaucucuacgaccaugcacuaaugucaauuauaucaacauuucaucuauccauaccaaacuucaaccaauacgaagcaaugucuugcgacuucaaugauggaaaaauaucaguacaauacaaccuaucccacacauaugcaggcgauacagcuaaccauugcggaaccguugcaaacggcguacuacaaacauucaugcgaauggcauggggaggaucauauauagcauuagacucaggacgcggcggaugggacugcaucaugacaucauaucaauacuuaaucauacaaaacaccacaugggaagaucauugucaauucucuagaccaucuccaauaggauacuuaggccuacucucccaaagaaccagagauaucuacaucaguagaagacuacuaggaaccuucaccuggacacuaucagacucugaaggaaaagacaccccaggcgguuauugucuaacacguuggaugcuaauagaagcagaacuaaaaugcuuuggaaacacagcaguagcaaaaugcaacgaaaaacacgaugaagaauuuugcgauaugcucagacucuucgacuucaacaaacaagcaauacagagacuaaaagcagaagcacaaaugaguauacaacuaauaaacaaagccgucaacgcacuaaucaacgaccaacuuauaaugaaaaaccacuuaagagacauaaugggaauaccauauugcaacuacucaaaauacugguaccuaaaccacaccguaacaggaaaaacaucauuaccaaaauguugguuagucuccaacggaucuuacuuaaaugaaacccauuucucagacgacaucgaacaacaagcagacaauaugauaacugaaaugcuucaaaaagaauauauggaacgucaaggaaaaacaccuuuaggauuaguugaucuuuuuguauucucaaccuccuucuaucuaauaucaaucuuccuccaccuaguaaaaauacccacacacagacacgucguaggaaaaccaugccccaaaccacacagacuaaaucacaugggcauaugcucaugcggauuuuacaaacaaccaggaguaccaguaagauggaaaagauaa

SEQ ID NO: 2804 - RNA, 1476 nt, Artificial Sequence
  derived and/or modified CDS sequence (opt6) from Lassa virus__ANH09724__GPC
augggacaaaucguaacauucuuccaagaaguuccacacguaauagaagaaguaaugaacauaguacuaauagcccuaucaauacuugcaguucuuaaaggccucuacaacgucgcaacaugcggacucauaggacucguaacauuuuuacuacuauguggacgauccugcacaacaacacuauauaaaggcgucuaugaacuacaagcauuagaacuaaacauggaaacauuaaacaugaccaugccccuaucaugcaccaaaaacgacucccaccacuauauaaugguaggaaacgaaacaggccuagaacuaacacuaacaaacacaaguauaaucagccacaaauucugcaaccuauccgacgcacauaaacaaaacuuauacgaccacgcauuaaugucuauaauuuccacauuccaccuaucaauaccaaauuucaaccaauacgaagcaaugucuugcgacuucaacggcgguaaaauaucaguacaauacaacuuaucccacacauaugcaggagacgcagcaaaccacugcggaacaguagccaacggaguauuacaaacauuuaugcgaauggcauggggaggcucuuacauagcacuagacucaggaagaggcggaugggauugcauaaugacaucuuaccaauaucuaaucauccaaaacaccacaugggaagaccacugccaguucucccgaccauccccaauaggcuaucuaggacuauuaucacaaagaacucgagacauauacauauccagaagacuucuagguacauucacauggacccuaucagauuccgaaggaaaagauacacccggaggauacugccuaacucgcuggaugcuuauagaagcugaauuaaaauguuucgguaacaccgcaguagcuaaaugcaacgaaaaacacgaugaagaauuuugcgacauguuaagacuauucgacuucaacaaacaagcaauacaaagauuaaaagcagaagcacaaauguccauacaacuaauaaacaaagcaguaaaugcucuaauaaacgaucaacuaauaaugaaaaaccaccuucgagauauaaugggaauaccauauugcaacuauaguaaauacugguaccuaaaccacacuguaacaggaaaaacaucacuaccaaagugcugguuaguaucaaacggaucauaccuaaacgaaacacacuuuucagaugacauagaacaacaagcagacaacaugauaacugaaaugcuacaaaaagaauauauggaaagacaaggaaaaacaccauuaggccuaguagaccuauucgucuuuuccacauccuucuaccucauaucaauauuucuucacuuagucaagauucccacacauagacacguaguaggaaaaccaugcccaaaaccacacagacucaaccacaugggaauaugcucaugcggauucuauggacaaccaggaguaccaguaagauggaaaagauaa

SEQ ID NO: 2805 - RNA, 1476 nt, Artificial Sequence
  derived and/or modified CDS sequence (opt6) from Lassa virus__ANH09728__GPC
augggacaaauaguaacauucuuccaagaaguaccacacguaauagaagaaguaaugaacauaguauuaaucgcacuaucaguacuagcaguacuaaaaggacuauacaacguagcaacguguggauuaauaggucuaguaacuuucuuacuuuuaugcggcagaucaugcacaaccacacuauacaaaggagucuacgaauuacaagcauuagaacuaaacaugggaacacuaaacaugaccaugccccuaucaugcacuaaaaacaacucacaucacuauauuaugguaggaaacgaaacuggacuagaauuaacacuuacaaacaccuccauaauuaaccacaaauucugcaaccucucagaugcacacaagaaagaccuauaugaccacgcauuaaugucaauaauaucaacauuccaucuaagcguacccaacuuuaaccaauacgaagcuaugucaugugacuucaauggcggcaaaauauccguacaauauaaccuaagucacgcauacgcaggagacacagcaaaucacugcggaacagucgcaaacggcguacuacaaacauuuaugcgaauggcauggggugguuccuacauagcucuagauuccggaagaggcgguugggauuguauaaugacaucauaucaauaucuuauuauacaaaauaccacaugggaagaucacugccaauuuucaagacccaguccaauaggauaucucggacuauuaucacaacgaacacgugacaucuauauaucacgcagacuacuaggcacauucacauggacauuaucagacucagaaggagaauauacacccggaggauacugucuaaccagauggaugcuaauagaagcagaacuaaaaugcuucggcaauacagcagucgcaaaaugcaacgaaaaacaugaugaagaauuuugcgauaugcuaagacuauucgacuucaauaaacaagcaauacaacgacucaaagcagaagcccaaaugucaauacaauuaauaaauaaagcagucaacgcacuaaucaaugaccaacucaucaugaaaaaucaccucagagauauuauggguaucccauauuguaacuauucuaaauacugguacuuaaaccacacaguaacaggaaaaacauccuuaccaaaauguugguuaguauccaauggaucauaucuaaaugaaacucacuucucagaugauauagaacaacaagcagacaauaugauaacagaaauguuacagaaagaauacauggaaagacaaggaaaaacacccuuaggacucguagaccuauucguauucucaacaucauuuuacuugaucucuauauucuuacacuuagucaaaauacccacacacagacacguaguaggaaaaccaugcccaaaaccucaccgacuaaaucacaugggaauauguuccugcggauuuuacaaacaacccggcguaccaguacgauggaaacgauaa

SEQ ID NO: 2806 - RNA, 1476 nt, Artificial Sequence
  derived and/or modified CDS sequence (opt6) from Lassa virus__ANH09730__GPC
augggccaaauaguuaccuuuuuucaagaaguaccccacguaauagaagaaguaaugaauaucguccuaauagcccuaagcguuuuagcaguacucaaaggccuauauaauguagcaacauguggacuaaucggacuuguaacauucuuacuauuaugcggaagaucaugcacaacaacacuauauaaaggcgucuaugaauuacaagcccuagaauuaaauauggaaacucuaaauaugacuaugccacuaucauguacaaaaaacaauucucaucacuacauaaugguagguaaugaaaccggauuagaacucacauuaacaaacacgucaauaauaaaccacaaauuuugcaaccuaucagacgcacacaaaaaaaacuuauacgaccacgcacucaugucuauaauaucuacauuucacuuaucuauuccaaacuuuaaucaauacgaagccaugucaugugauuucaaucaaggaaaaauaucaguccaauauaaccuuagccacgcauacgcaggugacgccgcaaaucauugcggaacaguagcaaacggcguauuacaaacauucaugagaauggcauggggcggaaguuacauagcacuagauucaggaagaggaggaugggauugcaucaugacauccuaucaauaccuaaucauacaaaauacaacaugggaaaaucauugccaauucucaagaccaucaccaauaggauacuuaggauuacuaagccaaagaacaagagacauauacauaucaagaagauuauuaggaacauuuaccuggacacuaucagacucagaaggaaaaggcacaccaggaggauacugucucacuagauggauguuaauagaagcagaacuaaaaugcuucggaaacacagcaguagccaaaugcaacgaaaaacacgaugaagaauucugugacauguuaagacucuucgauuuuaacaaacaagcaauucaacgauucaaagcagaagcacaaaugucaauacaacuaaucaacaaagcaguaaacgcauuaauaaaugaccaacuaauaaugaaaaaccauuuaagagacauaaugggaauaccauauugcaacuauagcaaauacugguacuuaaaccacaccgucacaggcaaaacaucacuacccaaauguuggcuaguaucaaauggauccuauuuaaacgaaacacacuucucagaugauauagaacaacaagcagacaauaugauaacagaaauguuacaaaaagaauacauggaaagacaaggcagaacaccauuaggacuaguagacuuauuuguuuucucaaccucauucuauuuaauaucuauauuucuccaccuaguaaaaaucccuacacauaggcacguaguaggaaaaccuugcccaaaaccccaccgcuuaaaccacaugggaauaugcucaugcggauucuacaaacaaccaggcguccccguuagauggaaaagauaa

SEQ ID NO: 2807 - RNA, 1476 nt, Artificial Sequence
  derived and/or modified CDS sequence (opt6) from Lassa virus__ANH09732__GPC
augggacaaauagucacauucuuccaagaagucccacauguaauagaagaagucaugaauauaguacuaauagcacuaagcauacuagcaguccuaaaaggcguauacaauguagcaaccuguggacuuauagguuuaguaacauuccuacuacucuccggccgaucaugcaccacuacaauauauaaaggagucuacgaacuacaagcauuagaacuaaacauggaaacacuaaauaugaccaugccucuauccuguacuaaaaauaacucucaccacuauaucaugguugguaaugaaacaggcuuagaacuaacauuaaccaacacaucaauaauuaaccacaaauuuuguaauuuaucagaugcacauaaaaaaaaccuuuaugaccaugcacucaugucaaucauaucuaccuuucauuuauccauuccuaacuucaaucaauaugaagcaaugucaugugacuucaacggaggaaaaauauccguacaauauaacuuaucacauacauacgcuggagaugcagcaaaucacugcggcacuguugcaaacggcguacuacaaacauucaugagaauggccuggggaggcucauacaucgcacuagacucuggacacggaggaugggacugcaucaugacuucauaccaauacuuaauaauacaaaacaccacaugggaaaaccacugccaauucucaagaccaagcccaauuggauaucuagguuuacuaucacaaagaacaagagacauauacaucuccagaagacuuuuagguacuuuuacauggacccuuagcgauucagaaggcaaagacacaccaggaggcuacuguuuaacacgauggauguuaauagaagccgaacuaaaaugcuuugguaacacugcagucgcuaaaugcaacgaaaaacaugacgaagaauucugugauauguuaagauuauucgacuucaacaaacaagcaauacaaagacuaaaagcagaagcccaaaugucaauacaauuaauuaacaaagcugucaacgcauuaauaaaugaccaacucauaaugaaaaaccacuuaagagacauaaugggaauaccauauugcaacuacucaaaauacugguaucuaaaccacacaguuacaggaaaaacaucucucccaaaaugcugguuaguaucaaacggaucauacuuaaaugaaacucacuucucugacgauauagaacaacaagcagacaacaugauaaccgaaauguuacaaaaagaauauauggaaagacaaggaaaaacaccacuaggacuaguagaccuauuugucuuuucaacaucauuuuauuuaaucucaauauuuuuacaccucguaaaaauaccaacacauagacacauaguaggaaaaccaugcccaaaaccacauagauuaaaccacaugggaauauguucuugcggauucuacaaacaaccaggaguacccgucagauggaaaagauaa

SEQ ID NO: 2808 - RNA, 1473 nt, Artificial Sequence
  derived and/or modified CDS sequence (opt6) from Lassa virus__ANH09738__GPC
augggucaaauaguaacauucuuccaagaaguuccgcacguaauagaagaaauuaugaacauagucuuaaucacccuaucacuacuagccauacuaaaaggacuauacaacuuugcaacaugcggacucauaggauuaauaaccuucuuauuccuaugcggaagaucaugcucaaugauauacaaaggcuccuaucaacuagaaacacuagaauuaaacauggaaacacuaaacaugacaaugccacuauccugcaccaaaaacaacucccaccacuacauaagaguuggaaacgaaaccggacuagaauuaacauuaacaaauacaucaauaauuaaccauaaauuuugcaacuuauccgacgcacacaaaagaaacuuauaugaccacucauuaaugucuauaauaucaaccuuccauuuaucuauaccaaacuucaaucaauaugaagcaaugucaugugacuucaacgguggaaaaauauccauacaauacaacuuaucacauacauaugcaggagacgccgccaaacacugcggaacaguagcaaauggcguacuccaaacauucaugagaauggcauggggagggucauacauagcuuuagacucaggcagaggaaacugggacugcaucaugacaucauaccaauauuuaauaauccaaaauacaacaugggaagaccacugccaauucuccagaccaucuccaauaggauaccuaggacuauuaucacaaagaacaagagacauuuacauaucaagacgacuucuaggaacauucacuuggaccuuauccgacagcgaaggaaaagaaacaccuggaggauacugcuuaacacgauggaugcuaaucgaagcagaacucaaaugcuucggcaacacugcaguagcaaaaugcaaugaaaaacaugacgaagaauuuugugacauguuaagacuauucgacuucaacaaacaagcaauacaacgacucaaaacagaagcccaaaugucaauccaacuaauaaauaaagcaguaaaugcauuaauaaacgaucaauuaauaaugaaaaaccaccuuagagauauaaugggaauaccauacugcaacuacaguaaauacugguauuuaaaccacacaucaacaggaagaaccucacuaccaaaaugcuggcuaguaucuaacgguuccuacuuaaacgaaacacacuucucagacgauaucgaacaacaagcagacaacaugauaacugaaaugcuacaaaaagaauacauagacagacaaggcaaaacuccgcuaggucucguugaugucuucauguucagcacaucauucuaucuaauaucaauauuccuacauuuaguaaaaauaccaacacauagacauauaguuggaaaauccugccccaaaccacauagacuaaaucacaugggaaucuguucaugcggacuauauaaacaaccagggguaccaguaagauggaaaagguaa

SEQ ID NO: 2809 - RNA, 1473 nt, Artificial Sequence
  derived and/or modified CDS sequence (opt6) from Lassa virus__ANH09740__GPC
augggacaaauuguaacauucuuccaagaaguaccacaugucauagaagaaguaaugaauauaguccuaauagcccuaucacuucuagccauauuaaaaggucuauacaauuucgcaacaugcggaguaauuggacucauaacauucuuacuauuaugcggaagaucaugcucagccacauacaaaggacaauaugaauuacaaacauuagaacuaaauauggaaucacucaauaugaccaugcccuuaucaugcacaaaaaacaacucacaucauuacauacgagcaggaaacaacacaggacuagaauuaacuuuaacaaacacauccauuaucucacauaaauucugcaaucuaucagaugcacacaaaaaaaaucucuacgaucacacccuaaugaguaucauuacaaccuuccacuuaucaauaccaaacuuuaaccaauacgaagcaauguccugugauuucaauggaggaaaaauaucaauacaauauaaucuaagucacaguuaugcaggagacgccgcacaacacuguggcacaguagccaauggaguauuacaaacauucaugcgcauggccuggggaggaagcuaccuagcauuagacucaggcagacguggcugggauuguauaauauccucauaccaauaccuaauuauccaaaacacaacaugggacgaucauugccaauucagucgaccaucaccaaucggauaccuaggauucguaagccaaaaaacacgagacauauacauaucuagaagacucuuaggaaccuuuacauggacucuaucagacucugaaggucacgacaugccaggaggauacugcuuaacaagauggaugcuaauagaagcagaccuaaaaugcuuuggaaauacagcuguagcaaaaugcaaugaaaaacaugacgaagaauucugugauauguggagacuuuucgacuucaauaaacaagcuauacaaagauuaaaagcagaagcacaaaugaacauccaacuaauaaacaaagcaguaaacgcacuaauaaacgaucaacuaaugaugaaaaaucacuuaagagacauaaugggcauaccauacuguaacuauucaaaauucugguaucuaaacaauacaaccaccggucgaacaucacuaccaagauguugguuaaucucaaauggauccuauuugaacgaaacacacuuuucagaugacauagaacaacaagccgacaacaugauaacugaaaugcuacaaaaagaauauauggacagacaaggaaaaacaccauuaggauuagucgacuuauuuguauuuucaacaucuuucuacuuaauaacuauauuccuacaccuaguaaaaauaccuacccacagacauaucguaggaaaaccauguccaaaaccacaccgacuaaaccacaugggcaucugcucaugcgguuuauacaaacaaccaggaguaccaguacguuggaaacgauaa

SEQ ID NO: 2810 - RNA, 1473 nt, Artificial Sequence
  derived and/or modified CDS sequence (opt6) from Lassa virus__CAA36645__GPC
augggacaaauaguaacauuuuuccaagaaguaccucauguaaucgaagaaguaaugaauauaguacuaaucgcccuaucaauauuagcuauauuaaaaggacucuauaacguagcaaccugcggacuaauaggccuagucacauucuuacuacuaucaggcagauccugcucauuaauauauaaaggaaccuaugaacuacaaacacuagaauuaaauauggaaacucucaauaugaccaugccacuaucauguacuaaaaacaauucacaccacuauauaagagucggaaacgaaacaggacuagaauuaacacugacaaacacuucaauacuaaaccacaaauuuugcaauuuaucagaugcacacaaacgaaaccuauacgaccacucacuuaugucaauaauaucuacauuccaccuuucaauacccaacuucaaccaauacgaagcaaugagcugcgacuucaacggaggaaaaaucacaguucaauacaaccuaucacacucauucgcaguagacgcagcaggacacugcggcacccuagcuaauggaguauuacaaacauucaugagaauggccuggggaggauccuacauagcacuagacucaggaagaggaaacugggacugcauaaugacaucauaccaauaucucauaauacaaaacaccacaugggacgaccacugucaauuuucacguccaucaccaauaggcuaccuaggacuauuaucacaaagaacaagagauauauauauaucaagaagacuauuaggaaccuucaccuggacucuaucagauucagaaggaaaugaaacacccggaggauacugccuaacacgauggaugcuaaucgaagcugaacuaaaaugcuucggaaauacagcagucgccaaaugcaacgaaaaacacgaugaagaauuuugcgauauguuaagauuauucgacuucaacaaacaagccauacgcagacuaaaaacagaagcacaaaugucaauacaacuuauaaauaaagcaguaaacgcacuaauaaaugaccaauuaauaaugaaaaaucaccuaagagacaucaugggaauacccuacugcaauuacucuagauacugguacuuaaaccacacauccacaggaaaaacaucuuuaccaagauguugguuaauuucaaaugguucauaccucaaugaaacaaaauucagcgacgacaucgaacaacaagcagacaacaugaucacugaaauguuacaaaaagaauacaucgaccgacaaggcaagacaccuuuaggccuagucgaccuauuugucuucucaacaucauucuaccuaauaagcauauuucuacacuuagucaaaauaccaacacacagacauauaguaggaaaacccuguccuaaaccacacagacuaaaccacaugggaaucuguucaugcggacucuauaaacaaccaggaguccccgucagauggaaacgauaa

SEQ ID NO: 2811 - RNA, 1476 nt, Artificial Sequence
  derived and/or modified CDS sequence (opt6) from Lassa virus__NP_694870__GPC
augggccaaauaguaaccuucuuucaagaaguaccacacguaauagaagaaguaaugaauauaguacuaauagcucuaagcguucucgccgucuuaaaaggacuauacaacuucgcaacauguggccuaguaggauuaguaacauuucuacuccuaugcggacgaucaugcacaacaucacuauauaaaggaguauacgaacugcaaacacuagaacuaaacauggaaacacuaaauaugacaaugcccuuaaguugcacuaaaaacaacucccaccacuauauaauggucggaaacgaaacaggccucgaauuaacauuaacaaacacaaguauaauaaaucacaaauuuuguaaucuaagcgaugcacacaaaaagaauuuauaugaccacgcacuaaugucaauaauaaguaccuuucauuuaucaaucccuaacuuuaaccaauaugaagcaaugucuugcgauuucaacggaggaaaaauaucaguacaauauaacuuaucacacaguuacgcaggagaugcagccaaccacugcggcacuguagcaaacggaguacuccaaaccuucaugagaauggcauggggcggauccuauauugcacucgacaguggaagagguaacugggauugcaucaugaccucauaccaauauuuaauaauacagaauacaacaugggaagaccauugccaauuuucuagaccaucaccuauagguuacuuaggcuuauuaucacaaagaacacgagauauauacauauccagaagauuacuaggaacauuuacauggacacuaagugauagcgaaggcaaagacaccccaggagguuacugcuuaaccagauggauguuaauagaagcagaauuaaaauguuuuggcaauacagcaguagcaaaaugcaacgaaaaacacgaugaagaauuuugcgauaugcucagacuuuucgacuucaacaaacaagcaauccaaagauuaaaagcugaagcacaaaugagcauacaacuaaucaauaaagcaguuaaugccuuaauaaacgaccaacuaauaaugaaaaaccacuuaagagacauaaugggaauaccauacugcaacuauaguaaauacugguaucuaaaucacacaacuacaggccguacuucacugccaaaauguuggcuaguaagcaacggaucauauuuaaacgaaacacauuuuucagacgauauagaacaacaagcugauaacaugauaaccgaaaugcuucaaaaagaauacauggaaagacaaggcaaaacaccccucggucuaguagaccuauuugucuucagcacaaguuuuuacuuaauaucaauauucuuacaccuuguaaaaauaccaacacauagacacauaguaggaaaaucauguccaaaaccacauagacuaaaccacaugggaauauguagcugcggucuauauaaacaaccaggagucccaguaaaauggaaacgauaa

SEQ ID NO: 2812 - RNA, 1713 nt, Artificial Sequence
  derived and/or modified CDS sequence (opt6) from Lassa virus__AAA46284__NP
augagugcaagcaaagaaguaagaucaugccucuggacucaaucacuaaggagagaacuaucaggauacugcaguaauauaaaauuacaaguggucaaagaugcacaagcacuguuacauggacuugauuucucagaaguaucaaauguccaaagacuuaugagaaaacaaaagagagaugauggcgaccuaaaaagauuaagagauuuaaaucaagccguaaauaacuuaguugaauuaaaaucaacacaacagaaaagcguauuaagaguaggcacauuaaguagugacgauuuacuaauauuagcagcggaucuagaaaaauuaaaaucaaaaguaacaagaacugagagaccauuaucaucagggguauauaugggaaaccuaaguagucaacaacuagaucaaaggagagcauuauuaaacaugauaggaaugacaggagucucaggaggcggaaaaggagcaucaaauggaauaguaagaguaugggauguuaaaaaugcagaacuacucaacaaucaauuuggaacaaugccaucacucacauuagcaugcuuaacaaaacaaggacaaguagauuuaaacgaugcaguacaagcacuaacagauuuaggauugauauauaccgcaaaauaucccaacuccucagauuuagacagacuaagucaaucacauccaauauuaaauaugaucgauacaaagaaaucuucauuaaacauuagcggauauaacuucagccuaggggcugcaguaaaagcgggagcauguaugcuugacgggggaaauauguuagaaacaauaaaagucucuccacaaacaauggauggaaucuuaaaaucaauauuaaaaguaaagaaauccuuaggcauguucguaagcgauacucccggagaaagaaacccauaugaaaauaucuuauauaaaaucugccuaagcggagauggauggucuuauauugcaucaagaacaaguauaguugguagagcaugggaaaacacaguaguagaucuagaacaagacaacaagccgcagaaaauaggaaauggaggaagcaauaaaaguuuacaaagcgcaggauuugcagcuggauuaaucuauagccaauuaaugaccuugaaagacuucaaauguuuuaaucuaauaccaaacgcaaaaacguggauggacauagaaggaagaccagaagauccaguggaaauagcauuguaucaaccuucaagcgguugcuacguucauuucuuuagagaaccuacagacuuaaaacaguucaaacaagaugcaaaauauucucacggacgagacguaacagacuuauucgcugcacaacccggcuuaacauccgcgguuauagaagcacuuccaagaaacaugguuauaacaugccaaggaucagaagauauaagaaaauuacuagaaagucaaggaagaagagauauaaaacuaauagauauaacccuuuccaaagccgauagcagaaaauuugaaaacgcaguaugggaccaauucaaagaccuuugccacaugcauacaggagugguaguagaaaagaagaaaagaggaggaaaagaagaaauaacaccacauugcgcacuaauggauuguaucauguucgaugccgcagucucuggaggacuagacgccaaaguauuaagaguaguccuaccuagagauaugguuuucagaacuucuacgccaaaagucguuuuauaa

SEQ ID NO: 2813 - RNA, 1710 nt, Artificial Sequence
  derived and/or modified CDS sequence (opt6) from Lassa virus__AAF86704__NP
augucagcaucaaaagaagucaaauccuuuuuauggacacaaucacuucgacgagaauuaucaggauauugcucaaacauaaaacuacaaguuguaaaagacgcacaagcacuccuacacggacuagacuuuucagaaguaaacaauguacaaagacuaaugagaaaacaaaaaagagacgauggcgacuuaaaacgccugagagaucuaaaccaagcuguaaauaaucuaguagaacuaaaaaguacacaacaaaaaaguauccuaagaguaggaacacucacaucagaugaucuucuuacacuagccgcagaucuagaaaaacuaaaaucgaaaguaauaagaacagaaagaccucuaucaucaggaguauauaugggcaacuugucaacacaacaacuagaacaaagacgagccuuacuaaauaugauaggaauggucgguggagcacaagggacccaaccaggccgagauggugugguaagagugugggacguaaaaaacccagaucugcuaaauaaccaauuuggaacaaugccaagccucacacucgcaugccuaaccaaacaaggucaaguagauuuaaacgaugcaguuuuagcauuaacagaccuaggacuaauauacacagcuaaauacccaaauagcagugaucuagacagauuaucacaaagccacccaauauuaaacaugguugauaccaaaaagagcagcuuaaauaucucaggauauaauuucucgcuaggugcagccguaaaagcaggagcuuguauguuggauggugggaauauguuagaaacaauaaaaguaacaccacaaacaauggacgggauccuaaaaaguauacuaaaaguaaaaaggucacucggaauguuugucucagauacaccaggagaaagaaaccccuacgaaaauauacuauauaaaauaugucuaucaggagauggauggccauauauagcaucaagaaccaguauaguaggaagagcaugggaaaauaccacaguugaucuagaaagcgauggaaaaccacaaaaaguaggaacagcaggaucaaacaaaucacuacaaucagccggauuuccaacuggacuuacauauagccaauuaaugacauuaaaagacaguaugaugcaauuagaccccagcgccaaaacauggaucgacauagaaggaagaccagaagaccccguagagaucgcauuauaccaaccaaugaguggaugcuacauucauuucuuuagagaaccaacggauuuaaaacaguucaagcaagacgcaaaauacucacacggaaucgacguugcagaucucuucccagcacaaccaggucuaacaagugcuguaauagaagcauuaccaagaaacaugguacuaacaugucaaggaucagaugacauaaaaaaauuauuagacagucaaggaagaagagacauaaaacuuauagacaucagucuaucaaaaguagauucaagaaaauucgaaaaugcaguaugggaccaaugcaaagaucucugucauaugcacacaggaguuguuguagaaaaaaaaaaaagaggaggaaaagaagaaauaacaccacacugcgcauuaauggauuguauuauguuugaugccgcaguaagcgguggauuaaacauaccaguacuaagagcuguauuaccgcgcgauaugguauuuagaaccucaucacccaaaguuguauuauaa

SEQ ID NO: 2814 - RNA, 1710 nt, Artificial Sequence
  derived and/or modified CDS sequence (opt6) from Lassa virus__AAO59513__NP
auguccgccucaaaagaaguaaaaucauuuuuauggacacaaucauuaagaagagaacuaagcggauacuguucuaauaucaaauuacaaguaguaaaagacgcccaagcauuacuacacggucuagauuucagcgaaguaucaaauguccaaagacuaaugcgaaaagaaagaagagacgacucugacuuaaaaagauuaagagauuuaaaccaagcgguaaauaauuuaguugaacuaaaaucaacacaacaaaaaucaguacuaagaguagguacacuaacaagugaugaccuauuaguauuagcagcagauuuagaaaaauuaagaaguaaaguuacaagaacagaacgaccauuaucagccgguguauauaugggaaaucuuaguucacaacaacuagaucaaagacgagcacuacuaucaaugauaggaaugaacggaaguaaccaaggagcaagagccggaagagacggaguagucagaguaugggaugugaaaaacgccgaacuauuaaauaaucaauucggaacaaugccaucacuaacauuagcaugccuuacaaaacaaggacaaguagacuuaaaugaugcgguucaggcuuuaacggaccuaggauuaauauauaccgcaaaauauccuaauaccucagacuuggauagauuaacacaaagccacccaauccuaaauaugaucgacacaaagaaaaguagcuuaaacguaagcggauacaauuucagccuaggagcagcaguaaaagcaggagcauguaugcuagauggaggaaauauguuagaaacaauaaaaguaucaccucaaacaauggacggaauccuaaaauccauauuaaaaguaaagaaagcucuaggaauguuuauaagcgauacaccuggcgaaagaaacccuuaugaaaacauccucuauaaaauaugccuuucaggagauggauggccguacauagcaucacgaacgucuauaacugguagagcaugggaaaacacaguaguggaucuagaaagcgaugaaaaaccacaaaaagcugggaguaacaauaguaauaaaucauuacaaagugcaggauucacagcaggauuaacauauucacaacuaaugacacuaaaagaugcuauguuacaacuagaccccaaugccaaaacauggauggauauagagggaagaccagaagacccagucgaaaucgcucuauaucaacccaguagcggauguuauauacauuucuuuagagaaccuacagacuuaaaacaauuuaaacaagaugcaaaauauucccauggaauagauauaacagauuuauuugccgcucaacccggcuugaccagcgcaguaauagaugcacuaccccgaaauaugguaauaacaugucaaggaucagaugacaucagaaaauuauuagaaucacaagguagaaaagacauaaaauuaauagauaucgccuuaaauaaagcagacuccagaaaguacgaaaacgcaguaugggaucaauauaaagacuuaugucauaugcauacagguguagucguagaaaagaagaaaagaggcgguaaagaagaaauaacaccacauugugcacucauggauugcaucauguuugacgcagcaguuagcggaggauuaaaaacccuaguacuacgagcaguauuaccaagagauaugguauuuagaacaucaacaccacgaguuguccuauaa

SEQ ID NO: 2815 - RNA, 1710 nt, Artificial Sequence
  derived and/or modified CDS sequence (opt6) from Lassa virus__AAT48999__NP
augucaguauccaaagaaauaaaaucauuccuauggacacaaucauuaagacgagaacuuagcggauauugcucaaacauaaaauuacaaguaguaaaagaugcacaagcauuauuacacggucuagauuucucugaagucucaaauguacaaagacuaaugcgaaaacaaagaagggacgacaaugaccuaaaacgauugcgagaccuaaaucaagcaguuaacaacuuaguagaacuaaaaagcacccaacaaaaaaguguauuaagaguaggaacucucaccucagaugaccuuuuaauacuagcagcagacuuagaaaaacucaaaucaaaagugacacgaacagaaagaccacuaagcgcaggaguauacaugggaaauuuaucaagccaacaacuugaccaaagaagagcacuuuuaaauaugauaggaaugucaggaggaaaccaaggugcacaaacuggaagagacggugucgucagaauaugggacguuaaaaacgccgaacuacuaaauaaucaauuuggaacaaugccaagcuuaacacuagcauguuuaacaaaacaagggcaaguugaucucaaugacguaguacaagcacuaaccgaccucggacuuauauauacugcaaaauaucccaauacaucagacuuagacaggcuaacacaaucacauccaauuuuaaacaugauagauacaaaaaaaucauccuuaaauauaucagguuacaacuucucccucggcgcagcgguuaaagcaggagcgugcaugcuagacgguggaaacaugcuagaaacaauaaaaguaagcccccaaacuauggacggaauauuaaaaucuauauuaaaagucaaaaaagcacuaggcauguuuauuucugauacaccuggagaacgcaacccauacgaaaacauuuuguauaaaauaugucucucuggagacggauggccauauauagccucaagaacaaguauuacaggacgagcaugggaaaacacaguaguagauuuagaaucaggcgaaaaaccacaaaaaauaggaucaaauaacucaaauaaaugccuacaauccgcuggauuuacagccggacuaaguuauucccaauuaaugacacuaaaagaugcaaugcuacaacuagacccaaaugccaaaaccuggauggacauagaaggaagaccagaagacccaguagaaauagcacuauaccaaccauccaguggaugcuacauacacuucuucagagaaccaacagaucuaaaacaauuuaaacaagaugcaaaauauagccauggaauagacguaacagaucuauucgcagcacaaccuggacuaacuuccgcuguaauagaagcacuaccaagaaacaugguaaugacaugccaaggcucagaugacauucgaaaacuacucgaaagucagggaaggaaagacaucaaauuaauugacaucgcauuaagcaaaaccgauucaagaaaauacgagaaugcagucugggaccaauauaaagaccuaugccacaugcacacaggaguuguaguugaaaaaaaaaaaaaaggagguaaggaagaaauaacaccacauugugcauuaauggauugcauaauguuugaugcagcaguaucaggaggauugaacacaucaguucuaagagcaguucuaccaagagauaugguauuuagaacaaguacccccaaaguuguacuauaa

SEQ ID NO: 2816 - RNA, 1710 nt, Artificial Sequence
  derived and/or modified CDS sequence (opt6) from Lassa virus__AAT49007__NP
augucaguuagcaaagaaauaaaaucauucuuauggacacaaucauuaagaagagaacuaucaggauacugcagcaauauaaaacuacaagucguaaaagacgcacaagcauuacuacauggauuagacuuuucagaaguaucaaauguccaaagauuaaugagaaaacaaagacgagacgacaacgaucuaaaaagacuaagagaccuaaaucaagcaguaaauaaucuaguugaacuaaaaucaacucaacaaaaaucgguauuacgaguaggaacgcuaacaagugaugaucuacuaauuuuagcagccgaccuagaaaaacuuaaaaguaaaguaaccaggacagaacgaccauuaagcgccggaauauauaugggaaaccuaaguagucagcaacuagaccagagaagagcacuauuaaacaugauaggaaugagugguggaaaucaaggagcacaaacagggagagacggaguaguaagaauaugggacguuaaaaaugcagaauuacuuaauaaucaauuuggaacaaugccuuccuuaacauuagcaugcuuaaccaaacaaggacaaguagaccuaaacgauguaguacaagcacuaacagauuuaggccuaauauacacugccaaauauccuaauaccucagaccuagacagacuaacacaaucucauccaauauuaaacaugauagacacaaaaaagaguucauuaaacauaucaggcuacaacuuuagucuaggugcagcagucaaagcaggcgcuugcaugcucgacggcggaaauaugcucgaaacuauaaagguaucaccacaaacaauggacgguauacucaaaucaauacuaaaaguaaaaaaagcauuggguauguucauaucagacacaccaggagaacgaaacccauaugaaaauauacuuuacaaaauaugccuaaguggagauggguggccauacauagcuagucgaacaaguaucacagguagagcaugggaaaacaccguaguagaccuagaaucaggugaaaaaccccaaaaaauaggaucaaauaacaguaauaaaucccuacaaucagcaggauuuacagcaggacuaacauacagccaacuaaugacacucaaagaugcgaugcuacaacucgaccccaacgcaaaaacauggauggauauagaaggaagaccggaagacccaguagaaauagccuuauaucaaccaucaucagguugcuacauacacuucuucagagaaccaacagauuuaaaacaauucaaacaagaugcuaaauauagucauggaauagaugucacagauuuauuugcagcacaaccaggccuaacaucggcaguaauagaagcauuacccagaaauaugguaaugaccugccaaggaagugaugacauaaggaaauuauuagaaucacaaggaagaaaagacauaaaacuaauagauauagcccuaaguaaaacggacuccagaaaauacgaaaacgcaguaugggaccaauauaaagauuuaugccauaugcauacaggaguaguuguugaaaagaaaaaaaaaggagguaaagaagaaauaacaccacacugugcauuaauggacuguauaauguucgaugcugcggcaaguggaggccuaaacacacuaguauuaagagcaguauuaccaagagacaugguuuucagaacuucaaccccaaaaguaguacuauga

SEQ ID NO: 2817 - RNA, 1710 nt, Artificial Sequence
  derived and/or modified CDS sequence (opt6) from Lassa virus__AAT49009__NP
auguccgcaucaaaagaaguaaagagcuucuuauggacacaaagccucagaagagaacuaucaggauauuguucaaacauaaaauuacaaguaguaaaagacgcacaagcacuacuacacggacuagacuucucagaaguaaguaacguacaacgauuaaugagaaaacaacgaagagaugacggagaccugaaaagacugagagaucuaaaccaagccgucaauaacuuaguagaacuaaaaucuacucaacaaaaaucaguacuaagaguaggaacacuaaauucagaugacuuacucguacucgcugcagacuuagaaaaacucaaaucaaaaguuaucagaacagaaagaccacuaucaagcgguauauacaugggaaaucuaagcucucaacaacuagaucaaagaagagcacuacuaaacaugauaggaaugaccggaggaaaccgaggagguggcacaucaucagacggaauugucagaguaugggauguaaaaaaugcagagcuauuaaauaaccaauucggaacaaugcccucacuaacucuagcauguuuaacaaaacaaggacaaguagaccuaaaugaugccguccaagcacuaacugauuuaggacuaauauauacagcaaaauacccuaauucaagugaucuagauagauuagcacaaagucacccaaucuuaaacaugauagauacaaaaaaaucauccuuaaacaucucaggauauaauuucucccuaggagcagcaguaaaagcaggagcauguaugcuagacggagguaacaugcuagaaacaauaaaaguaucaccacaaaccauagauggaauauuaaaaacaauucuaaaaguaaaaaaaucccuaggaauguucauaagugaugucccaggagaacgaaauccauaugaaaacauauuauacaaaauaugcuuaucaggagauggauggcccuacauagcaagcagaacuaguauaguaggaagagcuugggaaaacacaguaguggaccuagaaagugacaauaaaccacaaaaaacaggaaauggagguaguaacaaaucauuacaaucagcaggauuugcagcuggauuaacauacucucaacuaaugacgcuaaaagacagcauguuacaauuagauccaaauuccaaaacauggauggacauagaaggccgaccagaagacccaguugaaauagcgcuauaccaaccuaacaguggaugcuauauacacuuuuuuagagaaccaacagaccucaaacaauuuaaacaagaugcaaaauacucacauggaauagacgucacugacuuauucgcagcccaaccaggacuaacaagugcgguaauagaagcauuaccaagaaacaugguaauaacaugccaagguucagaagacauuagaaaauuauuagaaagucaaggucgaagagauauaaaauuaauagauaucucacuuaacaaagccgacagcagaaaauuugaaaaugcuguaugggaccaauucaaagaucuaugucauaugcacacaggaguaguaguugaaaaaaaaaaaagaggaggaaaggaagaaauuacaccucauugugcauuaauggauugcauaauguuugacgcagcaguuucaggaggauuagacgcaaaaguuuuaagagcagugcuaccaagagauauggucuucaggacaagcacaccuaaaguaguucuuuaa

SEQ ID NO: 2818 - RNA, 1710 nt, Artificial Sequence
  derived and/or modified CDS sequence (opt6) from Lassa virus__ADI39452__NP
augaguguaucaaaagaaguaaaaaguuuuuuauggacacagagucuaagaagagaacuaucaggauacuguucaaacauuaaauuacaaguaguuaaagaugcucaagcacuccuucauggccucgauuucagcgaaguaucaaauguacaaaggcuaaugagaaaacaacgaagagacgauaaugacuuaaaaagacuacgagauuuaaaucaagccgucaacaacuuagucgaacuaaaaucaacacaacaaaaaagcguacugagagucggaacuuuaacaucagaugaucuacuaauauuagcugcagaucuagaaaaacuuaaaaccaaaguaacaaggacagagagaccauuaagcgcagguguauauaugggaaacuuaucaucacaacaauuagaacaacgacgagcuuuacuuaacaugauugggaugaauggagguaaucaaggaguacaagcaggaagagacggaguaguaagagucugggauguaaaaaacgcugagcuacuaaauaaucaauucggaaccaugccaucgcuaacacuagcaugucuaacuaaacaaggacaagucgaucuaaacgaugcaguacaagcuuuaacggauuuaggauuaauuuacacagccaaauauccaaauacaucugacuuagacagacuagcacaaagccacccaauacuuaacaugauugacacaaaaaaaucaucauuaaauauaaguggcuauaacuuuagucucggagcagcaguaaaagcaggugcauguaugcuagauggaggaaauauguuagaaacuauaaaagucaguccacaaacaauggacggaauauuaaaaagcauacuaaaaguaaaaagaaccuuaggaauguucguaagcgacacaccaggagaaaggaauccauaugaaaacauucuauacaaaauauguuuaaguggagacggauggccauauauagcaaguagaacauccaucacaggcagagccugggaaaacacaauaguugaucuagaaagugacggaaaaccacaaaaaguaggaaauaacggaagcaauaaaucauuacaaagcgcagguuuuacugcaggacuaacauauucucaacuaaugacauuaaaagaugccaugcuccaacuagauccaaaugcaaaaacauggauggacauugaaggaagaccagaagauccuguagaaguagcauuauaccaaccaaguucagguuguuacauacacuuuuucagagaaccaacggaucuaaaacaauucaaacaagacgcuaaauauucacacgggauagacguaacagaccuauuugcagcccaacccggacuaacaucagcaguuaucgaagcccuaccccgaaauaugguaauaaccugucaaggaucagaagacguaagaaaauuauuagaaucacaagggagaaaagauauaaaacucaucgacauagcucuauccaaagcagacaguagaaaauaugaaaaugcaguaugggaccaauacaaagaucuaugucacaugcauaccggaguaguaguggaaaaaaaaaaaaggggagggaaagaagaaaugacaccacacugugcccuuauggauugcauaauguuugacgcugcaguaaguggcggguuauccacacaaguauuaagggccguucucccacgagauaugguauucagaaccaguacuccaaaaguaguacucuga

SEQ ID NO: 2819 - RNA, 1710 nt, Artificial Sequence
  derived and/or modified CDS sequence (opt6) from Lassa virus__ADU56611__NP
augagcgcaucaaaagaaguaaaaaguuucuuauggacucaaucauuaaggagagaacucucaggauacugcucaaacauaaaacuacaaguaguaaaagacgcacaagcauuauuacacggauuagauuucucagaaguauccaauguacaaagacuaaugagaaaacaaaaacgagaugacggugacuuaaaaagacucagagacuuaaaccaagcaguaaauaaucuaguagaacuaaaaaguacucaacaaaaaagcguauuaagaguaggaacucuaacaagcgacgaccuuuuaacauuagcagccgaucuugaaaaacuaaaaucaaaaguaaucagaacugaaaggccauuaaguaguggaguauacaugggaaaccuaaguacacaacaacuagaacaacguaaagcauuauuaucaaugauaggaaugguaggaggagcacaaggaacccaaccaggacgagacggaguaguaagagucugggauguaaaaaauccagauuuauuaaacaaccaauucggaacaaugccuucuuuaacacuagcauguuuaacaaaacaaggccaaguagaucuaaacgaugcaguacuagcacuaacagaccuaggccucauuuacacagcuaaauauccaaauucaucagauuuagauagauuaucacaaagucauccuauauuaaauauggucgacacaaaaaaaucuucauuaaacauaucaggauacaacuucucauuaggagcagcagucaaagcaggagcaugcaugcuagacggaggaaacaugcuagaaacaaucaaaguaacaccacaaacuauggacgguauauuaaaaucaauauuaaaaguaaaaagaucacuagguauguucguaagcgauacuccgggagaaagaaacccauacgaaaauauauuauacaaaauuugucuaaguggagauggauggccauauaucgcaucaagaacauccauaguugggcgagccugggaaaacaccacaguagacuuagaaagugacggaaaaccccaaaaagucggaacagcaggaagcaauaaaucacuacaaagugcaggauuuccaacaggccuaacauacucacaacucaugacccuaaaagacaguaugaugcaacuagacccuagugcaaaaacauggauagacauagaaggacgaccagaagauccagucgaaauagcacuuuaucaacccaugagcggauguuauauacauuuuuuuagagaaccaaccgaucuaaaacaauucaaacaagaugcaaaauauucgcacggaauagacgucacagaucuauucagugcucaaccaggccuaacuucagcuguaauagaagccuuaccgagaaacauggucuuaaccugucaagguagcgaugauauuaaaaaacuccuagacagucaaggacggcgagacauaaaacuaaucgacauaucauuaaacaaagcagauucaagaagauucgaaaaugcuguaugggaucaauguaaggaccuaugucacaugcacacaggaguaguuguagaaaaaaaaaaaagaggcggaaaagaagaaauaaccccacacugcgcauuaauggauugcauaauguuugaugcagcaguaucaggaggacuaaacauaccaauacuaagagcaguacuaccaagagacauggucuucagaaccucaagcccaaaaguaguucuuuaa

SEQ ID NO: 2820 - RNA, 1710 nt, Artificial Sequence
  derived and/or modified CDS sequence (opt6) from Lassa virus__ADU56615__NP
augagcgccagcaaagaaguaaaaaguuucuuauggacacaaucauuaagaagagaauuaucaggauauuguagcaauauaaaacuacaaguaguaaaagacgcacaagcauuauuacacggacuagauuuuagugaaguaagcaauguccaacgucuaaugagaaaacagaaaagagaugacagcgauuuaaaacgacuacgagaccuaaaucaagccguaaauaaccuggucgaauuaaaaagcacacaacagaaaaguguauuacgaauuggaacgcuuucaagugaugacuuauuaauacuagcagcagacuuagaaaaauuaaaaaguaaaguuguaagaacagaaagaccacuaucaagcggaauauauauggguaaccuaaguucacaacaacuagaccaacgaaaagcguuauuaaacaugauuggaaugacagguggcaacgguggaagaaaugcaacaucagacgggauaguaagaguuugggauguuaaaaaugcagaauuacuaaauaaucaauucgguacaaugccuucacuaacacuagcaugcuuaacaaaacaaggacaaguagacuuaaaugacgcgguccaagcauuaacagacuuaggccuaauuuacaccgcaaaauauccuaauagcucagaccuagauagauuagcacaaagucauccaauauuaaacaugauagauacaaagaaaucauccuuaaacauuagcgguuauaauuucucacuaggagcagcaguaaaagcaggagcauguauguuagacggaggaaacauguuagaaacaauaaaaguaagcccacagacgauggacggaauauuaaaaucaauauuaaaaguaaaacguucacuaggaauguucauaagcgacacaccaggagaacgaaauccauacgaaaauauacuauacaaaauuuguuuaagcggagauggauggccauacauagcaagccgaacuucaauagucggaagggcaugggaaaauacugucguagaucucgaaacugauaacaaaccacagaaaacaggaaauggggguucaaauaaaagucuacaaucagccggauucgcagcaggauugacuuauucacaauuaaugacucucaaagauucuaugcuucaauuagauccaaaugcaaaaacauggauggacauagaagggagaccagaagacccaguagaaauagccuuauaucaaccaguaucagguugcuauauacauuucuuuagagaaccaacagaccuuaaacaauuuaaacaggacgcaaaauauucacauggaauagacgucaccgaccuauuugcagcacaaccaggauuaacaucagcaguaauagaagcauuaccaagaaauaugguaauaacaugucaaggauccgaagacauacgaaaauuacuugaaucacaagguagaagagacauaaaacuaauagauauaagucuaagcaaaguagacucuagaaaauuugaaaaugcuguuugggaccaauuuaaagauuuaugccauaugcauacgggaauuguagucgaaaagaagaaacgugguggaaaagaagaaauaacaccacacugugcauugauggacugcauaauguuugacgcagcaguuucaggaggaguugaugcaaaagucuuaagagcuguucuaccaagagauauggucuuuagaacaaguaccccaaaaguaguacuauaa

SEQ ID NO: 2821 - RNA, 1710 nt, Artificial Sequence
  derived and/or modified CDS sequence (opt6) from Lassa virus__ADU56619__NP
augagugcaaguaaagaaguaaaaucuuuucuauggacacaaaguuuaagacgcgaacuaucagguuacugcaguaauauaaaauuacaaguaguaaaagaugcucaagcacuauuacacggccuagauuucucagaaguaaguaauguacaaagauuaaugagaaaacaaaaacgagacgacggugaccuaaaaagacuuagagaucuaaaucaggcaguaaacaaucuaguugaacuaaaaucaacacaacaaaaaucaguacuaagaguaggcacacuaucauccgacgaccuauuaguacuagcagcagaucuagaaaaacuaaaaaguaaagucguaagaaccgaaagaccacuaaguaguggcauauauaugggcaaccuaucaucgcaacagcuagaccaaagaaaagcacuauuaaauaugauaggaaugacuggaggaaauggaggaagaaacacaacaucagaugggaucguucgaguaugggauguaaaaaacgcagaauuauuaaauaaccaauucggaacaaugccaucacucacucuggcauguuuaacaaaacaaggacaaguagaccuaaaugaugcagugcaagcauuaacagacuuaggauugauauauaccgccaaauauccaaauucaagugaucuagaccgcuuagcacaaagccaucccauacuaaauaugauagauacaaaaaaaagcucacuuaacauaucagguuacaauuuuucgcuaggagcagcagucaaagcaggugccuguauguuagacggaggaaauauguuagaaacaaucaaaguaaguccacaaacaauggacggaauauuaaaaucgaucuuaaaaguaaaacguucauuaggaauguucauaagcgauacaccaggagaaagaaaccccuaugaaaauauauuauauaaaauuugucuaucaggcgauggauggccauauauagcaucacgaacaagcauaguagggcgagcuugggaaaauacugucguagaucuagaaucagacaacaaaccacaaaaaacaggaaauggagguucaaauaaaucacuacaaagugccggauuugccgcaggcuugacauauagucaacuaaugacauuaaaagacagcauguuacaacuagauccaaacgcaaaaacauggauggacauugaaggacgaccagaagacccaguagaaauagcuuuauaucaacccucaucaggaugcuacauacacuuuuuccgagaaccaacagaccucaaacaauucaaacaagaugcaaaauauucucauggaauugacguaacagaucuauuugccgcacaaccugguuuaacaucagcaguuauagaagcccuaccacgaaauaugguaauaacaugccaagggucagaagauauuagaaaacuacuggaaagucaaggaagaagagacaucaaacuaauugauauaagucuauccaagguagauucuagaaaauuugaaaaugcuguuugggaccaauucaaagacuuaugucauaugcauacagguauaguaguagagaaaaaaaaaagaggagguaaagaagaaauaacaccccauugugcccugauggacugcauaauguuugacgcugcaguaagcgguggaguagaugcaaaaguucuaagagccguucuaccuagagacaugguauuuagaacaaguacaccaaaaguuguauuauaa

SEQ ID NO: 2822 - RNA, 1710 nt, Artificial Sequence
  derived and/or modified CDS sequence (opt6) from Lassa virus__ADU56623__NP
augagugccuccaaagaaguuaagucauucuuauggacucaaucacuuagaagagaauuauccggauacuguucaaauauaaaauuacaaguuguaaaagaugcgcaagcacuacuccacggucuugauuucagcgaaguaucaaauguacaacgacuaaugaggaaacaaaaaagagacgacagugaucuaaaaagacuuagagaccuaaaucaagcaguaaacaaccuuguagaauuaaaaucaacacaacaaaaaucaauauuaagaguaggaacacucacaucagacgaccuacuaacucuagcugcagaucuagaaaaacuaaaaucuaaaguaauaagaacugaaagaccauuaucauccggagucuacaugggaaaucugucaacucaacaauuagaacaaagaagagcacuauuaaacuuaauagguaugguuggaggagcacaaggaacccaaccaggaagagacgguguaguacgaguaugggacguaaaaaacccugacuuacuaaauaaccaauuuggaaccaugccaucauuaacauuagcauguuuaacaaaacaaggacaaguugauuuaaacgaugcaguccucgcccuaacugaucuaggacuaauauauaccgcuaaauauccuaauucuucagaccuagaccgauuaucucaaucacaccccaucuuaaauaugguggacacaaagaaaucaucccuaaauauaagcggauuuaauuuuucauuaggagcagccguaaaagccggagcuuguaugcucgacggcggaaauauguuagaaaccauaaaaguaaccccacaaacaauggacgguauucuaaaaucuauacuaaaagucaaaaaaucauugggaauguucgugagcgauacaccaggcgaaagaaauccauaugaaaauauauuauacaaaauaugccuaagcggcgauggcuggccauauauagcaagcagaacauccauaguaggaagagcaugggaaaauacaacuguagaucuugaaagcgauggaaaaccacauaaaguaggaacagcaggaagcaauaaaucauuacaaagugcaggcuuucccacaggauuaacauauagccagcucaugacauuaaaagauucuaugaugcaauuagauccaucagcaaaaacauggauagauauagaaggaagaccagaagacccaguagaaauagcauuauaucaaccuaugucuggcuguuacauacauuuuuucagagaaccuaccgacuuaaaacaguuuaaacaagaugcaaaauacucacaugguauagauguagcagaucuuuuuccagcgcaaccuggauuaacaucagcaguuauagaagcauuaccaagaaacaugguauuaacuugucaagguagugaugauauaaaaagacuauuagauucacaagggagaagggauauaaaacuuauagauauugccuuaucaaaagcugacucaagaagauucgaaaaugcaguuugggaucaaugcaaagaucuaugccacaugcacacuggaguuguaguagaaaaaaaaaaaagaggaggaaaagaagaaauaaccccacacugugcuuuaauggauuguauaauguaugaugccgcaguaagcggcggucuaaacauaccaguccuacgagcaguauuaccacgagauaugguguuuagaacaucaagcccuaaaguaguucuauaa

SEQ ID NO: 2823 - RNA, 1710 nt, Artificial Sequence
  derived and/or modified CDS sequence (opt6) from Lassa virus__ADU56627__NP
augucagcuaguaaagaaguaaaaucuuucuuauggacacaauccuuaagaagagaacucucaggauacugcaguaauauaaaauuacaaguugugaaagacgcacaagcuuuacuccacggauuagacuucucagaaguaucaaacguacaaagacucaugcguaaacaaaaaagagacgauucagaucuaaaaagacuaagagaucuaaaucaagcuguaaauaauuugguagaacuaaaaagcacacaacaaaaaaguauuuuaagaguuggaacacuaaccagcgaugaucuucuaacacuagcagccgaucuagaaaaauuaaagucaaaaguaauaagaacagagagaccucuauccucaggaguauauauggguaacuuaaauacucaacaacuagaacaaaggagagcauuguuaaacaugauaggaauggcaggaggagcacaagggacccaaccuggaagagacggaguuguucgaguaugggauguaaaaaauccugacuuauuaaauaaucaauuuggaacaaugccaucucuaacacuagcgugcuuaacaaaacaaggucaaguagaccuuaaugaugcaguucuagcucuaacagaccucggcuuaauauacaccgcaaaauaucccaacagcuccgacuuagacagacuaucacaaagucacccaauuuuaaacaugguagacacaaaaaaaagcucacugaacauaucaggauauaauuucucauuaggugcagcugucaaagccggagccuguauguuagauggugguaauauguuagaaacaauaaaaguaacaccucaaacaauggacggaauauuaaaaagcauauuaaaaguaaaaaaaucauuaggaauguuuguaucagauaccccaggagaaagaaauccauacgaaaauauacuauacaaaauaugccuuucaggagauggauggccauauauagcaagucgaacaucaauaguaggacgagcaugggaaaacacaacuguagauuuagaaucagauggaaaaccacaaaaaguagguacagcaggcucgaauaaaucacuacaaagcgcaggauuuccuacaggucuaacauacagucaauuaaugaccuuaaaagauagcaugaugcaauuagauccaucugcaaaaacguggauagauauagaaggaagaccagaagauccaguagaaauagcacucuaucaaccaaugagcggcugcuacauacauuuuuucagagaaccaacagaucuaaaacaauuuaaacaagaugcaaaauacucacauggaauagauguagcagaucuuuucccagcacagccaggacuaacaucagcaguuauagaagcauugccaagaaacaugguauuaaccugucaaggcucagacgauauaaaaagacuacuugauagucaaggaagacgagauauuaaacuaauagauauagcuuugucaaaagcagacaguagaagguucgaaaaugcaguuugggaccaaugcaaagaucuaugccauaugcauacaggagucguaguagaaaaaaaaaaaagaggagguaaagaagaaauaacaccacauugugcauuaauggacuguauaauguacgacgcagcaguaucuggaggacuaaauauacccguacuaagagcaguacuaccucgagacaugguuuucagaacaucaaguccgaaagucguacuauaa

SEQ ID NO: 2824 - RNA, 1710 nt, Artificial Sequence
  derived and/or modified CDS sequence (opt6) from Lassa virus__ADU56631__NP
augucagccucaaaagaaguaaaaucauuuuuauggacacaaucauuaagaagagaauuaucaggcuauugcaguaacauaaaacuacaaguaguaaaggaugcucaagcccuacuacacggauuagauuucucagaaguaaguaacguacaaagacucaugagaaaacaaaaaagagaugauucagaccuaaaaagguuacgagaccuaaaucaagccguaaauaauuuaguagaauuaaaaucuacacaacaaaaaucaauauuaagaguuggaacacuaacaagugaugacuuacucacacucgcagccgaucucgaaaaacucaaaagcaaaguuauaagaacagaaagaccccuuaguaguggcguauacaugggcaacuuaaguacucaacaacuagaacaaagaagagcuuuauuaaauaugauaggaauggucggaggagcacaaggaacucagccaggccgugacggaguaguaagagucugggauguaaaaaauccugaucuacuaaauaaccaauucgguacaaugccuagccuaacacuagcuugccuaacaaaacaaggacaaguagaccucaaugaugcuguauuagcauuaacagaucuaggacugauauauacugcaaaauauccaaacagcagugaucucgauagacuaucacaaucacauccaauccuaaacaugguagauacuaaaaaaucaucguuaaauauaagcggauacaauuucucacucggagcagcaguaaaagcaggagcaugcauguuagacggcggaaacauguuagaaacaauaaaaguaacaccacaaaccauggacggaauacuaaagucaaucuuaaaagucaaaaaaucauuagguauguuuguaucagauacaccaggagaaagaaacccuuacgaaaacauuuuauauaaaauauguuuaaguggagauggauggccauacaucgcuucuagaacauccauaguaggcagagccugggaaaauacaaccguagaucucgaaagcgacggaaaaccacaaaaaguuggaacagcagggagcaauaaaucacuccaaucagcaggcuucccaacgggauuaacauacucucaacuaaugacauuaaaagauaguaugaugcaauuagauccaagcgcaaaaacauggauagauauagaaggaagaccagaagaccccguugaaauugcuuuauaccaaccaauguccggauguuauauacauuuuuuccgagaaccaacagaucuaaaacaauuuaaacaagaugccaaguauucacauggaauagacguuacagacuuauuuccagcccaacccggauuaacaagugcaguaauagaagcacuaccuagaaacaugguauuaacaugucaaggaagcgaugauauaaaacgacuauuagauucacaaggaagaagagauauaaaacuaauagacauagcacuuucaaaagcagauaguagaagauucgaaaacgcaguaugggaccaauguaaagauuuaugucacaugcauacaggaguaguaguagaaaaaaaaaaacgaggaggaaaagaagaaauaacuccacauugcgcuuuaauggauugcauaauguaugacgcagcaguaucaggaggcuuaaacauaccaguacugagagcaguauuaccaagagacaugguuuucagaacaaguagcccaaaaguuguguuauag

SEQ ID NO: 2825 - RNA, 1710 nt, Artificial Sequence
  derived and/or modified CDS sequence (opt6) from Lassa virus__AFY05580__NP
augagugcuucaaaagaaauaaaaucuuuucuguggacacaaagccuaagaagagaacuaucaggauauugcucaaauauaaaacuacaaguaguaaaagacgcacaagcacuacuacauggcuuagacuuuagcgaaguuucaaauguacaacgauuaaugagaaaagaaagacgagacgauaacgaucuaaaaagacuacgagauuuaaaucaagccguuaauaaccuaguagaauuaaaauccacacaacaaaaaucaauauuaagaguaggaacauuaaccucagacgauuuacucauauuagcagcagaucuagaaaaacuucgaagcaaaguaauaagaaccgaaagaccucuaagcgcaggaguauauaugggaaacuuaucaucgcagcaauuagaucaaaggagagcacuauuaaauaugauaggaaugucaggcggaaaucaaggagcaagagcuggaagagacggaguaguacgaguuugggacgucaaaaaugccgaauuacuaucuaaccaauucggaacaauaccaucauuaacacuagcaugucuuacaaaacaaggccaaguagacuuaaaugaugcaguacaagcauuaacggaccuaggacuuaucuauacugcaaaauacccaaauacaucagauuuagauagacucacacaaucacacccgauacuaaacaugauagacacaaagaaaaguucauuaaacauaucagguuauaauuuuucucugggagcagcaguaaaagccggugcauguauguuggauggaggcaacauguuagaaacaauaaaaguaagcccacaaacgauggacggaauccuaaaaucaauccucaaaguaaagaaagcacucgguauguucauaucagauacaccaggagaaagaaauccauacgaaaauauacuuuauaaaauaugcuuaucuggagaugguuggccuuauauagcaaguagaaccaguauaacugguagagcaugggaaaauacaguuguagacuuagaaaguggaggaaaaccacaaaaagcagacaguaacaauucaucaaaaagucuccaaucagcaggauuuaccgcagggcuaaccuauagccaacuaaugacauuaaaagaugcaauguuacaauuagauccaaaugcaaaaacauggauggauauagaagggcgaccggaagaucccgucgaaauagcucuauaccaaccaagcagcgguuguuacauacacuuuuuccgcgaaccaacagaccuaaaacaauucaaacaagacgcaaaauauucacauggaauugacguaacugacuuauucgcaacucaacccggacuaaccucagcaguaauagacgcauuaccaagaaauaugguaauaacgugucaaggaagcgaugauauaagaaaacuauuagaaagccaaggcagaaaagauauaaaauuaauagauauagauuuaucaaaaacagauucaagaaaauacgaaaacgcaguaugggaccaauauaaagacuuaugccauaugcacacaggggucguuguagaaaagaagaaaagaggcgggaaagaagaaaucacaccacacugcgcauuaauggauugcauaauguucgacgcagcaguuagcggaggacuaaauacaaguguacuaagagcaguguugcccagagauaugguauuucgaacuucaacacccagaguaguauuauaa

SEQ ID NO: 2826 - RNA, 1710 nt, Artificial Sequence
  derived and/or modified CDS sequence (opt6) from Lassa virus__AFY05581__NP
augucagcaucaaaagaaauaaaaaguuuuuuauggacacagucuuuaagaagagaacuuagcggauauugcucaaauauuaaauuacaaguaguaaaagacgcccaagcauuacuacacggacuugacuuuucugaaguaucaaacguacaaaggcuuaugagaaaagaaagacgagacgauaaugaucuaaaaagauuaagagacuuaaaucaagcuguuaauaacuuaguagaacuaaaaucuacacaacaaaaaucaauuuuaagaguaggcacauuaacuuccgacgacuuacuaauauuagcugcagaucuagaaaaauuaaaaaguaaaguaauaagaaccgaacgaccacuaagugcaggagucuauaugggaaaccuaucaucacaacaacuagaucaaaggcgagcccucuuaaacaugauaggaaugucaggagguaaccaaggagcacgagcagguagagauggagucguaagaguaugggauguaaaaaaugcagaacuauuaucgaaccaauucggcacaauaccaucauuaacuuuagccugcuuaacaaaacaaggucaaguagaccuaaaugacgcaguccaagccuugacagacuuaggauuaauauauacagcuaaauacccaaacacaucagauuuggauagacuaacacaaucacacccaauuuuaaauaugauagauacaaaaaaaucgucacuaaacauuucaggauacaacuucucacuaggcgcagcaguuaaagcaggagcaugcaugcuagacggaggaaauaugcuagaaacaauaaaaguuuccccacaaacaauggacggaauauuaaaaaguauauuaaaaguaaaaaaagcccuaggaauguucauaucagauacaccaggagaacgaaauccauaugaaaacauucucuacaaaauaugccuaaguggagauggauggccauauauagcaaguagaaccaguauaacaggccgcgcaugggaaaacacaguaguagaccuagaaucaggcggcaaaccacaaaaagcagauaguaauaacagcucaaaaagucuccaaucagcgggauucacagcuggauuaacuuauucgcaacucaugacucugaaagacgcaaugcuacaacuagaccccaaugccaaaacauggauggauauagaaggaagaccagaagacccaguugaaauagcucucuaucaacccucaucuggauguuacauacacuuuuuuagagaaccuaccgaccuaaaacaauucaaacaagacgcaaaauauagccauggaauagauguaacagaucuauucgcaacacaaccaggacuaacaagugcuguaauugaugcacucccaagaaauaugguaauaacaugccaaggaagugaugauauaagaaaacuauuagaaucucaaggaagaaaagacauaaaauuaauagacauagaucugaguaaaacagauucacgaaaauacgaaaacgcagucugggaccaauacaaagauuuaugucauaugcacacaggaguaguagucgaaaaaaagaaaagagggggaaaagaagaaauaacaccacacugugcauuaauggauuguaucauguucgacgcagcaguaucaggaggccuaaacacaaguguacuaaaagcagugcuaccaagagacaugguguucagaacaucaacaccaagaguuguacuauaa

SEQ ID NO: 2827 - RNA, 1710 nt, Artificial Sequence
  derived and/or modified CDS sequence (opt6) from Lassa virus__AFY05587__NP
augucagcuucaaaagaaauaaaaagcuuuuuauggacccaaucuuuacguagagaacuaaguggauacugcagcaauauaaaacuacaaguuguuaaagaugcacaagcauuauuacacggacuagauuucucugaaguaucgaacguacaaagacuaaugagaaaagaaagaagggacgauaacgaucuaaaacgcuugagggaucuaaaucaagcaguaaacaaucuaguagaauuaaagucaacacaacaaaaaaguauacuaagagugggaacauugacuagcgaugaucuauuaauccuagccgcagaucuagaaaaauuaagaagcaagguaauaagaacagaaagaccauuaucagcugguguauacaugggaaaccuaucaucucaacaacuagaucaaagaagagcacuccuuaacaugauagguauguccggaggaaaccaaggagcuagagcaggaagagacggaguuguaagaguaugggauguuaaaaacgcagaauuauuaaguaaucaauucgguacuaugccaagcuuaacauuagcaugccuaacuaaacaaggacaaguagaucuaaacgaugcaguucaagcacuaacagaccuaggauuaauauauaccgcaaaauacccuaacacuagugaccuugauagacugacacaaagccaccccauauugaacaugauagacaccaaaaaaucaucauugaacauuaguggauacaauuucagucuaggagcugcaguaaaagcgggagcaugcauguuagacggcggaaauauguuggaaacaauaaaaguaucaccccaaacaauggacgguauacuaaaaucuauauuaaaaguaaaaaaagccuuaggaauguucaucucagauacaccaggagaacgaaacccauacgaaaauauacuauacaagauauguuuaucaggagauggauggccauacauagccagcagaacaucaauaacaggaagagcaugggaaaauacaguaguagauuuagaaucagauggcaaaccucaaaaagcagacucaaauaauagcaguaaaucacuucaaucugcaggauucaccgccggacuaacauauagucaacucaugacacuaaaagaugccauguuacaacuagacccaaacgcaaaaacauggauggacauagaaggaagaccagaagauccgguagaaauagcauuauaccaaccgucaaguggauguuauauacacuuuuucagagaacccacagaucuaaaacaauuuaaacaagaugcaaaauacucacacggaauagauguuacagaucuauucgcaacucaaccuggacucacaucagcagugauagaugcgcuaccucgaaauaugguaauaaccugucaaggaucagacgauauaagaaaacuuuuagaaucacaaggaagaaaagauauaaaacuaaucgacauagaucuaucaaaaacagauucacgaaaauacgaaaacgcagucugggaucaauacaaagacuuaugucauaugcauacaggaguaguaguagaaaaaaaaaaaagaggagguaaagaagaaauuaccccucacugugcacuaauggauugcauaauguuugacgcugcaguaucuggaggauuaaauacaucagugcugagagcaguacuaccuagagacaugguuuuuagaacgagcacaccaagaguaguacuauaa

SEQ ID NO: 2828 - RNA, 1710 nt, Artificial Sequence
  derived and/or modified CDS sequence (opt6) from Lassa virus__AFY05591__NP
augucagccucaaaagaaauaaaaucauuuuuauggacccaaucauuaagaagagaacuaaguggauauugcucuaauauaaaauuacaaguaguaaaagaugcacaagcccuacuacauggucuugauuucagcgaaguuucaaauguacaaagauuaaugcgaaaagaaagacgagacgauaacgacuuaaaaagacuucgggacuuaaaucaagcaguaaacaaccucguagaauuaaaaaguacacaacaaaaaucaauacuaagaguaggaacacucacaagugaugaccuacucauauuagcugcagaucuagaaaaauuaaaaaguaaaguaauuagaacagaacgaccacuuucagcagguguauauaugggcaauuuauccucacaacaacuagaccaaagaagagcacuacuaaauaugauuggaaugaguggcgguaaucaaggagcaagagcuggacgagacggaguugugcgaguaugggauguuaaaaauguggaauuacuaucuaaucaguucggaaccaugcccucacuaacauuagcaugucucacgaaacaaggacaaguugacuuaaacgaugccguacaagcacucacugaccuaggccuaauauauacagcuaaauaccccaauacaucagauuuagaccgauuagcgcaaucacaccccauuuuaaacaugauagauacaaaaaaaagcucacuaaacauaagcggauacaauuucagccuaggagcagcagucaaagcaggagccuguauguuagaugguggaaacaugcuagaaacaauaaaaguaucaccacaaacaauggacggcauauuaaaaaguauauuaaaaguaaaaaaagccuuggguauguucaucucagauacaccaggagaaagaaauccauaugaaaauauauuauacaaaauaugccucucuggcgacggauggccauauaucgcaagccgaacaucaauaacagggagagcaugggaaaauacaguaguagaucuugaaucugauggaaaaccacaaaaagcagacagcaauaauagcucuaaaagccuacaaucagcuggcuuuacagcaggauuaacuuauucacaauuaaugacuuuaaaagaugccaugcuacaacuagauccaaaugcaaaaacauggauggacauagaagguagaccagaagacccaguugaaauagcucuauaucaaccaagcuccggaugcuacauacauuuuuucagagaaccaacugaucuaaaacaauucaaacaagaugcaaaauauagccauggaauagacguuacagaccucuuugcuacacaaccuggacuaacaagugcuguaauagaugcacuaccaagaaauaugguaaucacaugucaaggcucagaugacauaagaaaacuacuagaaucucaagguagaaaagacauuaaauuaauagacauagaccuaaguaaaacagacagcagaaaauaugaaaaugcaguaugggaucaauacaaagaccuuugccauaugcauacaggaguaguuguagaaaaaaaaaaaagaggaggaaaggaagaaauaacuccacacugugcacuaauggacugcauaauguucgacgcagcaguaagcggagguuuaaacacuagcguauuaagagccguacuaccuagagauaugguauuucgaacaucaacgccaagaguaguacuauga

SEQ ID NO: 2829 - RNA, 1710 nt, Artificial Sequence
  derived and/or modified CDS sequence (opt6) from Lassa virus__AFY05597__NP
augucagcaucaaaagaaauaaaauccuuccuauggacacaaucucuacgacgagaacuaucaggcuauugcucuaacauaaaauuacaaguuguaaaagacgcacaagcauuauuacauggcuuagacuuuucagaaguaaguaacguacaacguuuaaugagaaaagagagacgagaugauaaugacuuaaaacgacuaagagacuuaaaccaagccguaaauaaucuaguagaacuaaaaucaacucaacaaaaaucaaucuuacgaguagguacacuuacaagugaugaucuacuaauauuagccgcagaccuagaaaaacuuaaaucaaaaguaauaagaacagaaaggccacuaucagcaggaguauauaugggaaauuuaucaucacaacagcuagaucagaggagagcacuuuuaaacaugauagguaugucuggaggaaaucaaggagcgagagccggacgagauggaguaguucgagucugggaugucaaaaacgcagaauuacuaucaaaccaauuuggaacuaugccaucacuaacauuagcauguuuaacaaaacaaggucaaguagacuuaaaugacgcaguucaagcuuuaacagacuuaggauuaauauauacagcaaaauaucccaacacaucagauuuagacagauuaacacaaucacauccaauauuaaacaugauagauacuaaaaaaucuagccuaaacauaucagguuauaauuucucacuaggugccgcagugaaagcaggugccuguaugcuagacggaggcaacauguuagaaacuauaaaaguuucuccacaaacgauggaugguauccuuaaaaguauacuaaaagucaaaaaagcacuugggauguucauuucagacacaccuggcgagagaaauccauaugaaaauauacuauauaaaaucugucuuaguggagacgguuggccuuacauagccagccgaaccucaaucacggggcgagcaugggaaaauacuguuguagaucuagaaagcgacggaaaaccccaaaaagcagacaguaauaacucauccaaaucacuacaaucagcuggauuuaccgcaggauuaacauauagccaacuaaugacccuaaaagaugcaauguuacaacuagauccaaacgcuaaaacauggauggauauagaaggaagaccagaagacccagucgaaauagcacucuaucaaccaaguucaggcuguuauauucauuuuuucagagaaccaacagaccuaaaacaauucaaacaagaugcaaaauacucccauggaauagauguuacagaucuauuugcaacucaaccaggcuugacaagugcagugauugaugcacuuccuagaaauaugguaauaacuugucaagguuccgaugauauuagaaaacuccuagaaagucaaggaagaaaagacauaaaauuaauagauauagacuuaucuaaaacagacucaagaaaauaugaaaacgcaguaugggaccaauacaaagauuuaugccauaugcacacaggaguaguagucgagaaaaaaaaaagaggaggaaaagaagaaauuacaccucauugcgcauuaauggauugcauaauguuugacgcagcaguaucaggaggauuaaacacuucaguacuaagggcaguacuaccgcgagauaugguauuccggacaucaacaccacgaguaguauuauaa

SEQ ID NO: 2830 - RNA, 1710 nt, Artificial Sequence
  derived and/or modified CDS sequence (opt6) from Lassa virus__AFY05610__NP
augucagcuucaaaagaaauaaaaucuuuccuauggacccaaucacuacgaagagaguugucaggauauugcaguaauaucaaacuucaaguagucaaagacgcgcaagcacuauuacacggacuagacuucagcgaaguaaguaacguacaaaggcuaaugagaaaagagcgaagagacgauaacgauuuaaaaagacuaagagauuuaaaucaagcaguaaauaacuuaguagaacuaaaaagcacccaacaaaaaucaauacuaagaguaggcacacuaacaucagaugauuuauuaauacuagcugcagaucuagaaaaacuaaaaucaaaaguuauaagaacagaaagaccccuaucagcaggcguauauaugggaaaccuuucaagucaacaacuagaucaaaggcgagcucuacuuaauaugaucggaaugucuggaggaaaccaaggagcucgagcuggucgagauggagucguacgaguaugggacguaaaaaacgccgaacuauuaagcaaccaauucggaacaaugccaucauuaacuuuagcaugucuaacuaaacaaggacaaguagauuuaaaugacgcaguacaagcacuuaccgaccuaggauuaauauacaccgcuaaauauccuaauacaucugaccuugacagauuaacacaaucacacccaauauuaaacaugauagauacaaaaaaaaguagcuuaaacauaucaggauacaauuucucauuaggagcagcagucaaagccggagcguguaugcucgacggaggaaacaugcuugaaacaauuaaaguaucaccucaaacaauggacggaauacuaaaaucaauauuaaaaguaaaaaaagcauuagguauguuuauaucagacacuccuggagaaagaaacccauacgaaaauauacuauacaaaauauguuuauccggagauggauggccauacauagcaaguagaacaucaauaacuggacgugcaugggaaaauacaguaguagaucucgaaucagauggcaaaccacaaaaagcagacaguaauaauaguagcaagucacuacaaagugcaggauuuacagcaggacuaacauauagucaauuaaugacauuaaaagacgcuauguuacaacuggacccaaauacuaaaacauggauggauauagaaggacgaccagaagacccuguagaaauagcauuauaucaaccaaguaguggaugcuacauacacuuuuucagagaaccuacagaucuaaaacaauuuaaacaagacgcaaaauauucacauggaauugauguaacagaucucuuugcuacacaaccaggacuaacaagugcaguaauugacgcacuucccagaaacaugguaauaacuugucaaggaucagaugauauaagaaaauuauuggaaucacagggaagaaaagacauaaaacuaauagacauagaucuaucaaaaacagauucuagaaaauaugaaaacgcagucugggaucaauacaaagauuuaugccacaugcauaccggaguaguaguagaaaaaaaaaaaagagguggaaaagaagaaauaacaccacacugcgcucuaauggauuguauuauguuugaugcagcaguauccggcggacuaaacacaagcguacuaagagccgugcucccaagagacauggucuuuaggacaucaacuccaaggguagucuuauag

SEQ ID NO: 2831 - RNA, 1710 nt, Artificial Sequence
  derived and/or modified CDS sequence (opt6) from Lassa virus__AFY05616__NP
augagcgccucaaaagaaauaaaaucuuucuuauggacccaaucacuaaggagagaacuaucuggauacugcucaaacauuaaacuacaaguaguaaaagacgcacaagcauuauuacacggucuagacuuuucugaaguaaguaauguacaaagacuaaugagaaaagaaagaagagacgauaacgacuuaaaacgauuacgagaucuaaaucaagcuguaaauaacuuaguagaauuaaaaagcacacaacaaaaaucaauuuuaagaguuggaacacucacaagcgacgaccuacucauacuagcagcugaucuugaaaaauugaaaaguaaaguaauccggacagaaagaccucuaagcgccgguguauacaugggcaaucuaaguucgcagcaacuagaucaacgaagagcacuuuuaaacaugauaggaaugucaggaggaaaccaaggagcaagagcaggaagagacgguguggugagaguaugggauguaaaaaaugcagaacuacuauccaaucaauucggaaccaugccaucacuaacguuagcguguuuaacaaaacaaggccaaguugauuuaaaugaugcuguccaagcauuaacagauuuaggucuaauuuauacagcuaaauauccaaauacaucagacuuggacagauuagcacaaucacauccaaucuuaaacaugaucgauacaaaaaaaucaucccuuaacauaaguggcuacaacuuuucucuaggggcagcagucaaagcuggagcauguaugcuagaugguggaaauauguuagaaacaauaaaaguaucaccacaaacaauggacggaauccuuaaaaguauauuaaaaguaaaaaaagcauuagguauguucauaagcgacacccccggagaacgaaacccauaugaaaauauucuauacaaaauaugccuaaguggagacggauggccauauauagcuagccgaacaaguaucacaggaagagcaugggaaaacacaguaguggaucuagaaagcgaugggaaaccacaaaaagcagacucaaauaacaguaguaaaaguuuacaaagugcaggauucacagcuggccuaacauauucccaacuaaugacacuaaaagaugcaauguuacaacuagauccaaaugcaaaaacauggauggauauagaaggacgaccagaagacccaguagaaauagcauuauaucaaccaagcucaggauguuacauucauuuuuucagagaaccaacugaccuaaaacaauucaaacaagaugccaaauacucacacggaauagacgucacagaccucuuugcaacacaaccuggauuaacuagugccguaauagacgccuuacccagaaacaugguuauaacaugucaagguuccgaugauauaagaaagcuauuagaaucgcaaggaagaaaagauauaaaauuaauagauauagaucuaucgaaaacagauucaagaaaauacgaaaacgcgguaugggaucaauacaaagauuuaugccauaugcauacaggaguaguagucgaaaaaaaaaaaagaggugguaaagaagaaauaacaccacacugugcauuaauggacuguauaauguucgaugcugccguuucaggaggauuaaacacuagcguucucagagcaguauuaccacgugacaugguauucagaacaucaacaccaagaguaguacuauga

SEQ ID NO: 2832 - RNA, 1716 nt, Artificial Sequence
  derived and/or modified CDS sequence (opt6) from Lassa virus__AFY05618__NP
augucagcaucaaaagaaauaaaaucauuccuauggacacaaagcuuaagaagagaauuaucaggauauugcucaaauauaaaauuacaaguaguuaaagaugcucaagcauuacuacacgguuuagauuuuucugaaguaucaaacguacaacgauuaaugagaaaagaacgaagagacgauaacgaccuaaaaagauuaagagaccuuaaucaagcuguuaacaaucuaguugaauuaaaaaguacucaacaaaaauccauacuaagaguaggaacauuaacaucagaugaccuacugauauuagcagcagaccuagaaaaacuaagaucaaaagucauaagaacagaacgaccauuaucugcaggaguauauaugggaaaccuaagcucacaacaacuagaucaaaggagagcccuauuaaacaugauaggaauguccggaggaaaccaaggagcucgagcuggaagagacggaguagucagaguuugggauguaaaaaacgcagaauuacuuucaaaucaauucggaacuaugccaaguuuaacauuagcaugucucaccaaacaaggacaaguagaucuaaaugaugcaguacaagcauuaacagauuuaggcuuaaucuauacagcaaaauaucccaacacuagcgaccuagaccgacuuacucagagccacccaauccuuaacaugauagauacaaaaaaauccagcuuaaacauaucaggauauaauuucaguuuaggagcagcaguaaaagccggagcguguauguuagacggagggaacauguuagaaacaauaaaaguuucaccacaaacaauggacgggauccuuaaauccauacuaaagguuaaaaaagcucuagguauguuuauuucagauacaccaggagaaagaaacccauacgaaaauauacuauauaaaauaugucuaaguggagauggauggccauauauagcaucaagaacaucaauaacgggaagggcaugggaaaacacuguuguagacuuagaaagcgaugguaaaccacaaaaagcagauucaaacaauucaucaaaaucucuacaaucagcaggauuuacagcaggauuaacauauucacaacuaaugacccuaaaagacgcaauguuacaauuagauccaaaugcuaaaaccuggauggauauugaaggccgaccagaagauccaguugaaaucgcauuauaucaaccaucaucagguuguuacauccacuuuuuuagagaaccaacugauuuaaaacaaaaacaauuuaagcaagacgcaaaauacucacauggaauugauguaaccgaucuauucgcaacucaaccaggauuaacuagugcaguaauagaugcauugccacgaaacaugguaaucacaugucaagguagcgacgacauacggaaguuauuagaaucacaaggacgaaaagacauaaaacugauagacauagaucucucaaaaacagacaguaggaaauacgaaaacgcaguaugggaccaauauaaagaccuaugucauaugcauacaggagugguuguagaaaaaaaaaaaagagguggaaaagaagaaaucacaccgcacugugcacuaauggauugcaucauguuugacgcagcaguaagcggaggacuaaacacaucaguacuaagagcaguuuuaccaagagauaugguauuuagaaccucaacuccaagaguagucuuauaa

SEQ ID NO: 2833 - RNA, 1710 nt, Artificial Sequence
  derived and/or modified CDS sequence (opt6) from Lassa virus__AHC95552__NP
augagugcaucaaaagaaguuaaaaguuuccuauggacacaaagucuaaggagagaacuaucaggauauugcucaaacauaaaacuacaaguugucaaagaugcacaagcacuacugcauggacuagauuuuucugaaguaagcaauguucaaagacuaaugcgcaaacaaagacgagacgauggggaucuuaaaagauuaagagaucuaaaucaagcaguaaauaacuuaguagaacuaaaaaguacacaacaaaaaaauguauugagaguaggaacacuaaauucugaugaccuacuaacccuagccgcugaucucgaaaaacuaaaaaguaaagucacacgaacagaacgaccacuaagcagcggaguauacaugggaaauuuaucaagucaacaauuagaucaaaggagagccuuacuaaauaugauaggaaugacaggaggaaaccaaggaacucaagcugguagagacggaguaguaagaguaugggauguaaaaaaugcagaauuauuaaauaaccaauucggaacaaugcccucauuaacauuagcaugcuuaacuaaacaagggcaagcugacuugaacgaugucguacaagcuuuaaccgaucuuggauuaauauauaccgccaaauauccuaaugcuucagaccuagacagauuaacacaaagccacccaauauuaaacaugauagacacaaaaaaaucuaguuuaaacauuaguggcuauaauuucagccuaggggcagccguuaaagcaggcgcauguauguuagaugguggaaacauguuagaaacaauaaaaguaucaccacaaucaauggacggaauauuaaaaucaauauuaaaaguaaaaagagcauuaggcauguuuguaagugauacaccaggagaaagaaauccuuaugaaaacauauuauacaaaauauguuuaucaggagacggauggccauauaucgcaucaagaacuucaauuguagguagagcaugggagaauaccguagucgaucuagaagccgacggaaauccuaaaaaguuaaauucaaauggauccaauaaaagccuacaaucagccgguuuuccagcagguuuaacauauagucagcuaaugacgcuaaaagacgcaauguuacaacuagauccuaaugcaaaaacauggauggauaucgaaggaagaccagaagacccagucgagguagcacucuaucaaccaaauuccggauguuacauccauuuuuucagagaaccuacagaucuaaaacaauuuaaacaagaugcaaaauacucacauggaauagacgucacagaucuauuugcagcucaaccaggacucaccucagcaguaauagaagcacuaccaagaaauauggucauaaccugccaaggaucagaggauauacgaaaacuacuagaaagucaaggaagaaaagauauaaaacuaauagauauagcacucucaaaaacagacaguagaaaauuugaaaacgcaguaugggaccaauauaaagaccuaugccauaugcacacaggaguaguaguugaaaaaaaaaaacgugguggaaaagaagaaauuacaccacacugcgcauuaauggauugcauaauguucgacgcagcagucagcgguggauuaaacacgcuaguacuaagagcaguacuaccaagagauauggucuucagaacgaguacaccuagagucguacuauaa

SEQ ID NO: 2834 - RNA, 1710 nt, Artificial Sequence
  derived and/or modified CDS sequence (opt6) from Lassa virus__AHC95554__NP
augagugcuaguaaagaaguacgaucauucuuauggacacaaagucuaagaagagaauuaucaggauacuguucaaacauaaaauuacaaguugucaaagaugcucaagcacuauuacauggauuagauuuuucagaaguaaguaauguccaaagauuaaugagaaaacaaagaagagacgauggagaccuaaaaaggcuuagagaucuaaaucaagcaguaaauaacuuaguagaacuaaaaucaacacaacagaaaagugucuuaagagucggaacacuaaauagcgaugacuuauuaacguuagcagccgacuuagaaaaacuuaaaucaaaaguaacaagaacagaaagaccauuaaguucuggaguuuacaugggaaaucuuagcucacaacaauuagaccaaagacgagcacuauuaaauaugauaggcaugacagguggaaaucaaggagcacaagcaggaagagacggaguaguaagaguaugggauguuaaaaacgcagaauuauuaaauaaccaauucggaacaaugcccagucuaacacuagcuugcuuaacaaaacaaggacaaguagaucuuaacgauguaguacaagcccucacagauuuaggacucauauauacagcuaaauauccaaacacaagugacuuagauagauuaacucaaagccauccgauauuaaauaugauagacacaaagaaaagcucauuaaauauaucaggauacaauuucagucuaggagcagcagucaaagcaggagcauguauguuagacgguggaaauaugcuugaaacaauaaaaauaucuccacaaucgguagacggcauucucaaaucaauacucaaaguaaaacgaucacugggaauguuuguaucagacacaccaggagaacgaaacccauaugaaaauauacucuacaaaauauguuuaaguggagacgguuggccuuauauagccucaagaaccagcauaguagguagagcaugggaaaauacgguaguagaucuagaagcagauggaaaaccacaaaaaccaaauucaggaaguagcaacaaaucacuacaaagugcaggauucccagcaggcuuaacauauucacaauuaaugacacuaaaagacgcaauguuacaauuagacccaaacgcaaaaacauggauggauauagaaggaagaccggaggacccuguagaaguagcuuuauaucaaccuucaucagguuguuauauacacuuuuucagagaaccaacagaucucaaacaauucaaacaagaugcaaaauauagccacggaauagauguaacagauuuauuugcagcacaacccggcuuaacaucagcaguaauagaagcacugccacgaaacauggugauaacaugucaaggcagugaagauauaaagaaacuauuagaaucacaaggccgaaaagauauaaaacuuauagauauagcacugaguaaaauagauagcagaaaauuugaaaacgcaguuugggaucaauacaaagauuuaugccacaugcacacaggagucguagucgagaaaaagaaaagaggaggaaaagaagaaaucacaccacauugugcacuaauggacugcauaauguuugaugcagcgguuucaggagguuugaacgcaucaguacuaagggcaguacuaccacgagauaugguauucagaacuucaacaccaaaaguaguauuauaa

SEQ ID NO: 2835 - RNA, 1710 nt, Artificial Sequence
  derived and/or modified CDS sequence (opt6) from Lassa virus__AHC95556__NP
augagcgcaucaaaagaaguaaaaucauucuuauggacacaaucuuugaggagagaauuaaguggauauugcucaaacauaaaacugcaaguaguuaaagaugcacaagcucuacuucacggacuugacuucucugaaguaagcaacguacaacgauuaaugagaaaacaaagaagagacgauggagauuuaaaacgacuaagagaucuaaaucaagcgguaaauaacuuaguagaacucaaaaguacacaacagaaaaauguccuaaggguaggaacacuaaauucagacgaccuauuaacucuagccgcagaucuagaaaaacuaaaauccaaaguaacuagaacagaacgcccucuaucaagcggaguauacauggggaacuuaucaucacaacaacuugaucaaagacgggcucuacuaaauaugauaggaaugacagguggaaaccaagggacacaaaccggcagagacggaguaguacgaguaugggacgucaaaaaugcagaacuccuaaauaaccaauuuggaacaaugccuucccuaacacuagcaugucuaacaaaacaagggcaagcagaccuaaaugacguaguacaagcucucacagacuuaggauuaaucuauacagcaaaauauccaaacgcaucagauuuagauagauuaacucaaucacauccgauauuaaauaugauagauacaaagaaaucaagucuaaacauaagugguuacaauuuuucacucggagcagcagucaaagcaggagcuugcaugcuagacggaggcaauauguuagaaacuauaaaagucaguccacaaucaauggacggaauacuaaaaaguauccuuaaagucaaaagagcuuuaggaauguucguaucagauacuccaggcgaaagaaauccauacgaaaacauacucuacaaaauaugcuuaucuggagacggauggccauauauagcauccagaaccaguauaguagguagagcaugggaaaauacaguaguagauuuagaagcagacggcaauccuaagaaauuaaauucaaacggaaguaauaaaaguuuacaaagugccggcuucccagcaggucuuacauauagccaacuaaugacacuaaaagaugcaaugcuacaauuagauccaaaugcaaaaaccuggauggacauagaaggaagaccagaagauccagucgaaguagcauuauaucaaccgaacagcggcugcuacauacauuucuucagagaaccaacagauuuaaaacaauuuaaacaagacgcaaaauauucccacggaauagacguaacagaucucuucgccgcacaaccaggauuaacaucagcaguaauugaagccuuaccgagaaacaugguaauuacaugccaagggucagaagauauaagaaaauuacuagaaucucaagggagaaaagauauaaaacuaauugauauagcauuaucaaaaacagauucaagaaaauucgaaaaugcuguaugggaccaacacaaagauuuaugucauaugcauacaggaguuguaguugaaaagaagaaaagaggcggaaaagaagaaauaaccccacacugugcacuaauggacuguauaauguuugaugcagccguaucaggaggucugaacacauuaguccuacgagcuguucuaccuagagauaugguauucagaacaucaacaccaaaaguuguuuuauaa

SEQ ID NO: 2836 - RNA, 1710 nt, Artificial Sequence
  derived and/or modified CDS sequence (opt6) from Lassa virus__AHC95558__NP
augucagcaucaaaagaaguaagaucauuuuuauggacacaaagucuaagaagagaauuaagcggauauugcucaaacauaaaauugcaaguaguaaaagacgcacaagcauuacuacauggcuuagacuuuucagaaguaucaaacguccaaagauuaaugagaaaacagaggcgagaugauucagaccucaaaagauuacgagaccuuaaucaagcaguaaauaaccuaguagaacuuaaaucaacacaacaaaaaucuguacuacgaguaggcacacuaucaucagacgaucuacuaacauuggcagcagauuuagaaaaauuaaaaucaaaaguaauacguacagaacguccgcuaagcucaggaguuuauaugggaaaccucagcucacaacaacucgaucaacguagagcacuauuaaacaugauaggaaugacaggaggaaaucaaggcgcacaagcaggaagagacgguguaguucgaguaugggacgucagaaaugcagaacuacuaaacaaccaauucgguacaaugcccucccuuacacuagcaugucuaacgaaacaaggucaagucgacuuaaacgacguuguacaagcacuaacagacuuagguuuaauauauacagcaaaauaccccaacacuucagacuuagacaggcucacacaaaaucacccaauacuaaacaugauagauacaaaaaaaaguagcuuaaacaucagcggauauaauuucucauuaggugccgcgguaaaagcaggagcaugcauguuagacggagguaauauguuagaaacuauaaaaguaucaccccaaucaauagauggcaucuuaaaaaguauacuaaaaguaaaaagaacauuggguauguuugucucagauaccccaggagaaagaaauccauaugaaaauauacuuuauaaaauaugucuaaguggagauggauggccauauauagcuucaagaacaucaauaguaggaagagcaugggaaaauacaguaguagaucucgagacagauaggaaaucacaaggccccaauaguggaaauucuaauaaaucauuacaaagugcuggauucucagcaggauugacauauucacaauuaaugacacuaaaagaugcaaugcuacaacuagauccaaacgccaaaacuuggauggacauagaaggaagaccagaagauccaguagaagucgcccuauaccaaccaauauccgguuguuacauacacuucuuuagagaaccaacagaucuaaaacaauuuaaacaagacgcaaaauauagucauggaauagauauaacagaccuauuugcugcacaaccaggacucacuagcgcuguuauagaagcacuaccaagaaacaugguaauaacgugccaaggaagcgaagauaucaaaaaauuacuagaaagccaagggagaaaagacauaaaacuaauugauauagcacuuaguaaaauagacucaaggaaauuugaaaacgcaguaugggaccaauauaaagaccuaugccauaugcauacgggaguaguaguagaaaaaaaaaaaagaggagguaaagaagaaauaacaccacacugcgcacuaauggauuguauaauguuugaugcagcaguaucaggaggacuaaacgcaaguguauuaagagcuguacuaccaagagacaugguauuucgaacaaguacaccaaaaguggucuuauaa

SEQ ID NO: 2837 - RNA, 1710 nt, Artificial Sequence
  derived and/or modified CDS sequence (opt6) from Lassa virus__AHC95560__NP
augucagcaucaaaagaaguaaaauccuuccucuggacacaaaguuuaagacgagaacuaucaggcuauugcucaaauauuaaacuacaagucguaaaagacgcucaagcacuauuacauggacuagauuucagugaaguaucaaauguacaaagauuaaugagaaaacaaaggagagaugauggagaucuaaaaagauuaagagaucuaaaccaagcaguaaauaauuuaguagaauuaaaaucaacccaacagaaaaauguauuaagaguaggaacacuaaauucugacgaccuucucacacucgcggcagauuuagaaaaacuuaaaucaaaaguaacaagaacagaacgaccacuaagcucaggaguauauauggguaauuuaaguucacaacaacuagaccaaagacgagcgcuucuaaacaugauaggaaugagcggaggaaaucaaggaacccaaguagguagagacgguguaguaagaguaugggauguuaaaaacgcagaauuauugaacaaucaauuuggaacaaugccaagucucacauuagcuuguuuaacaaaacaaggacaagcagacuuaaaugacguaguacaggcauuaacagaucuaggccuaauauauacagcaaaauauccaaaugcaucagauuuagacagauuaacacaaagccaccccauacuaaacaugauagacaccaaaaagucgucacuaaacauauccggcuacaacuucucacucggggcagcaguaaaagcuggagcaugcauguuagauggaggaaauauguuagaaacuauuaaaguaucaccucaaagcauggacggaauauuaaaaaguauccuaaaaguaaaaagagcauuaggaauguucguuucagauacaccaggagaaaggaauccauacgaaaacaucuuauacaaaauuuguuuaucaggagauggauggccauauaucgcaucaagaacauccauaguagggagagcaugggaaaauacagucguugauuuagaagcagacgguaauccaaagaaacuaaauucaaacgguagcaauaaaucucuccaauccgcgggcuuuccggccggauuaacauacagccaacuaaugacauuaaaagaugcaaugcuacaauuagacccaaaugcaaaaacauggauggauauagaaggaaggccagaagacccaguugaaguagcacuauaucaaccgaacucagguuguuacauacacuuuuucagagaaccuaccgauuuaaaacaauuuaaacaagacgcuaaauauagucauggaauugauguaacagaccuauuugcagcacaaccaggauuaacaagcgccguaauagaagcacucccaagaaacaugguuauaaccugccaagguagcgaggacauaagaaaauuauuagaaucgcaaggaagaaaagacauaaaacuuauagacaucgcacucucaaaaaccgauucaagaaaauucgagaacgcaguaugggaccaacacaaagaucuaugucauaugcauacaggagugguaguagagaaaaagaaacgaggagguaaagaagaaauaacaccucacugugcauuaauggauugcauaauguucgacgcugcaguaagugguggacuaaauacacuuguuuuaagagcaguacuacccagagacaugguauucagaacaucuaccccaaaaguaguacuauaa

SEQ ID NO: 2838 - RNA, 1710 nt, Artificial Sequence
  derived and/or modified CDS sequence (opt6) from Lassa virus__AIT17127__NP
augucagcaucaaaagaaauaaaaagcuuucuauggacacaaucacucagacgagaauuaaguggauacuguucaaacaucaaauuacaaguaguaaaagaugcgcaggcacuauuacaugguuuagacuucagcgaaguaucuaauguacaacgauuaaugagaaaagaaagaagagacgauaaugaucuaaaaaggcuaagagauuuaaaucaagcaguaaacaauuuaguagaauuaaaaucaacacaacaaaaaaguauacuaaggguaggaacacuaacaagcgacgauuuacuaauccuagcagccgaucuagaaaaacugaaauccaaaguaauaagaacagaaagaccauuaagcgccggagucuacauggguaauuuaaguucccaacaacuagaccaaagaagagcacuauuaucaaugauaggaaugucuggaggaaaucaaggaguacgagcaggcaaagacggaguaguuagaguuugggauguaaaaaaugcagaacuacucaauaaccaauucggaacaaugccaaguuuaacacuagcauguuuaacuaaacaaggacaaguagaccuaaaugacgcaguucaagcacuaacagaccuagguuuaauauauaccgcaaaauauccaaauaccucagauuuagauagacuaacacaaucacacccuauauugaacaugauagacacuaaaaaaucaucacuaaacaucucaggauauaacuucucauuaggagcagcagucaaagccggagcauguauguuagacggaggaaauauguuagaaaccauaaaaguaagcccacaaacaauggacggcauuuuaaaauccauacuaaaagucaagaaagcuuuaggaauguuuauaucagauacuccaggagaaagaaaucccuaugagaauauauuauacaaaauauguuuaucaggugauggauggccauauauagcaucuaggaccucaauaacgggaagagcaugggaaaauaccguaguagaccuagaaucggacggcaaaccacaaaaagcagggucgaacaacagcaauaaaucacuacaaucagcagguuuuacagcaggauuaacauauagucaauuaaugacauuaaaagacgcaaugcuacaacuagauccaaacacaaaaaccuggauggauaucgaaggaaggccagaagauccaguagaaauugcauuauaucaaccaucaagcggauguuauauucauuuuuuuagagaacccacagaccuuaaacaauucaaacaagaugcaaaauacucacauggaauagauguuacagauuuauuugcagcacaaccaggacuaacuagcgccguaaucgacgcauuacccaggaacaugguaauaacaugucaaggcagcgacgacauaagaaaauuacuagaaagccaaggcagaaaagacauaaaauuaauugauaucgcacucaacaaaaccgauucaagaaaauacgaaaacgcuguaugggaccaauacaaagaccuaugucauaugcauacaggaguaguuguagaaaaaaaaaaaagaggaggaaaagaagaaauaaccccacauugugcauuaauggauugcauaauguuugaugcugcaguaucuggaggacuuaacacaucaguacugcgagcaguacucccaagagacaugguuuuuagaacaaguacaccaagaguaguccucuaa

SEQ ID NO: 2839 - RNA, 1710 nt, Artificial Sequence
  derived and/or modified CDS sequence (opt6) from Lassa virus__AIT17131__NP
augucagcaucaaaagaaauaaaaucguuccuauggacacaaucauuacgacgagaacuaucaggcuacuguuccaauauaaaauuacaaguaguuaaagaugcacaagcccuguuacauggacuagacuuuucugaaguaucaaacgugcaaagauuaaugcgaaaagaaagaagagacgauaaugauuuaaaacgauuaagagauuuaaaucaagcaguaaauaacuuaguagaacuuaaaucaacucaacaaaaaucgauucuuagaguggguacacuaucuucugacgacuuacuaguauuagcagcagauuuggaaaaauuaaaaaguaagguaacaagaacagaaagaccccuaagugcaggaguauauauggguaaccuaagcagccaacaacuagaccaaagacgagcacucuuaaauaugauaggaaugucaggaggaaaucaaggagcaagagcaggaagagacgguguaguaaggguuugggauguaaaaaacgcugaacuucuaaauaaucaauucggaacuaugccuucacuaacacuagcaugccuaacaaaacaaggacaagucgacuuaaaugauguaguacaagcauuaaccgaccuaggccuaauauauaccgcaaaauaccccaauacgucagaccuagacagacugacacaaucgcauccaauacuaaacaugguagauacaaaaaaaucaagcuuaaauauaagcggauacaauuuuucauuaggagcagcuguuaaagcaggagcaugcaugcucgacgguggaaauauguuagaaacuauaaaaguaucgccucaaacaauugaugggauacuaaaaaguauauuaaaaguuaaaaaagcacuaggaauguucauaucagauacuccaggagaacgaaacccauaugaaaacauacuauacaaaauauguuuaaguggagaugguuggccauauauagcaucaagaacauccauaacaggaagggcaugggagaauacaguaguagaccuagaaagcgacggaaaaccacaaaaagcagggagcaauaauucaaauaaaucacuacaaucagcaggauuuacagcaggacucacauauucccaauuaaugacacuaaaagaugcaaugcuacaauuagauccuaacgccaaaauauggauggacaucgaaggaagaccagaagauccaguagaaauagcauuauaucaaccaucaagcggauguuauauucacuuuuucagagaaccaacugaucuaaaacaauuuaaacaagaugcaaaauauagccauggaauagauguaacagaccuauucgcagcacaaccuggauuaacaagcgcaguuaucgacgcacuaccaaggaauauggucauaacaugccaaggcgcggaugacauaagaaaauuauuagaaucacaaggaagaaaagauauaaaacuaauagauauagcucuaaauaaagcagacucaagaaaauaugaaaacgcaguaugggaccaauauaaagaucuaugucauaugcauacuggaguaguaguagagaaaaaaaaaagagguggaaaagaagaaauuacaccacauugcgccuuaauggacuguauaauguucgacgcugcaguaagcggcggacuuaacacaucaguacuaagagcaguccuaccaagagauaugguuuuuaggacaaguacaccacgagucguauuauaa

SEQ ID NO: 2840 - RNA, 1710 nt, Artificial Sequence
  derived and/or modified CDS sequence (opt6) from Lassa virus__AIT17139__NP
augagcgcaucaaaagaaauaaaaucauuuuuauggacacaaagccuaagaagagaauuaaguggauauugcucaaauauaaaauuacaaguuguaaaagacgcacaagcacuauuacacggacucgauuuuucagaaguaaguaacguacaaagacucaugagaaaagaaaggagagaugacaaugauuuaaaacgacuaagagauuuaaaucaagcagucaacaaccuaguagaacuaaaaagcacucaacagaaaagcguuuuaaggguaggaaccuuaacuucagaugaucuacuaauauuagcagcagacuuagaaaaauuaaaaucaaaaguaacuagaaccgaaagaccacuaucagcuggaguauacaugggaaaccucucaucacaacaacuugaucaacgcagagcguuauugaauaugauaggaaugucaggagguaaucaaggugcuagagcaggcagagacggaguaguaagaguaugggauguuaaaaaugcagaauuacuaaauaaccaauuugggacaaugccgucacuaacauuagcaugucuaaccaaacaaggacaaguagauuuaaacgacgcaguacaagcucuaacugauuuaggucuaauauauacagccaaauauccaaauacaucagauuuagacagacuaacacaaagucaucccauauuaaacaugauagauacaaagaaaucuucauugaauauaagcgguuacaauuuuucauuaggagcugcaguuaaagccggagcauguaugcuagacggaggcaauauguuagaaacuauaaaaguaucaccucaaacaauggacucaauacuaaaaucaaucuuaaaaguuaagaaagcauuaggaauguucauuucagauacaccaggagaaagaaacccauacgaaaauauauuauacaaaauauguuuaucaggagauggauggccauacauagccucgcggaccucaauaacagggagagcaugggaaaacacaguagucgaucuagaaucagauggaaaaccucaaaaagcuggaucgaacaauagcaauaaaucuuuacaaucagcuggauuugcugccgggcuaacauacucacaacuaaugacauuaaaagacgcaauguuacaacuagacccaaaugcaaaaacauggauggacauagaagguagaccagaagacccaguagaaaucgcccucuaccaaccaagcaguggcuguuacauacacuucuuuagagaaccaacagacuuaaaacaauuuaaacaagaugcgaaauacagccauggaauagauguaacagaucuguuugcagcucaaccaggauuaaccagugcagugauagaugcacuaccgagaaacaugguaauaacaugucaagguuccgaugauauaagaaaacuucuagaaucucaaggccgaaaagacauaaaacucauugacauagcucuaucaaaaaccgauucuagaaaauacgaaaacgcaguaugggaucaauacaaagacuuaugccacaugcauacagguauuguaguggaaaagaagaaaagaggaggaaaagaagaaaucacaccacauugugcauuaauggacugcauaauguuugacgccgcuguaaguggaggauuaaauacaucaguauugagagcaguacuaccaagagauaugguauuuagaacuaccacacccagagucguacuauaa

SEQ ID NO: 2841 - RNA, 1710 nt, Artificial Sequence
  derived and/or modified CDS sequence (opt6) from Lassa virus__AIT17143__NP
augucagcuucuaaagaaauuaaaucauuccuauggacacaaucacucaggagagaacuaucugguuauuguuccaauaucaaauuacaaguaguuaaagacgcacaagcccuuuuacacggucuagauuuuucugaaguaaguaauguacaaagauuaaugcgaaaagaaagaagagacgauaaugaucuaaaacgacuacgagaucuuaaucaagcaguaaauaaccuaguagaacuaaaaucaacacaacaaaaaucaauauugagaguaggaacucuaacaucagacgacuuacuaauauuagcagcagauuuagaaaagcuuaaaucuaaagugacacgaacagaaaggccacucagcgcuggagucuauaugggaaaucuaucaucacaacaacucgaucaaagaagagcucuauuaaauaugauagguauguccgguucaaaccaaggcgcaagagccggacgugauggcguuguaagaguuugggaugucaagaacgcagaauuauuaaacaaccaauucggaacaaugccaucacuaacacuagccugucuaacaaaacaaggacaaguugacuuaaacgacgccguucaagcucucacagacuuaggcuuaauauauacggcaaaauauccaaacacaucagaccuagacagacuaacacaaagucaccccauauuaaauaugaucgauacaaaaaaaucuucauuaaacaucucaggguauaacuuuagccuaggagcagcaguaaaagcaggagcauguauguuagacggaggaaauauguuagaaacgauuaaaguaucaccacaaacaauggacggaauccuaaaaucuauuuuaaaagucaaaaaagcauuaggaauguucaucucagauacuccaggcgaacgaaacccguaugaaaauauacuauacaaaauaugccuuagcggagacggauggcccuauauagcaucaagaaccagcauaacaggaagagccugggaaaauacugugguagaucuagaaagugauggaaaaccacaaaaagccggaaauaacgguucuaauaaaucuuuacaauccgcaggauuuacagcaggauuaaccuauagccaauuaaugacacuaaaagacgcuaugcuacaacuagaucccaacgcaaaaacauggauggacauagaaggaagaccugaagacccaguagaaauagcauuauaucaaccaucaucaggauguuacauacauuuuuuccgagaaccaacagacuuaaaacaauuuaaacaagacgcuaaauauucacacggaauagacguaacagaucuauuugcagcacaacccggucuuacaucugcaguaauugacgcauuaccaagaaaucuuguaauuaccugucaaggaagcgaugacauaagaaaauuacuagaaucacaaggucgcaaagacauuaaauuaauagauauagcacuaaguaaaacggauucaagaaaauacgaaaacgcaguaugggaccaguauaaagaucuuugccacaugcauacaggcauaguagucgaaaaaaaaaaaagaggagguaaagaagaaauaacaccacacugugcacuaauggauugcauaauguuugaugcugcaguaagcggaggccuaaauacaucaguucuaagagcaguacuaccacgagauaugguauucaggaccucaacaccacgaguaguccuuuag

SEQ ID NO: 2842 - RNA, 1710 nt, Artificial Sequence
  derived and/or modified CDS sequence (opt6) from Lassa virus__AIT17147__NP
augagcgcaucaaaagaaauaaaaucauucuuauggacacaaagccuaagaagagaauuaagcgguuacugcucaaacauaaaauuacaaguaguaaaagacgcacaagcacuauuacauggacuagauuucagcgaaguaaguaauguacaaagauuaaugagaaaagaaagaagagacgacaacgaccucaaaagacuaagagaucuaaaucaagcagucaauaaccuaguagaacuaaaaagcacacaacaaaaaagcguauuacgaguaggaacgcuaacaagugacgaccugcucauauuagccgcugauuuagaaaaauuaaaaagcaaaguaacaagaacggaaagaccacuaagcgccggagucuacauggguaaucuaucaucgcaacaauuagaacaaagaagagcccuucuaaauaugauagguaugaguggcucaaaccaaggcgcacaggcaggaagagacggaguagucagaguaugggacgucaaaaacgcagaauuacuuaacaaccaauucggaacaaugccaucccuaacauuagcaugucuaacaaaacaaggacaaguagauuuaaaugaugcaguacaagcauuaacagacuuaggauuaauauauaccguaaaauacccaaacacaucggauuuagacagacucacacaaagccacccaauacuaaacaugauagacacaaaaaaaagcucccuaaauauaucaggauauaauuucucauuaggagcagccgucaaagcaggugcaugcaugcuagacgggggaaacaugcuagaaaccaucaaaguauccccacaaacaauggacggcauacucaaaaguauuuuaaagguaaaaaaagcacuuggaauguucauauccgauacaccaggagaacguaaucccuaugaaaacauauuauacaaaauaugucuaaguggagacggcuggccauacauagcuaguagaacaucaauaacaggcagagcaugggaaaacacaguuguagacuuagaaucugauggaaaaccacaaaaagcagauucaaacucaucaaauaaaucauuacaaucagcaggauuuacagcaggauuaacauauucccaauuaaugacauuaaaagaugcaauguuacaacuagauccaaacgcaaaaaccuggauggacaucgaaggaagacccgaagaccccguagaaguagcacuauaucaaccaaguaguggauguuauauacauuucuucagagagccaacugaccuaaaacaauucaaacaagacgcaaaauauucacacggaauagacguaacagaucuauuugcagcacagccaggauuaacaucagccguaauagaugcauuacccagaaauaugguuaucacaugucaaggaucagacgacauaagaaaacuacuagaaagucaaggcagaaaagauauaaaauuaauagacauagcauuaucaaaaacagacucgcgaaaauacgaaaaugccguaugggaccaauauaaagacuuaugccacaugcauacaggaguaguaguugaaaaaaaaaaacgagguggaaaagaagaaauaacaccacacugcgcccuaauggacuguauuauguucgacgcugcaguaagcggaggacuaaauacauccgugcuaagagcuguacucccuagagauaugguauucagaaccagcacaccacguguaguccuuuaa

SEQ ID NO: 2843 - RNA, 1710 nt, Artificial Sequence
  derived and/or modified CDS sequence (opt6) from Lassa virus__AIT17151__NP
augucagcaucaaaggaaauaaaaucauucuuauggacacaaucacuaagaagagaacuauccgguuauugcaguaacauuaaacuucaaguugucaaagacgcacaagcacuacuacauggauuagauuucucagaagugagcaauguccaacgacuuaugcgaaaagaaagaagagacgauaaugauuuaaaaagauuacgagauuuaaaucaagcaguaaacaacuuaguagaauuaaaaaguacacaacaaaaaagcauauuacgagucggaacccuuacaucagaugaccuuuuaauuuuagcagccgacuuagaaaaauuaaaaucaaaaguaacaaggaccgaaagaccacuaucagcaggaguauauaugggaaaccuuucaucccaacaacuagaucaaagaagagccuuacuaaguaugauaggcaugucuggcgguaaucaaggugcacgagcgggaagagacggaguaguaagaguaugggauguaaaaaaugcagaacuacucaauaaucaauucggaacaaugccaucuuuaacacuagcaugcuuaacaaaacaaggacaaguugacuuaaacgacguagugcaagcauuaacagauuuaggauuaauauauacagccaaauaucccaauacuucagaucuagauagacuaacacaaucacauccuauauuaaacaugauagacaccaaaaaauccagcuuaaacauuagcggauacaauuucucacuaggagcagcaguaaaagcaggugcaugcauguuagacgguggaaauauguuagaaacaaucaaagucucuccacaaacaauggauggcauauuaaaaucaaucuuaaaaguaaaaaaagcauuaggaauguuuauuucagauacaccgggcgaacgaaauccuuaugagaauauauuauacaaaauaugucuaucaggagauggauggccauauauagcuagcagaacuucaauaacaggcagagccugggaaaauaccguaguagaccuagaaucagauggaaaacuacaaaaagccggaucuaacaauucaaauaaaucccuacaaucagcuggauucacagcaggacuaacuuacagccaauuaaugacccuaaaagaugcaaugcuucaacuugacccaaaugcaaaaacauggauggauauagaaggaagaccagaagacccaguagaaauugcacuauaucaaccaagcuccggaugcuacauacacuuuuucagagaaccaacagaucuuaaacaauuuaaacaagacgcaaaauauagccauggaauagauguaacagaucuauuugcagcucaacccggccucacaucugcuguaauagacgcacucccacgaaacauggucauaaccugccaaggaagugaugacauacgaaaauuauuagaaucccaaggacgaaaagauauaaaauuaaucgauauagcacuaaauaaaacugacagcagaaaauaugaaaacgcaguaugggaccaauauaaagacuuaugccauaugcauacaggaguaguuguugaaaaaaaaaaaaaaggcgggaaagaagaaauuacaccucacugugcauuaauggauuguauuauguuugaugcagcagucucaggcggacuaaacacaagcguauuaagagcaguacuaccaagggauaugguauucagaacaucaacaccacgaguaguauuauaa

SEQ ID NO: 2844 - RNA, 1710 nt, Artificial Sequence
  derived and/or modified CDS sequence (opt6) from Lassa virus__AIT17155__NP
augucagcuucuaaagaaauaaaaagcuuccuauggacucaaagucuaagaagagaauuaucaggauacugcaguaacauaaaauuacaaguuguaaaagacgcacaagcacuauugcacgguuuagacuuuagugaaguaagcaauguacaaagauuaaugagaaaagaaagaagggaugauaacgaccuaaaaaggcuaagagaucugaaucaagcaguaaauaacuuaguagaacuaaaaucaacccaacaaaaaucaguacuaagaguaggaacccuaacuucagaugaacuacuaguucuagccgcagaccuagaaaaacuaaaaucgaaaguaauaagaacagaaagaccccuuucagcaggaguauacauggguaaccuaucaagucaacaacuagaucaaagaagagcauuauuaucaaugauaggcaugucaggugguaaccaaggugcgagaacaggaagagacggaguaguuagaguaugggacguaaaaaacgcagaauuacugaauaaccaauucggaaccaugccaucacuaacauuagcaugcuuaacaaaacaaggucaaguagacuuaaacgaugcaguacaagcguuaaccgacuuaggucuaauuuauacagcaaaauauccgaauacaucagauuuagacagacuaacacaaucucacccaauacuaaauaugauugauacaaaaaaaucuucauuaaacauauccggauauaacuuuucacuaggagcagcaguuaaagcaggagcauguauguuagacggaggaaacauguuagaaaccauaaaaguaucgccacaaacaauggacggaauacuaaaaucaauauuaaaaguuaaaaaagcacugggaauguucauauccgacacacccggagaaagaaauccauaugaaaacauauuauauaaaaucugccuaucaggagacggauggccauacauagcuagcagaacaucaauaacaggcagagccugggaaaauacagucguagauuuagaaucagauggaaaaccccaaaaagcaggaucaaacaauucaaacaaaaguuugcaaucagcaggauuuacagcaggacuuacauauagucaacuaaugacauuaaaagaugcgaugcuccaauuggauccaaacgcaaaaacauggauggauauagaagguagacccgaagacccaguagaaauagcauuauaccaacccucaucuggauguuacauacacuuuuucagggaaccaacggaucuuaaacaauucaaacaagaugccaaauauucacacgggauagauguaacugacuuauucgcagcacaaccaggacucacaucagcagucauugaugcccugccccguaacaugguaauaacaugucaaggaucagaugauaucagaaaacuacucgaaucccaaggaagaaaagacauaaaauuaauagauauagccuuaucaaaaauagacucaagaaaauaugaaaacgcagucugggaccaauacaaagaccuaugucauaugcauacuggaguaguagucgaaaaaaaaaaaagaggagguaaagaagaaauaaccccacauugcgcucucauggacugcauuauguuugacgcagcaguuaguggaggauuaaacucacuaguauuaagagcaguuuuacccagagauaugguauucagaacgagcacaccuagaguuguauuauaa

SEQ ID NO: 2845 - RNA, 1710 nt, Artificial Sequence
  derived and/or modified CDS sequence (opt6) from Lassa virus__AIT17161__NP
augagcgcuucgaaagaaauaaaaagcuuccuauggacacaaucuuuacgaagagaguuaucuggauauugcucaaauauaaaauuacaaguaguaaaagaugcacaagcacuccuacacggucuagauuuuuccgaaguaaguaacguccaaagacuaaugaggaaagaaagaagagaugauaaugaucuaaaaagauuaagagauuuaaaucaagcuguuaauaauuuaguagaacuaaaaaguacucaacaaaaaucgauauuaagaguaggaacgcuaacauccgaugaccugcuaauauuagcagcugauuuagaaaaacuaaaaucaaaaguaaccagaacagaaagaccauuauccgcuggaguauacaugggaaaccuuuccucacaacaacuugaccaacgaagagcauuacuuaauaugaucgguaugaguggaucaaaccaaggagcaagaacuggcagagacggcgucgucagaguaugggauguuaaaaacgcugaauuacuaaacaaccaauuugguacaaugccaucacuaacccucgcaugcuuaaccaaacaaggacaaguagaccucaacgaugcuguacaagcauuaacagauuugggacuuauauauacagcaaaauauccaaauacaucagaccuagacagacuaacacaaucccauccaauauuaaauaugauagacacuaaaaaaucaaguuuaaacauaucagguuauaauuucagcuuaggagcagcuguaaaagcaggagcauguaugcuagacggaggcaauaugcuugaaacaauaaaagucaguccacaaacaauggauggaauauuaaaaucaauccuaaaaguaaaaaaagcauuaggaauguucaucagugacaccccaggagaaagaaauccauacgaaaauauauuauacaaaauaugccuaucaggugacggauggccauauauagcaucaagaacgaguauaacaggaagggccugggaaaauacuguuguagaucuagaaagugauggaaaaccacaaaaagcaggaucaaacucaucaaauaaaagucuacaaucagcagguuuaacagcaggacuuacauacagccagcucaugacguuaaaagaugcaaugcuccaacucgacccaaaugcaaaaaccuggauggauauagaaggaagaccagaagacccaguagaaauagcacuauaucaaccaucaucagguugcuacauacacuucuucagagaaccaacagacuuaaagcaauuuaaacaagacgcaaaauauucacauggaauagauguaacugaucuauuugcugcacaaccuggauuaacgucagcaguaauagacgcuuuaccuagaaaccuaguuauaaccugccaaggcagugacgacauaagaaaacuacuugaaucccaggguagaaaagacauuaaauuaauugauaucgcacugucaaaaacagauucuagaaaauacgaaaacgcaguaugggaucaauauaaagauuuaugccauaugcauacaggaauagucguugagaaaaaaaaacgaggaggaaaagaagaaauaacaccacacugugcacuaauggauugcauuauguucgacgcagcaguauccggaggacuuaacgccucaguacuaagagcaguacuaccaagagacaugguauucagaaccucaacaccaagaguaguacuauaa

SEQ ID NO: 2846 - RNA, 1710 nt, Artificial Sequence
  derived and/or modified CDS sequence (opt6) from Lassa virus__AIT17165__NP
augagcgcaucuaaagaaaucaaauccuuuuuauggacacaaagcuuaagaagggaauuaucagguuauugcaguaacauaaaauuacaaguaguaaaagaugcacaagcauuauuacacggauuagauuucucagaaguaaacaauguacaaagacuaaugcgaaaagaaaggagagacgacaacgaccuaaaaagauuaagagaucugaaccaagcaguaaacaauuuaguagaauugaaaucaacucaacaaaaaucaauuuuaagggucggaacacuaaccucagacgaccuacugauacucgcagcagaccuagaaaaacucaaaucaaaaguaacaaggaccgaacgaccccuuucagcaggaguauacauggguaaccuaucaucacaacaauuagaucaaagaagggcauuauuaaacaugaucggaaugucaaauggaaaccaagguacuagagcagguagagauggaguaguaaggguaugggacguuaaaaaugcagaacuauuaaacaaucaauucggaacaaugccaucuuuaacucuagcuuguuuaacaaaacaaggacaaguagacuuaaacgaugucguccaagccuuaacagacuuaggguuaauauacacagcaaaauauccaaauaccucugacuuagaucgucucacacaaagccaccccauauuaaacaugauagacacaaaaaaaucaucauuaaacauaucuggauauaauuucaguuuaggugcagcaguuaaagcaggagcauguauguuagacggcggcaauaugcuagaaacuaucaaagucucaccacaaaccauggaugguaucuuaaaaucaauacuaaaagucaaaaaagcacucggaauguucauuucagacacacccggagaaagaaauccauaugagaauauacuauacaaaauaugucuaagcggagacggauggcccuacaucgcaagcagaacuucaauaacaggccgugcuugggaaaauacuguuguagauuuagaaucagacggaaaaccacaaaaagcagacucaucaaacucaaacaaaucauuacaaucagcaggauuuacagcuggauuaacauacucucaacuaaugacacuaaaagaugcaaugcuucaauuagauccaaacgcaaaaacauggauggauauagaaggacgaccagaagauccaguagaaguagcauuauaccaaccaucaucugguuguuauauacacuuuuuuagagaaccaacagaccucaaacaauucaaacaagacgcuaaauauucccauggaauagacguaacagaucuauucgcagcacaaccaggauuaaccucagcaguaauagaugcacuaccaagaaauaugguaauaacaugucaagguuccgacgacauuaggaaacuauuagaaucacaaggaagaaaagacauaaaauuaauagacaucgcacucucuaaagcggacagcagaaaauaugaaaaugcaguuugggaccaacacaaagaucuuugccauaugcauacaggugucguuguagaaaaaaaaaaacgcggaggaaaagaagaaauaacaccacauugugcacuuauggauugcauaauguaugaugcagcaguaucaggcggacucaacacgaguguccuacgagcaguauuaccuagggauaugguauuuagaacaaguacaccacgaguaguacuuuaa

SEQ ID NO: 2847 - RNA, 1710 nt, Artificial Sequence
  derived and/or modified CDS sequence (opt6) from Lassa virus__AIT17169__NP
augucagcauccaaagaaauaaaaaguuuuuuauggacacaaucacuacgaagagaacuaucaggauauuguucaaacauaaaauuacaaguaguaaaagaugcccaagcauuauuacacggacuugauuucagugaaguaagcaauguccaaagacuaaugagaaaagaaagaagagaugacaacgaccuuaaacgauuaagagacuuaaaucaagcaguaaauaaccuaguagaauuaaaaucaacacaacaaaaaaguauauuaagaguagguacacucacaucagaugaccuacuaauauuagcagcagaucucgaaaaacuaaaaagcaaaguaauaagaacagaaagaccacuaagugcaggaguauauaugggaaacuuaucaucacaacaacuagaucaaagaagagcacuccuaucuaugauaggaaugagcagcggaaaccaaagagcacaagcaggaagagauggaguaguacgaguuugggacguaaaaaacguagaauuacugaauaaucaauucggaacaaugccaagccuaacacuagcgugcuuaaccaaacagggacaaguagaccugaacgacgcaguacaagcucuaacagaucuaggucuaauauacacagccaaauacccaaauaccagcgauuuagaccgccuaacacaaucgcauccaauauuaaauaugauagauaccaaaaaaucaagccuaaacauaucaggauauaauuuuucacuaggggcggccgucaaagcuggagcauguauguuagauggagggaauaugcuggaaacaaucaaaguaaguccacaaacuauggacggaauucuaaaaucaauauuaaaaguaaaaaaagcacuaggaauguuuaucucagauacaccaggagaaagaaacccuuaugaaaauauacuauacaaaauaugucuuucaggagauggauggccauauauagcaucaagaaccucaauaacaggacgagcuugggaaaauacaguaguugaucuagaaagugaugguaaaccacaaaaagccggaaguaauaauaguaauaaaucauuacaaucaguaggauuuaccgcaggauuaacguauagucaacuaaugacacuaaaagacgcaaugcuacaacuagaccccaaugcaaaaacauggauggacauagaaggaagaccagaagacccgguugaaauagcacuauaucagccuucaucgggaugcuauauacacuuuuuuagagaaccuacagaucuaaaacaauuuaaacaagaugcaaaauacagccacggaauagacguaaccgaucucuuugcagcacaaccaggcuuaacaucagcuguaaucgaugcacuaccuagaaacaugguaaucaccugccaaggaucagaugauaucagaaaauuacuagaaucacaaggcagaaaagacauaaaacuaauagauauugcauuaagcaaaacugacaguagaaaauaugaaaacgccgucugggaccaauauaaagaccuaugccacaugcacacaggaguaguuguagaaaaaaaaaaacgaggaggaaaagaagaaauaacuccacacugugcacuaauggauuguauaauguucgaugcagcaguaaguggaggacuaaauacuaguguacuacgugccguucucccacgagacaugguuuuccguacaaguacaccaagaguaguacuuuaa

SEQ ID NO: 2848 - RNA, 1710 nt, Artificial Sequence
  derived and/or modified CDS sequence (opt6) from Lassa virus__AIT17173__NP
auguccgcaucaaaagaaauaaaaucuuuucuuuggacacaauccuuacgaagagaacucucgggauauugcucuaacauaaaacugcagguaguaaaagacgcucaagccuuauuacauggacucgacuuuucagaaguuucaaacguccaacgcuuaaugcguaaagaacgaagagaugauaaugaccuaaaacgacuuagagaucuaaaccaagcaguuaacaacuuaguagaacuaaaaaguacacaacaaaaaucgaucuuaagaguuggaacauuaacaagugaugaccuauuaauacuagccgccgaccuagaaaaacugaaaucaaaaguaacaagaacagaacgaccguuaucugcaggcguuuauaugggaaaccugucgucgcaacaacuagaccaaagaagagcuuuacuaaacaugauaggaaugagcggaucaaaucaaggagcacgcgcaggaagggauggaguaguaagaguaugggacgucaaaaaugcagaacuauuaaacaaucaauucggaacaaugccuucacuaacacuagccuguuuaacaaaacaaggacaaguagaucuaaacgaugcuguacaagcacuaacagacuuaggccuaauauauacagcuaaauacccaaauacaucagacuuagacagauuaacucaaagucacccaauauuaaacaugauagauacaaaaaaaucaaguuuaaacauuaguggauacaacuucucacuaggagccgcuguaaaagcaggugcauguauguuagauggaggaaacauguuagaaaccauuaaaguauccccacaaacaauggauggaauuuuaaaaucuauacuuaaaguaaaaaaagcacuagguauguuuauaucagaugcaccaggagaaagaaauccuuaugaaaacauacucuacaaaauaugccucaguggagauggauggccguauauagcaucaagaacaucaaucacaggcagagcaugggagaauacaguaguagaucuagaaagugauggaaaaccacaaaaagcagguucaaauggaucaaacaaaucuuuacaauccgcaggauucacagccggucuuacauauagccaauuaaugacacuaaaagaugcuauguuacaguuagauccaaacgcaaaaacauggauggauaucgaaggaagaccagaagacccuguugaaauagcucuauaucaaccaucaucaggaugcuauauacacuuuuuuagagaaccaacagaucucaaacaauuuaaacaagaugcaaaguauucacacgguauagacguaacagaccuauuugccgcacaaccaggacuaaccucagccguaauagaugcgcucccacguaacaugguaauaacuugucaaggaagcgaugacauaagaaaacuauuugaaucacaaggaagaaaagacauuaaacuaaucgauauugcuuuauccaaaacagacucaagaaaauacgaaaacgcaguaugggaccaauacaaagacuuaugccauaugcacacaggaauaguaguggaaaaaaaaaaaagaggaggaaaagaagaaauaacaccacacugcgcucuaauggauugcauuauguucgacgcagcagucucagguggauuaaauacaaguguacuaagagcaguacuaccaagagauaugguuuucagaacaaguacaccaagagugguuuuauaa

SEQ ID NO: 2849 - RNA, 1710 nt, Artificial Sequence
  derived and/or modified CDS sequence (opt6) from Lassa virus__AIT17177__NP
augucagcaagcaaagaaaucaaaucauuccuauggacucaaucauuaagaagagaauuaucaggauauuguucaaacaucaaauugcaaguaguaaaagacgcacaagcacuuuuacacggacuagauuuuagugaagucagcaauguacaacgacuuaugcguaaacaaagaagagacgacaacgaucuuaaaagacuaagagaucuaaaccaagcuguaaauaaccuaguagaacuaaaaucaacucaacaaaaaucaguacuaagaguaggaacacuaaccucagaugaucuuuuaguucucgccgccgaucuagaaaaauuaaaaaguaaaguaauaagaacagaaagaccacuaagugcaggaauauauaugggaaauuuaagcagccaacaauuagaucaaagacgagccuuauuaaauaugauaggcaugucaggaggaaaccagggugcaagagcaggaagagauggaguaguaagaguaugggauguaaaaaacgcagaccuauuaaauaaccaauuuggaacaaugccaagcuuaacauuagcaugcuuaacuaaacaaggucaaguagaccuaaacgaugucguacaagcauuaacugacuuaggauuaauauauacagccaaauacccuaauacaucagaucuagaccgacuaacacaaagccacccuauuuuaaaaaugauugacgccaauaaaaguucacuuaacaucaguggauacaacuucucacuaggagcagcaguaaaagcaggugcauguaugcuagacgguggaaauauguuagaaacuauaaaaguaucuccacaaacuauggacggaauacuaaaaaguauacuaaaaguaaagaaaucacuuggaauguucaucagcgacacaccgggagaaagaaacccauaugaaaauauccuuuacaaaauaugccuaucuggagauggauggccuuacauagcaucaagaacaaguauaauuggaagagcaugggaaaauacaguugucgaucuagaaucagauggcaaaccacaaaaaacaggaagcaacaauucaucaaaaucacuacaaagcgcaggguuugccgcagguuuaacauacagccaacuaaugacguuaaaagacgcaauguuacaauuagacccaaaugcaaaaacauggauggacauagaaggaaggccagaagacccaguagaaauagcauuauaucaaccaagcucagguuguuauauacacuuuuuucgagaaccaacugauuuaaaacaauucaaacaagacgcaaaauauagucacggcaucgacguaacagauuuauuugcagcucaaccaggauuaacaucagccguaaucgaagcuuuaccuagaaauaugguaauaaccugccaagguucagaugacauacgaaaauuguuagaaucacaaggcagaaaagauauaaaacuaauagacauagcucuauccaaaacagauucaagaaaauacgaaaacgcuguuugggaccaauacaaagaucuaugccacaugcauaccgguauaguaguggaaaaaaaaaaaagaggaggaaaagaagaaauuacaccacauugugccuuaauggauugcauaauguucgacgcagcaguaucaggcggccuuaacacacucgucuuaagagccguacuaccuagagacaugguauuccguacaaguacaccaaaaguuguacuauaa

SEQ ID NO: 2850 - RNA, 1710 nt, Artificial Sequence
  derived and/or modified CDS sequence (opt6) from Lassa virus__AIT17181__NP
augucggcaucaaaagaaguaaaaucuuuccuuuggacccaaucucuaagaagagaacuaucagguuacuguucuaacauaaaauuacaaguugucaaagacgcgcaggcacuacuucaugguuuagauuucagcgaaguaagcaauguacaacgauuaaugagaaaacaaagaagagacgauaacgaucucaaaagauuaagagauuuaaaccaagcaguaaacaacuuaguagaacuaaaaucaacacaacaaaagagcguuuuaagagucggaacucuaacaagcgaugaucuacuaguacuugcagcagaucuagaaaaauuaaaaagcaaagucauacggacagaacgaccauuaucagcaggaguauauaugggaaauuuaucuagccaacaauuagaccaaaggcgagcauuacuaaacaugauaggaaugucuggaggaauacaaggaacaaggacaggaagagauggugugguaagaguaugggacgucaaaaacgcagaucuauuaaauaaccaauucggaacaaugccaagucuaacauuagcaugucuuacuaaacaaggccaaguagauuuaaaugauguaguacaagcacuaacagauuuaggccuaaucuauacagcaaaauacccaaacgcaagcgacuuagacagauuaacacaaucacacccaauauuaaacaugauagauaccaaaaaaucaucacuaaacauuucagguuacaacuucaguuuaggagccgcaguaaaagcaggagcauguaugcuagacggaggaaauaugcuugagacaaucaaaguaaguccacaaacuauggauggaauacuaaaaucaauacuaaaaguaaaaaaaaccuuaggaauguuuauaucagauacaccuggagaaagaaauccauaugaaaacauauuauacaaaauauguuuaucuggugacggcuggccuuacauagcaucccgaacaucaaucacaggacgugcaugggaaaauaccguugucgaucuugaaagugacgguaaaccacaaaaagcugguagcaacaauucaaauaaaucauuacagucagcaggauucgcagcaggucuaacauauucacaauuaaugacacuaaaagacgcaaugcuacaauuagacccaaaugcgaaaacauggauggauauagaagggagaccugaagauccaguagaaauagcuuuauaccagccaucaucuggauguuacauacauuucuuccgagaaccaacagaucuaaaacaauuuaaacaagacgcaaaauacucacauggaauagacguuacagaucuauuugccgcacaaccaggacuaacaucagccguaauagaagcacucccaagaaacaugguaauuaccugucaaggaucagaugacauuaaaaaacuacuggaaucacaaggcagaaaagacaucaaauuaauagauauagcauuaucaaaaacagacucaagaaaauacgaaaaugccguaugggaucaauacaaagaucucugccacaugcacacaggcguaguagucgaaaaaaaaaaacggggaggaaaagaagaaauaacaccccauugugcauuaauggacugcauaauguucgacgcagcaguaucaggaggacucaacacacuaguacuuagggccguacuaccacgagacaugguauucagaacaucgacccccagaguaguacuuuga

SEQ ID NO: 2851 - RNA, 1710 nt, Artificial Sequence
  derived and/or modified CDS sequence (opt6) from Lassa virus__AIT17185__NP
augucagccaguaaagaaauaaaaaguuuucuauggacccaaagucuaagacgggaauuaaguggauauuguucaaauauaaaacuacaaguagugaaagacgcacaagcauuauuacacggacuagauuucagugaaguaucaaauguucaacguuuaaugcgaaaacaaagaagagaugauggagaucuaaaaagacuaagagaccuaaaccaagcaguaaacaaucuaguagaauuaaaauccacacaacaaaaauccgucuuaagaguuggcacucuaacaagugaugaucuuuuaauuuuagcggcagauuuagaaaaauuaaaaaguaaaguaacaagaacagaaagaccccucagcgccgguguauacaugggaaauuuaucaucacaacaacuagaucaaaggagagcauuauuaaacaugauaggaaugagcgguggaaacagaggcgcuagaacaggaaaagauggaguaguaagaauaugggauguuaaaaaugcagaccugcucaauaaucaauuuggaacaaugccaucacuaacacuagcaugccuaacaaaacaagggcaaguagacuuaaacgauguaguucaagcccuaacagaucugggcuuaauauauacagcaaaauauccaaauaccagugauuuagacaggcuaacacaaucacauccgauauuaaauaugaucgauacaaauaaaucaucacucaacauauccggauacaauuucucuuuaggcgcagcaguaaaagcaggagcauguauguuagacggaggcaauauguuagaaacuauuaaaguaucaccacaaaccauggacgguauauuaaaaucaauacuuaaagucaagaaauccuuaggaauguuuauaagcgauacaccuggagaaaggaauccauaugaaaauauauuauauaaaauaugucucucaggagaugguuggccguacauagcaagcaggacaucaauaacuggacgagcuugggaaaauaccguaguagaccuagaaucagacgaaaaaccacaaaaagcaggaucaaauaacaguaacaaaagucuacaaucaacaggauucacagccggacuuacauacucacaacuaaugaccuuaaaagaugcaaugcuccaacuagauccaaacgcaaaaacuuggauggacauagaaggucguccagaagacccaguagagauagcacuauaccaaccaaguucaggaugcuauauucacuucuuucgagaaccaacagaucuaaaacaauuuaaacaggacgccaaauacucacauggaauugauguaacagauuuauuugcagcacaaccgggauuaacauccgcaguaauagauacauuaccaagaaauaugguaauaacaugucaagguagugacgacauaagaaaauuacuugaaucacaagguagaaaagauauaaaacuuauagauauagcccuaucaaaaacagacuccagaaaauacgaaaaugcagugugggaucaauauaaagacuuaugccauaugcauacaggaguaguaguagagaaaaagaaaagagguggaaaagaagaaauaacaccacacugcgcacuaauggauuguauaauguucgacgcagcaguaagcggaggauuaaacgcaagcguauuacgugccguauuaccaagagauaugguauucagaacaaguacaccaaggguaguccucuaa

SEQ ID NO: 2852 - RNA, 1710 nt, Artificial Sequence
  derived and/or modified CDS sequence (opt6) from Lassa virus__AIT17189__NP
augucagcaucaaaagagauaaaaucauuccuuuggacacaauccuuaagaagagaacuuucaggauauuguagcaacauaaaacuucaagucgucaaagaugcacaagccuuacuacacggauuagacuucucagaaguaaguaauguacaacgauuaaugagaaaagaaagaagagacgacaacgauuuaaaaagauuaagagauuuaaaucaagcuguaaauaauuuagucgaauuaaaaucaacacaacaaaaaucaguauuaagaguaggaacccuaacaucagaugaccuacuaauacuagccgcagaucuagaaaaauuaaaaucaaaaguaaccagaacagaaagaccacuaucugcaggaguauauauggguaaucuuagcucacaacaauuggaccaaagacgagcauuauuaagcaugaucggaaugagcggaggaaaccaaggcgcuaggacuggacgugacggaguaguaaggguaugggacguuaaaaaugcagaauuacuaaauaaucaauucggaaccaugccaucauuaacacuagcauguuuaaccaaacaaggacaaguagacuuaaaugauguaguacaagcacuaacagaucuaggacuaauuuauaccgcuaaauacccaaauaccuccgauuuagaccgauuaacccaaucacacccaauacuaaacaugaucgacacgaagaaaucaagccuaaauauaagcggauauaauuucuccuuaggcgcggcaguaaaagcaggagcauguauguuagacgggggaaauaugcuagaaacaaucaaaguaucuccacaaacaauagacggcauauuaaaauccauacuaaaaguaaagaaagcauugggaauguuuauaagcgauaccccgggcgaaagaaaucccuaugaaaauauauuauacaaaauauguuuaucaggagauggauggccauauauagcaagcagaaccucaauaacaggacgagcaugggaaaauacaguggucgauuuagaaucagauggaaaaccacaaaaagcagguucaaacaacuccaacaaaagucuacaaucugcaggauuuacagcaggacuaacauauucacaacuuaugacacuaaaagaugcaauguuacaauuagauccaaaugccaaaacuuggauggacauagaaggcagaccagaagacccaguagaaauagcauuauaucaaccaagcagcggauguuauauucauuucuuuagagaaccuacggaccuaaaacaauuuaaacaagaugccaaauacucacacgguauagacguaacggaccuuuuugcagcacaaccaggccugacaucagccguuauagacgcuuuaccaagaaacaugguaauaacaugucaaggauccgacgacauaagaaaauuacuagaaucacaaggaagaaaagacaucaaacuaauagacauagcauuauccaaaacagacucaagaaaauacgaaaaugcaguaugggaccaauauaaagacuuaugccacaugcauacaggaguuguaguagaaaagaagaaaagaggaggaaaagaagaaauaacaccacauugugcauuaauggauuguauaauguuugacgcagcuguaaguggaggauuaaauagccuaguacuacgggcgguacuaccgagagauaugguauuuagaacuucaacuccaagaguaguauuauaa

SEQ ID NO: 2853 - RNA, 1710 nt, Artificial Sequence
  derived and/or modified CDS sequence (opt6) from Lassa virus__AIT17193__NP
augagugcaucaaaagaaauuaaaucauucuuauggacacaaucucuuagaagagaacuaaguggauacugcagcaacauaaaacuccaaguaguuaaagacgcccaagcauuauuacacggacuagauuuuucugaaguaucaaauguucaaagacuaaugagaaaagaacgaagagacgauaacgaucuaaaaagacuaagagaccuaaaucaagccgugaacaaccuaguagaacucaaaucaacccaacaaaaaucaguauuacgagucggaacacuuacaucagaugacuuacuaauauuagcagcagauuuagaaaaauuaaaaucaaaaguaacaagaacagaaagaccucuaucagcggguguauauaugggaaaucuaucaagucaacaauuagaucaacguagagcacuacuaagcaugauagguaugaguggagguaaccaaggggcaagaacagguagagauggaguaguaagaguaugggauguuaaaaacgcugaacuacugaacaaucaauucggaacaaugccaucacuaacacuugcuugucuaacaaaacaaggccaaguagaccuuaacgacgcaguacaagcacuaacugacuuaggauuaauauacaccgcaaaauaucccaacacaucagauuuagaucgacuaacgcaaucucacccaauauuaaacaugauagacacaaagaaaucaucauuaaacaucuccgguuacaauuucucacuaggagcagccguaaaagcaggagccugcauguuggauggaggaaauauguuagaaacaauaaaaguaagcccacaaacaauggacggcauacucaaaucaauucuaaaaguaaagaaagcacucggaauguuuauaucagauacaccaggagaacgaaaccccuacgaaaauauacuauauaaaauaugucugaguggagacggauggccauauauagcaaguagaaccaguauaacuggacgagcaugggaaaauacaguaguagacuuagaaucagauggaaaaccccaaaaagccggaaauaacaauuccaauaaaucacuucaaucagcaggauuuacagcaggccuaacauauucacaauuaaugacacuaaaagacgcaaugcuacaacuagacccaaaugcaaaaacauggauggacauagaaggacguccagaagacccaguagaaauagcauuauaucaacccucaagcggauguuauauucacuucuuccgagaaccuaccgacuuaaaacaauuuaaacaagaugcaaaauacagccacgguauagacguaacagaccuauuugcagcucaaccuggucuaacaucagcaguaauagacgcauuaccaagaaacaugguaauaacaugucaagguucagaugacauaagaaaacuauuggaaagucaaggacgaaaagauauaaaauuaauagauauagccuuaaguaaaacagacucaagaaaauacgaaaacgcaguuugggaccaauauaaagaccuaugccauaugcauacaggaguggucguagagaaaaagaaaagaggagguaaagaagaaauaacaccacacugugcccuaauggacugcaucauguuugaugcagcaguaagcggaggacuaaacagucuaguauuaagagccguguuaccuagagauaugguauuucguacaucaacucccagaguaguauuguaa

SEQ ID NO: 2854 - RNA, 1710 nt, Artificial Sequence
  derived and/or modified CDS sequence (opt6) from Lassa virus__AIT17197__NP
augucagcaagcaaagagauaaaaagcuucuuauggacacaaucacucagaagagaauuaaguggauacugcaguaauauaaaacuacaaguaguaaaagacgcucaagcacuauuacacggguuagauuucagcgaaguaagcaauguacaaagauuaaugaggaaagaaagaagagacgauaacgaccuaaaacgacuacgagaccuaaaucaagccguaaauaacuuaguagaauuaaaaucaacucaacaaaaaagcauauuaagagucggaacacuaacuagcgacgaccuacuuauucuggcagcggaucuagaaaaacuaaaaagcaaaguaauacgaaccgaaagaccauuaucagcuggaguauauaugggaaauuuaagucuacaacaauuagaucaacgaagagcauuauuaaacaugauaggaaugucuggcagcaaccaaggaguacgcgcaggaagggacgggguuguucgaguaugggauguaaagaaugcugaacucuuaaacaaccaauuuggaacaaugccaucacuaacacuagcaugcuuaacaaaacaaggccaaguagauuuaaacgaugcaguacaagcccuaacagacuuagguuuaauauauacugcaaaauacccaaacacuucagaccuugauagacuaacacaaucucauccaauccuuaauaugauagacacaaaaaaaaguucauuaaacauaucaggauacaauuucagucuaggagcagccgucaaagcaggagcauguauguuagacggaggcaauauguuagaaacaauuaaaguaucaccucaaacuauggacggaauccuaaaaucaauuuuaaaaguaaaaaaagcacuagggauguucauaagcgauacaccuggagaaagaaauccauacgaaaacauacuauauaaaauaugucuaucaggagacggauggccuuauauagcaagcagaacaaguaucacaggaagagcaugggaaaacacaguuguagaucuugaaucagacggaaaaccacaaaaagcuggaucaaacgguucaaacaaaagucuacagucagccggauucacugcaggccuuacauauagucaauuaaugacauuaaaagacgcaaugcuacaacuagauccaaaugcgaaaacauggauggauauagaaggacgaccagaagauccaguagaaauagcacucuaucaaccaucgucagguugcuacauacauuucuuuagagaaccaacugaucuaaaacaauucaaacaagaugcuaaauacucacacggaauugacguaacagauuuauuugcagcacaaccaggauuaacaucagcaguuauugaugcauuaccaagaaauaugguaauaacaugucaaggaagcgacgacauuagaaaacucuuagaaucucaaggaagaaaagauauaaaauuaauagauauagcauuaaguaaaaccgauucaagaaaauacgaaaacgccguaugggaccaauacaaagauuuaugccauaugcauacaggaaucguaguagaaaaaaaaaaacgaggaggaaaagaagaaauaacaccacacugugcauuaauggacuguauaauguuugacgcagcaguuucagguggacuuaacacaagcguacuacgagcaguauuaccaagagauaugguuuuuagaacaagcacuccaagaguaguauuauaa

SEQ ID NO: 2855 - RNA, 1710 nt, Artificial Sequence
  derived and/or modified CDS sequence (opt6) from Lassa virus__AIT17201__NP
augagcgcuuccaaagaaauuaaaucuuucuuauggacacaaucacucagaagagaacuaagcggauauuguagcaacauaaaauuacaaguaguaaaagacgcccaagccuuacugcacggacuagacuuuucugaaguaaguaauguccaaagauuaaugaggaaagaacggagagaugauaaugaucucaaacgucuaagagaccucaaucaagcaguaaauaacuuaguagaacuaaaauccacacaacaaaaaagcauacuaagagucggaacacuaacaucagaugaucuguuaauucuugcagccgaccuagaaaaauuaaaaucaaaaguaacacgaacagaaagacccuuaucagcagguguauauaugggaaacuuaucaucucaacaacuugaccaaagaagagcauuauuaaacaugauagguaugagcggguccaaccaaggagcaagagcaggaagagacggaguaguacgaguaugggauguaaaaaacgcagaauugcugaauaaucaauucgguaccaugccaagucuaacauuagcaugccuaacaaaacaaggucaaguagaccuuaacgacgccguacaagcucuaacggaccuugguuuaauauauacagcuaaauaucccaacaccucagacuuagaccgucugacucaaucacauccaauauuaaacaugauagauacaaaaaaaucaucacuaaauauaucaggcuacaacuucucacuaggggcagccguaaaagcaggcgcaugcauguuagauggugguaacaugcuagagaccauaaaaguaucaccacaaacgauggacgguauauuaaaaagcauauuaaaaguaaaaaaagcgcucggcauguucauaagcgacgcacccggagaaagaaauccauaugaaaauauauuauacaaaauuugucucucaggagauggauggccauauauagcauccaggacuucaauaacaggaagagcaugggaaaacacaguaguagauuuagaaucagauggaaaaccccaaaaagcaggaaguaacggaagcaauaaaucuuuacaaagcgcugguuucacagcaggcuuaacauauucccaauuaaugacauuaaaagacgcaauguuacaacuugauccaaacgccaaaacauggauggacauagaaggucgaccagaggacccaguagaaauagcacuauaccaaccaucaaguggaugcuauauacacuuuuuuagagaaccaacagacuuaaaacaauuuaaacaagacgccaaauauucacacgguauagacguaacagaccuuuuugccgcucaaccaggauuaacaagugcaguaauugaugcacuaccaagaaacaugguaauaacaugucaaggaagcgaugauauaaaaaaauuauucgaaucacaaggaagaaaagauauaaaacuaauagauauagcacuaucaaaaacagauucacgcaaauacgaaaacgcuguaugggaucaauauaaagacuuaugccauaugcacacaggaaucguuguagaaaaaaaaaaaagaggaggaaaagaagaaauaaccccucauugcgcguuaauggauugcauaauguuugacgcagcaguaaguggaggcuuaaacacuucaguauuaagggccguccuaccaagagauaugguauucagaacaucaacaccgcgagugguauuauaa

SEQ ID NO: 2856 - RNA, 1710 nt, Artificial Sequence
  derived and/or modified CDS sequence (opt6) from Lassa virus__AIT17205__NP
augucagcgucaaaagaaauuaaaucauuucuauggacacaaaguuuaagacgagaauuaucuggauacugcagcaacauaaaacuacaaguaguaaaagacgcacaggcccuacuccacggacuugauuucagugaaguuuccaacguacaaagacuaaugcguaaagaaagaagagacgauaacgaccuaaaacgauuaagagacuuaaaccaagcaguaaauaauuuaguagaacuaaaaucaacucaacagaaaucgauauuaagagucggaacauuaacaucagaugacuuauuaauucucgcagccgauuuagaaaaacuuaagaguaaagugacacgaacagaaagaccauuaucagcaggaguauacaugggaaacuugucaucacaacaacuagaccaacgaaaagccuuacuaaauaugauaggaauguccggaucuaaccaaggcgccagaauaggaagagacggaguaguaagaguaugggauguaaaaaacgcagaacuccuaaauaaucaauuuggaacuaugccaagccuaaccuuagcauguuuaaccaaacaaggacaaguagaucuuaaugaugcaguacaagcauuaacagaccuaggauuaauauacacugcaaaauauccaaauacaucagaucuagacagauuaacucaaucacacccaauauuaaacaugauagauacaaaaaagucaucacuaaauauaucaggauauaauuucagccuaggugcagcuguuaaagcuggagcaugcaugcuugacggcggaaacauguuagaaacaauuaaaguaucaccccaaaccauggauggaauauuaaaaucgauacuaaaaguaaaaaaagcacuaggaauguucauaucagacacgccaggagaaagaaauccauaugaaaacauacuauauaaaauaugccuaagcggcgauggcuggccauacauagcaucaagaacuucaauaacaggaagagccugggaaaauacaguuguagauuuagaaagugauggaaaaccacaaaaagcaggcucuaacucuaguaacaaauccuuacaaucagcaggauuaacagccggguuaacuuacucacaacuaaugacucuaaaagaugcaaugcuacaacucgaucccaaugccaaaacauggauggauauagaaggaagaccagaagacccaguagaaauagcgcucuaucaaccuagcaguggaugcuauauacacuuuuuuagagaaccuacagauuuaaaacaauuuaaacaagaugcaaaauauucacauggaaucgacguaacugaccuauucgccgcacaaccaggauuaacaagcgcgguaauagaugcacucccaagaaaucuaguaauaacuugucaaggaagugaugauauaagaaaacuauuagaaucgcaagguagaaaagauaucaaacuaauagacauagccuuaaguaaaacagauucaagaaaauacgaaaacgcaguaugggaucaauacaaagaucuaugucauaugcacacaggaauaguaguagaaaaaaaaaaacgaggaggaaaagaagaaauaacaccacacugcgcauuaauggauugcaucauguuugacgcagcaguaucaggaggccuaaacgcaucuguauugagagcaguacuuccacgagacaugguuuuccgaacaucaacaccaaggguaguauuauaa

SEQ ID NO: 2857 - RNA, 1710 nt, Artificial Sequence
  derived and/or modified CDS sequence (opt6) from Lassa virus__AIT17209__NP
augagugcaucaaaagaaauaaaaucauuucuauggacacaaaguuuaagacgagaacuauccggauacugcucuaauauaaaacuucaaguaguaaaagacgcucaagcucuauuacauggucuagacuuuucagaaguaagcaauguacaaagauuaaugcgaaaagaacgaagagacgacaacgaucuuaaaagacuaagagacuuaaaucaagcaguaaauaaucucguagaacuaaaaagcacacaacaaaaaagcauauuaagaguaggaacacuaacgucagaugaccuacuaauacuagcagcagauuuagaaaaauuaaaaucuaaaguaacaagaacagaaagaccacuauccgccggagucuauaugggaaaccuaucaucucaacaacuagaccaaagacgagcacuuuuaagcaugauuggaaugucaggaggaaaccaaggcgcacgagcaggccgagauggaguaguaagaguaugggacguuaaaaacgcagaauuauuaaauaaucaauucggaacuaugccgagucuaacauuagcaugucuaacaaaacaaggacaaguagacuuaaaugaugucguccaagcauuaacagaucuaggacuaauauacacagccaaauaucccaauacaucagauuuagaccgacuaacacaaagucacccaauacuuaacaugauagauacaaaaaaaucaagcuuaaacauauccggauacaacuucucauuaggagcagcuguaaaagcaggagcaugcauguuagaugguggcaacaugcuggaaacaauaaaaguaagcccccaaacaauggacgguauacuaaaaucuauauuaaaaguaaaaaaagcucuaggaauguucauaucggauacaccaggagaaaggaaucccuacgaaaacauccuauacaaaaucugcuuaaguggagauggcuggccguauauugcaagucgaacaagcauaacaggaagagcaugggaaaacacuguugucgauuuagaauccgaugguaaauuacaaaaaacaggcaguaacaacucgaauaaaagucuacaaagcgcaggauucacagcaggacucacauauucacaauuaaugaccuuaaaagaugcaauguuacaacuugauccaaaugcaaaaauauggauggauauagaagggaggccagaagauccaguggaaauagcccuauaucaaccaucaaguggaugcuauauacacuuuuuuagagaaccaacagaucucaaacaauuuaaacaagacgcaaaauacucacaugguauagacguuacagauuuauucgccgcacaaccagguuuaacauccgcaguaauugaugcauuaccaaggaacaugguaauaacaugccaaggaucugaugauauuagaaaacuacuugaaucacaaggaagaaaagauauaaaacucaucgauauagcauuaaacaaaaccgauagucgaaaauaugaaaacgcaguaugggaccaauacaaagaccuuugucauaugcauacaggaguagucguugaaaaaaaaaaaaaaggagguaaagaagaaaucacuccacauugcgcauuaauggacuguaucauguuugacgcagccguaaguggaggacuaaacacaucuguauuaagagcaguauuaccacgugauauggucuucaggacaucuacacccagaguaguauuauga

SEQ ID NO: 2858 - RNA, 1710 nt, Artificial Sequence
  derived and/or modified CDS sequence (opt6) from Lassa virus__AIT17211__NP
augagcgcaucaaaagaaauaaaaucauuccuuuggacacaaucuuuaagacgagaacugucgggauacugcucaaacauaaaacuacaaguaguaaaagaugcacaagcacuauuacacggauuagauuuuucagaaguaucaaauguacaaagacuaaugagaaaagaaagaagagacgacaacgacuuaaaaagauuaagagaccuaaaccaagcaguaaauaauuuaguagaacuaaaaucaacacaacaaaaaucaauauuaagaguaggaacucucacaagcgacgacuuacuaauacuugcagccgaucuagaaaaacucaaaucaaaaguaaccagaacagaaagaccacuaagugcugguguuuauauggguaacuuaagcucucaacaacuagaucaaagacgagcauuacugaacaugauaggaaugucuggggguaaccaaggagcacaagcagguagagacgggguagucaggguaugggaugucaaaaaugcugaauuacuaaacaaucaauuuggaacaaugcccucauuaacauuagcaugucuuaccaaacaaggacaaguagacuuaaacgaugcaguacaagcacuaacagaccuaggauuaaucuauacagcgaaauauccaaauaccagugaucuagacagacucacacaaucucauccaauccuaaacaugauagauacaaagaaaucuagucuuaacaucagcggauauaauuucucauuaggugcagcaguaaaagccggagcuuguauguuagacggagguaauauguuagaaacaauaaaagucucaccacaaacaauggauggaauauuaaaaucuauacuuaaagucaagaaagcccuaggaauguucauaucagauacccccggcgaacgcaaucccuaugaaaauauccuauacaaaaucuguuuaucaggagacggauggccuuauauagcaucaagaacuucaauaacaggucgcgcaugggaaaauacaguaguagaucuagaaucagauggcaaaccccaaaaagcaaauucaaacucaagcaacaaaagucuacagagugcaggcuuuacagcaggacuaaccuauagccaacuaaugacauuaaaagaugcaauguuacaacuagauccaaacgcaaaaacauggauggacauagaaggaaggccagaagacccaguagaaauagcacuauaucaaccaaguagcggauguuacauccacuuuuucagagaaccaacagaucucaaacaauuuaaacaagacgcaaaauauagccacggaauagacguaacagaccuauuugcagcacaaccuggacucaccucagcuguaauagacgcauuaccuagaaacaugguaauaacaugucaagguagugaugacauaagaaaacuacuagaaagucaaggaagaaaagacauaaaauuaaucgauaucgcauuaucaaaaacggauucucgaaaauacgaaaacgcaguaugggaccaauacaaagacuuaugccauaugcacacaggaauaguugucgagaaaaagaaaagagguggaaaagaagaaauaacaccacacugcgcacuaauggauugcauaauguuugacgcagcaguuucaggcggacuaaacacaagcguauuaagagcuguacuaccaagagacaugguauucagaacaucuacaccaagagugguucuauaa

SEQ ID NO: 2859 - RNA, 1710 nt, Artificial Sequence
  derived and/or modified CDS sequence (opt6) from Lassa virus__AIT17213__NP
augagugcuucaaaagaaauaaaaaguuuccuauggacacaaagccuaagaagagaauuagcagguuacuguucaaauauaaaacuccaaguaguaaaagaugcacaagcauuauugcacggauuagauuucagcgaaguaucaaacguacaaagacuuaugagaaaagaaagacgugacgacaaugaucuaaaaagauuaagagaccuaaaucaagcaguaaauaauuuaguagaacuaaaaucaacacaacaaaaaucaguacucagggucggaacauuaacauccgacgaccuauuaauauuggcagcagauuuggaaaaacucaaauccaaagugauaagaacagaaagaccauuauccgcaggagucuauauggguaaccuaagcagucaacaacuagaucaaagacgagcacuguuaaauaugauaggaaugucagggaguaaccaaggaguaagagcaggaagagauggaguaguaagagugugggauguuaaaaacgcagaacuacuaaauaaccaauucgguacaaugccaaguuuaacacuagccugccuaacaaaacaaggacaaguagacuuaaaugaugcagugcaagcccuaacagacuuaggauuaauauauacagcuaaauauccgaauacaagcgaccuugauagauuaacacaaucacauccaauauuaaauaugauagacaccaagaaaagcagccuaaauauaagugguuacaauuucagcuuaggagcugcaguaaaagcaggcgcaugcauguuagauggaggaaacaugcuagaaacaauuaaaguuaguccucaaacaauggacgguauauuaaaaagcauauuaaaaguaaagaaagcauuagguauguucauaagcgauacaccaggagaaagaaacccuuaugaaaacauacuauauaaaauaugucuaucaggugauggauggccuuauauagcaagcagaacaaguauuacaggcagagcaugggaaaauacaguaguagauuuagaaucagauggaaaaccacaaaaagcaggaucaaacgguucaaauaaaagccuacaaucagcuggauuuacagcuggccuuacauauucacaauuaaugacacuaaaagacgccauguuacaacuagaucccaacgcaaaaaccuggauggauauagaaggaaggccagaagauccaguagaaauagcacuauaucaaccuucuagugguuguuauauacacuuuuucagagaaccuacagacuugaagcaauuuaagcaagaugccaaauauucucauggaauagauguaacugauuuauuugcugcacaacccggacuuaccagcgcaguaauugaugcauuaccacgaaauaugguuauaacaugucaaggaagugaugauauaagaaaauuacuagaaagucaaggaagaaaagacauaaaauuaauagauauagcauuaagcaaaacagacuccagaaaauacgaaaacgcagucugggaucaauacaaagauuuaugucauaugcauacagguauagucguagaaaagaagaaaagaggaggaaaagaagaaauuaccccacacugcgcacuaauggauugcaucauguucgaugcagcaguaaguggaggacuaaauacuucaguuuuaagagcaguauugccaagagauaugguauuuagaacaaguacaccaagaguuguacuuuaa

SEQ ID NO: 2860 - RNA, 1710 nt, Artificial Sequence
  derived and/or modified CDS sequence (opt6) from Lassa virus__AIT17217__NP
augagugcaucaaaagaaauaaaaaguuuuuuauggacacaaucacuaagaagagaacuaucaggauauugcucaaauauaaaacuccaaguuguaaaagacgcacaagcccuacuacacggauuagauuuuucagaaguuucaaauguacaaagauuaaugagaaaagaacgacgagacgacaaugauuuaaaaagacuaagagaccuuaaccaggcaguaaacaaucuuguagaacuaaaaagcacacaacaaaaaucaauacuaagaguaggcacacuaaccucagaugacuuacuuauauuagcagcagaucuagaaaaauuaaaaaguaaaguuacacgaacagaaagaccacuuucagcaggaguauauaugggaaaucuaaguucacaacaauuagaucaacgaagagcucuacucagcaugauaggaaugucaucgggaguacaaggugccagagcuggaagggacggaguaguaagaguaugggauguaaaaaaugcagaauuauuaaauaaucaguucgguacaaugcccucacuaacauuagcuugcuuaacaaaacaaggacaaguggacuuaaaugauguaguacaagcacuaacugaccuaggauuaauauacacagcuaaauauccaaauaccagcgacuuagauagacuaacgcaaagccacccaauuuuaaacaugauagacacaaaaaaaucaucauuaaauauaaguggcuacaauuucucgcucggugccgcaguaaaagcaggugcauguauguuagacgguggaaauaugcuagaaacaauaaagguaucaccccagacaauggacggaauucucaaaucaauacuaaaaguaaaaaaggcauuaggaauguuuauaagcgaaacaccaggagaaagaaacccauaugaaaauauauuauacaaaaucugucuaagcggagacggauggcccuacauagcaucaagaaccucaauaaccggaagagcaugggaaaauacaguaguagaucuagaaagcgacggaaaaccacaaaaagcaggaucaaacaauucuaauaaaagcuuacaaucuacugguuuugcagcaggacuaacauauagucaacuaaugacauuaaaagaugcaaugcuacaacuagacccaaaugccaagacguggauggauauagaaggaagaccagaagacccagucgaagucgcauuauaccaaccaucaucaggaugcuacauacauuucuucagagaaccuacagacuuaaaacaauuuaaacaagacgcaaaauauucacacgguauagauguuacagauuuauuugcagcacaaccagggcuaacaucagcaguaauagaugcgcuuccaagaaacaugguaauaacaugccaaggaucagacgacauaaaaaaacuucuugaaucacaaggaagaaaagacauaaaauugauagauaucgcacuaucaaaaacagauucacggaaauaugaaaacgcaguaugggaucaguauaaagauuuaugccauaugcacacaggaguagugguagaaaaaaaaaaaagaggagggaaagaagaaauuaccccacacugugcacuaauggacuguauaauguucgacgccgcaguaaguggugguuuaaacacaucagugcuaagagcaguacuuccacgagauaugguauucagaacaaguacaccacgaguuguacuauaa

SEQ ID NO: 2861 - RNA, 1710 nt, Artificial Sequence
  derived and/or modified CDS sequence (opt6) from Lassa virus__AIT17225__NP
auguccgcuucaaaagaaauaaaaagcuuuuuauggacacaaaguuugcgaagagaacugaguggauauuguucaaacauaaaacuacaaguaguaaaagacgcacaagcucuacuccacggacuagauuuuucagaaguaucaaauguacaacgccuaaugagaaaacaaagaagggaugacaaugacuuaaaaagacuacgagaccuaaaucaagcaguaaauaacuuaguagaauuaaaaucaacacaacaaaaaucagucuuaaggguaggaacacuaacaucagaugaucuauuaguucuagcagcagaccucgaaaaacuaaaaucuaaagucacacgaacugagagaccacuaucagcaggcguauauaugggaaauuuaucuucacaacaacuagaucaaagaagagcacuauuaaacaugauaggaaugaguggaggaaaucaaggagcuagagcuggaaaugacggcgucgucagaguaugggauguaaaaaacgcagaccuauuaaauaaccaauucggaaccaugccaagucuaacucucgccugucuaacaaaacaaggacaaguagacuuaaacgacguaguacaagcucuaacagaccuuggauuaauuuauacagcaaaauacccaaauacaucagaccuugacagauuaacucaaucacaucccauauuaaacaugauagauacaaaaaaauccucuuuaaauauaaguggauacaauuucucauuaggcgcagcuguaaaagcaggagcaugcaugcuugauggaggcaauauguuagaaacaauaaaaguaaguccacaaacaauggacggaauauuaaaaucaauccuaaaaguuaaaaaagcacucggaauguuuauaagcgauacccccggagaacgaaauccauaugaaaauauauuauauaaaauauguuuaaguggagacggauggccauacauagcaagcagaacaaguauaacugggcgagcaugggaaaauacaguuguagaucuggaauccgacggaaaaccgcaaaaaacgggaaacaauucuucaaauaaaagucuacaaucagcaggauuuacugcaggacuuaccuauucacaauuaaugacacuaaaagacgcuaugcuacaauuagacccgaacgcaaaaacauggauggacaucgaaggaagaccagaagauccaguagaaguagcauuguaucaaccaucaucaggauguuacauacauuuuuuuagggaacccacggaccuaaaacaauuuaaacaagaugcaaaauacucacauggaauagacguaacagauuuauucgcagcacaaccaggauuaacaucugcaguaauagaagcacuaccuagaaacaugguaauaacaugccaaggaagcgacgacauaagaaaauuauuagaaucucaaggucguaaagacauaaaacuaauagauauagcacuuucaaaaaucgacucaagaaaauacgaaaaugccguaugggaccaauacaaagaccuaugccauaugcacacaggaguaguagucgaaaaaaaaaaaagaggaggaaaagaagaaauaacaccacauugcgcccuaauggauugcauaauguuugacgcugcaguaagcggagguuuaaauacauuaguccuacgugcaguacuaccacgggauaugguuuuccgcaccuccacaccaaaaguaguacucuaa

SEQ ID NO: 2862 - RNA, 1710 nt, Artificial Sequence
  derived and/or modified CDS sequence (opt6) from Lassa virus__AIT17229__NP
augucagcaagcaaagaaauaaaaucauucuuauggacucaauccuuaagaagagaauuaucaggcuacugcucaaacauaaaacuucaaguuguaaaagaugcacaagcacuacuacacgguuuagauuuuucugaaguaagcaauguacaaagauuaaugagaaaagaacggagagaugacaaugaucucaaaagacuaagagacuuaaaucaagccguaaacaaccuagucgaauuaaaaagcacccaacagaaaaguguuuuaagaguaggaacauuaacaagcgaugaccuauuaauucuagcugcagauuuagaaaaacuaaaaucaaaaguuauaagaacagaaagaccacucucagcaggaguauauaugggaaauuuaagcagucaacaauuagaccaaagacgagcacuauuaaguaugauaggaaugaguggugguaaucaaggaacaagagcaggcagagacggagucguaagaguaugggauguuaaaaacgcagaauuacuaaauaaccaauucggaacaaugcccagcuugacauuagccugccuaacaaaacaaggacaagucgacuuaaacgaugcaguacaagcacuaacagaucugggucuuauuuauacagcaaaauauccaaauacguccgacuuagauagauuaacacaaucgcauccaauacuaaacaugauagacacuaaaaagucuucacuaaacauaaguggauacaauuuuucacucggggcugcaguaaaagcaggagcauguauguuagauggaggcaauauguuagaaacaauaaaaguaaguccacaaacaauggauggaauccuaaaaucaauauuaaaaguaaagaaagcauuaggaauguuuauaucagacacaccaggagaaagaaacccauacgaaaauauccuuuacaaaauaugucuaucaggagaugguuggccuuauauugcaucaagaacaagcaucacaggacgagcaugggaaaacacagucgucgaccuagagagugacgguaaaccucaaaaagcgggcucaaacaauucaaacaaaucauuacaaagugcaggauuuacagcaggauuaacauauucucaacuaaugacauuaaaagaugcaauguuacaacuagacccaaacgcaaaaacauggauggauauugaaggcagaccagaagacccaguugaaauagcauuauaccagccuucaucaggauguuacauacacuuuuucagagaaccaacagauuuaaaacaauuuaaacaagaugcgaaauacucacaugggauagacgucaccgaucuauucgcagcacaaccuggauuaacaucagcaguaauagaugcauuaccaagaaacaugguaauuaccugccaaggaagugacgauauaagaaaauugcuagaaucacaaggacgaaaagauauaaaauuaauagauauagcacucucaaaagcagacucuagaaaauacgaaaaugcaguaugggaucaauauaaagauuugugccauaugcauacaggaguaguuguagagaaaaagaaaagaggugguaaagaagaaauaacaccacacugugcacuuauggauuguaucauguuugacgcagcaguaagugguggacuaaacacaaguguauuacgagcaguacucccaagagauauggucuucagaacuagcacuccaagaguuguauuauag

SEQ ID NO: 2863 - RNA, 1710 nt, Artificial Sequence
  derived and/or modified CDS sequence (opt6) from Lassa virus__AIT17233__NP
auguccgcuucaaaagaaguaaaaucauuucuuuggacacaaucccuaagaagagaacuaucaggauauugcucaaauauaaaauugcaaguaguaaaagacgcgcaagcacuacuucacggauuagauuucucagaaguaagcaauguacaaagacuaaugagaaaagaaagaagagaugauaaugauuuaaaaagauuaagagauuuaaaucaagcagugaauaaucuaguagaacuaaaaaguacacaacaaaaaaguauauuaagaguagguacauuaacaagcgaugaccuccuaguacuggcagccgaccuagaaaaacuaaaaucaaaagugacaaggaccgaaagaccauuaagcgcgggaguauacaugggaaaccucuccucacaacaauuagaucaaagaagagcauuauuaucaaugauaggaauguccggaggaaaucaaggcgcacaagcaggccgagacggaguaguccgaguaugggauguaaagaacgcagaauugcuuaauaaccaauucgguacaaugccaucucuaacauuggcaugcuuaacaaaacaaggacaagucgaccuaaacgaugcaguacaagcacuaacagaucuuggacuaauauauacagcuaaauacccaaauaccagugauuuagacagacuaacacaaucacaccccauacuaaauaugauagauaccaaaaaaucaucgcuaaacaucagcgguuauaacuucucguuaggugcagcaguaaaagcuggugcaugcaugcuagaugggggaaauauguuagaaaccauaaaaguaucaccacaaacuauggacggcauauuaaaaucaauauuaaaaguaaaaaaagcacuaggaauguucauaagugacacaccaggagaaagaaaucccuaugaaaauauauuauauaaaauauguuuaucaggagacggauggccauauauagcuucaagaacaagcauaacaggaagagcaugggaaaauaccguaguagaccuagaaagugauggaaaaccacaaaaagcaggaucaaauaauagcaauaaaucacuacaaagcgcaggauucaccgcgggacuaacuuauagccaacuaaugacauugaaagacgcaauguuacaacuagacccaaaugcaaaaacauggauggacauagaaggaagaccagaagacccaguagaaguugcauuauaucaaccauccucuggauguuacauacauuucuucagagaaccaacagauuugaaacaauuuaaacaagaugcuaaauacagucaugguauagacguuacagaucuauuugcagcacaaccaggccugacaagugcaguaauagaugcacuaccaagaaauaugguaauuacaugucaagguagugacgauauaagaaaauuauuagaaagucaaggcagaaaagacauaaaauugauagauauugcacuaucgaaaacagacaguagaaaauacgaaaacgcaguaugggaucaguacaaagacuuaugccacaugcacacaggaguaguaguagaaaaaaaaaaaagaggagguaaagaagaaauuacaccacacugugccuuaauggauugcauaauguucgaugcugcuguaaguggaggauuaaacacaucaguacuaagggcuguauuaccucgagacaugguuuuuaggacaaguacuccccgaguaguauuauaa

SEQ ID NO: 2864 - RNA, 1710 nt, Artificial Sequence
  derived and/or modified CDS sequence (opt6) from Lassa virus__AIT17237__NP
augagcgcaagcaaagaaauaaaaucauucuuauggacacaaucacuucgaagagaauuaaguggauauugcucuaacauaaaauugcaaguaguaaaagaugcacaagcucuauugcacggacuugacuucucagaaguuucaaauguucaacgauuaaugcgaaaagagagaagagaugauaaugaucuuaaaagacuacgagaucuaaaucaagcaguaaauaaccuuguagaauuaaaaaguacacaacaaaaaucuauauuacguguaggaacauuaacaagugaugacuuacuuauacuggcagcagauuuagaaaaauuaaaaucaaaaguaacucgaacggaaagaccucuaucagcaggcguauauaugggaaacuuaaguagucaacaauuagaccaaagacgggcauuauugaguaugauaggaaugucaggaggaaaccaaggagcuagagcuggaagagacggaguaguuagaguaugggauguaaaaaaugcagaacuccuaaauaaucaauuuggcacgaugcccucauuaacacuagccuguuuaaccaaacaaggacaaguagaucuaaaugaugcaguucaagccuuaacagaccuaggauuaauauauacagcaaaauauccaaauacaucagacuuagacaggcuuacacaaucacacccaauacuaaacaugaucgauacaaaaaaaucaucacuaaauauuuccggauauaauuuuucauuaggagcagcagucaaagcaggagcuuguauguuagacgguggaaauauguuagaaacaauaaaaguaaguccacaaacuauggacggaauauuaaaaucaauauuaaaagucaaaaaagcgcuaggaauguuuauuagugacacgccaggagaaagaaauccguaugaaaauauauuguauaaaauauguuuaucaggagacgguuggccauacauagcaagucguacuucuauaacaggaagagcaugggagaauacuguaguagacuuagaaagcgauggaaaaccacaaaaagcaggaucaaauaauucaaauaaaucacuacaaagugcaggauuuacugcaggauugacauauucccaacuaaugacuuuaaaagacgcaauguuacaacuagauccaaaugcaaaaacuuggauggacauagaaggaagaccagaagaccccguagaaguagccuuauaucaaccaucaucaggauguuacauacacuuuuuuagagaaccuacagaucuaaaacaauuuaaacaagaugcgaaauauucacauggaauugacguaacagaccuauucgccgcacaaccuggauuaacauccgcgguaauagaugcacuaccacgaaacaugguaauaacuugucaagggagcgaugauauaagaaaauuauuagaaagucaaggacgaaaagacauaaaauuaauagacauugcuuuaucaaaaacugacucuagaaaauaugaaaacgcagugugggaucaauacaaagauuuaugucauaugcacacagguguaguaguagaaaaaaaaaaaagaggaggcaaagaagaaauaacaccgcauugcgcauuaauggacuguaucauguuugacgcugcagucucagguggacucaacacauccguacuaagagcaguuuuacccagagacauggucuuuagaacaaguacaccaagaguaguauuauaa

SEQ ID NO: 2865 - RNA, 1710 nt, Artificial Sequence
  derived and/or modified CDS sequence (opt6) from Lassa virus__AIT17241__NP
augucagcaucaaaagaaauaaaaaguuuuuuauggacgcaaucacuaagaagagaauuaagcgguuauuguaguaacauuaaacuacaaguaguaaaagacgcacaagcacuacuucacggauuagauuuuuccgaaguuaguaauguacaaagauuaaugagaaaggaaagacgcgaugacaacgauuuaaaaagauuacgcgauuuaaaccaagcuguaaauaaucuaguagaauuaaaaagcacacaacaaaaguccauuuuaagaguagguacauuaacaagcgaugaccucuuaauacuugcagcagauuuagaaaaauuaaaaaguaaaguuacacguacagaaagacccuuaucagcaggaguuuauauggguaacuuaagcagccaacaacuugaucaaagaagagcacuacugucaaugauuggaaugagcggcggaaaccaaggagcgcgggcaggaagagacggaguaguaagaguaugggauguuaaaaacgcagaacuucuuaauaaccaauuuggaacuaugccaucacuuacuuuagcaugcuuaaccaaacaaggacaaguagaccuaaaugaugccguucaagcauuaacagacuuaggauuaauauauacggcaaaauauccaaacacaucagauuuagauagauuaacacaaagccauccaauacuuaauaugauagauacuaaaaaaucaucccuaaauauuucaggauauaacuuuucacugggugcagcaguaaaagcaggagcguguaugcuagacggaggaaauauguuagaaacaauaaaaguaucuccacaaacaauggacggaaucuuaaaaaguauacuaaaaguaaaaaaagcauuaggaauguucauaucagauacaccaggagaacgaaauccauacgaaaauauccuauacaaaauuugcuuaucaggcgauggguggccauacauagcaagcagaacaucaauaaccgguagagcaugggaaaauacgguaguagaccuagaaucagaugguaaaccacaaaaagcagggucaaauaauaguaauaaaucacuacaaagcgcgggauucacugcaggacuaacauauagucaacuaaugacauuaaaagacgcaauguuacaauuagaucccaacgcaaaaacuuggauggauauagaaggacgaccagaagauccaguagaaauagcacucuaccaaccgaguucaggauguuacauacacuucuuucgagaacccacagauuuaaaacaauuuaaacaagaugcaaaauauucacauggaauagauguaacagacuuauucgcagcacaacccggauuaacaucagcaguaauagaugcacucccucgcaacaugguaauuacaugucaagguucagacgacaucagaaaauuauuugaaucucaagggagaaaagauauaaaacuaauagauauagcauuaucuaaaacagacucaagaaaauacgaaaacgcaguaugggaccaauacaaagacuuaugccauaugcauaccggaguaguaguagaaaaaaaaaaaaggggcggaaaagaagaaauaacaccacacugugcacuaauggacugcauaauguuugaugcagcagugucaggagguuuaaauacuagcguacuaagagcaguauuacccagagacaugguauuuagaacaucaacuccaagaguaguuuuauaa

SEQ ID NO: 2866 - RNA, 1710 nt, Artificial Sequence
  derived and/or modified CDS sequence (opt6) from Lassa virus__AIT17245__NP
augucugcaucaaaagaaauuaaaaguuucuuguggacgcaaucacuacgaagagaacuaucaggauauugcucuaauauaaaacuacaaguagucaaagaugcccaagcccuucuacacggauuagauuuuuccgaaguaucaaauguucaaagauuaaugagaaaagaaagacgagacgauaacgacuuaaaaagauuaagagaucuaaaucaagcaguaaauaaccuuguagaacucaaaucuacacaacagaaaaguauauuaagaguaggaacacuaacaagugaugacuugcuaauauuagcugcagaucuagagaaacuaaaaagcaaaguaacacgaacagaaagacccuuaucagcggguguauauaugggaaacuuaaguucacaacaacuugaucaaagacgagcacuacuaaauaugauagguaugucaggcuccaaccaaggcgcaagaacaggaagagacggaguaguccgaguaugggacguuaaaaacgcugaacuacuuaauaaccaauucggaacaaugccaucacuaacguuggcaugcuuaacaaaacaaggacaaguagaucucaacgaugcaguacaagcauuaacagauuuaggcuuaauauauacagcaaaauacccaaacacaagugacuuagacagacuaacacaaucacacccaauacuaaauaugauugauaccaagaaaucaaguuugaacauaucuggauacaauuuuagcuuaggagcagccguaaaagcaggagcauguauguuagauggaggaaacauguuagaaacuaucaaaguauccccucaaacaauggaugguauccuaaaaucaauuuuaaaaguaaagaaagcacuugguauguuuauaucagauacgccgggagaaagaaacccauaugaaaauauacuauauaaaauaugucuaucaggugauggauggccauacauagcaucaagaacaucuauaacuggccgagcaugggaaaauaccguaguagauuuagaaucagaugggaaaccccaaaaagccggaucuaauaauucaaacaaaucuuuacaaagugcaggauuaaccgcaggccucacuuauucccaauuaaugacguuaaaagacgcaaugcuacaacuagauccaaacgcaaaaacauggauggacauagaaggacgaccugaagacccaguagaaauagcccuguaucaaccaagcucuggauguuacauacacuucuuuagagaaccuacagaucucaaacaauuuaaacaagaugcaaaauauagucacgguauagacguagccgaucuauuugcagcacaaccuggacuaacaucagcaguaauagaugcauuaccucgaaacuuaguaauaacaugccaaggcagcgaugacauaagaaaauuacuagaaucacaaggaagaaaagacauuaaacuaauagauauagcacucucaaaaacagacucuagaaaauacgaaaaugcagucugggaccaauauaaagaccuaugucacaugcauacaggaaucguaguagaaaagaagaaaagaggcgguaaagaagaaaucacaccacacugugcauuaauggauuguaucauguuugaugcugcuguaucaggaggucuaaacgcuucaguacugagagcaguacuaccuagagauaugguauuuagaacuucaacgccaagaguaguacuuuaa

SEQ ID NO: 2867 - RNA, 1710 nt, Artificial Sequence
  derived and/or modified CDS sequence (opt6) from Lassa virus__AIT17247__NP
augagcgcuucaaaagaaauaaaaaguuucuuauggacccaaucacuaagaagagaacuaucaggauauugcuccaacauaaaacuacaaguaguaaaagacgcacaagcacuauuacauggacuagacuuuagcgaaguuaguaauguacaaagauuaaugagaaaacaacgaagagacgauucagaucucaaaagauuacgagauuuaaaucaagcaguaaauaacuuaguagaauuaaagagcacacaacaaaaaaguguuuuaagaguaggaacucuaacaagcgacgaccuucucauacuagcugcagaucuggagaaacuaaaaucaaaaguaauaagaacagaaagaccauuaucaucaggggucuauauggguaaucuaagcucucagcaauuagaccaaagaagagccuuacuuaacaugauaggaaugaguggaggaaaccaaggagcucaaguaggaagagauggcguagucagaguaugggauguuaaaaaugccgaucuucuaaacaaucaauuuggaacaaugccaucguuaacucuagcaugccuuacaaaacaaggucaaguagaccuaaaugauguaguacaagcgcucacagacuuaggcuuaauauauacagcgaaauauccaaauacguccgaccuagaccgacucgcacagucacacccaauauuaaacaugauagauacaaaaaaauccagucucaacauaagcggauauaauuucucacuaggugccgcagucaaagcaggggcgugcauguuagacggaggcaacauguuagaaacaauuaaaguaucaccacaaacaauggauggaauuuuaaaaucaauacuaaaaguuaaaaaagcauuagguauguucauuucagaaacaccgggagaaagaaauccauaugaaaauauacuauacaaaauaugucuuucaggcgacggauggccauauauugcaucaagaacaucaauuacuggaagagcaugggaaaauacaauaguugauuuagaaucagauggcaagccucaaaaagcaggcucaaacaacaguaauaaaagcuuacaaagcgcaggauuuacagcagguuugacauauucacaauuaaugacacucaaagauucaauguuacaauuagauccaaaugcaaaaacauggauggauauagaaggccgaccagaagacccaguagaaguagcucucuaucaaccaagcucaggauguuacauacauuucuucagagaaccuacagacuuaaaacaauuuaaacaagacgccaaauauagccacggaauagacguuaccgauuuauuugccgcacaacccgguuuaacaagugccguaauagaagcauuaccaagaaacauggucauuaccugccaaggaagcgaugauauacgaaaacuacuugaaucacaagggaggaaagauauaaaacuaauagacauagcacuaaacaaaacagacucuagaaaauacgaaaaugcuguuugggaccaauacaaagaccuuugccacaugcauacaggagucguaguagaaaaaaaaaaaagagggggcaaagaagaaaucacaccacauugcgcauuaauggauugcauaauguuugacgcagcaguuucagguggauuaaaaacucucguacuaagagccguacucccacgagauaugguauucagaacaucaacaccaaaagugguauuauaa

SEQ ID NO: 2868 - RNA, 1710 nt, Artificial Sequence
  derived and/or modified CDS sequence (opt6) from Lassa virus__AIT17251__NP
auguccgcaaguaaagaaauuaaaucauuccucuggacucaaucacuucgacgagaacuaucaggauacugcucaaacauuaaguuacaaguaguaaaagacgcucaagcacuauuacacggauuagauuucuccgaaguaucaaacguacaaagacuuaugagaaaacaacgacgugacgauucugaucuaaaacgauuaagagaccuaaaccaagcaguaaauaacuuaguugaacuaaaaucaacacaacaaaaaucaguccuaagaguuggaacacuaacauccgacgaucuacucauauuggcagcagauuuagaaaaauuaaaaucaaaaguaauuagaacagagcgaccauuaaguucaggaguauauauggguaaccucagcucacaacaacuugaucaaaggagagcacucuuaaacaugauaggaauguccggaggaaaccaaggagcacaaguaggaagggacggaguaguacgaguaugggauguaaaaaaugcagaccuacuaaauaaccaauucggaacaaugccuucauuaacacuagcaugcuuaaccaaacaaggacaagucgauuuaaaugacguaguacaagcuuuaacagacuuaggccuaauauauaccgccaaauauccaaauacaucagacuuagaucgauuagcacaaagucauccaauauuaaauaugauagauacaaaaaaaagcagucuuaauauaucaggauauaauuucagucuaggagcagcaguaaaagcaggagcauguauguuagacggcgguaacauguuagaaaccauaaaaguaucgccacaaacaauggauggaauccuaaaaagcauacuaaaagucaaaaaagcacuaggaauguuuauaagugaaacccccggagaaagaaaccccuacgaaaauauacuuuacaaaauauguuuaaguggugaugguuggcccuacauagcaagcaggacaaguauuacaggaagagcaugggaaaacacaauaguagauuuagaaucugauggcaaaccacaaaaaacaggaaguaacaauucaaacaaaucacuacaaagugcuggauucacagcaggucuaaccuauagucaacuaaugacauuaaaagauagcauguuacaauuagauccaaaugcaaaaacuuggauggauauagaaggaagaccagaagacccaguagaaguagcucuauaucaaccaaguuccggcuguuacauacauuuuuuuagagagccaaccgauuugaaacaauuuaaacaagacgcaaaauacagccauggaauugauguuaccgauuuauuugcagcccaacccggcuuaacauccgcaguuaucgaagcccuaccaagaaacaugguaauaacaugccaaggcagcgacgacauccgaaaauuauuggaaagucaaggcagaaaagacauaaaacugauugauauagcccuaaauaaaacagacucaagaaaauacgaaaacgcaguaugggaccaauauaaagaucuaugccauaugcauacaggaguagucguagaaaaaaaaaaacgaggcggaaaagaagaaauuacaccacacugugcacuaauggauuguauaauguucgaugcugcaguaucaggaggacuaaaaacauuaguauuacgugcaguuuuaccgagagauaugguauuuaggacaucaacaccaaaaguaguauuauaa

SEQ ID NO: 2869 - RNA, 1710 nt, Artificial Sequence
  derived and/or modified CDS sequence (opt6) from Lassa virus__AIT17255__NP
augucagcuuccaaagaaauaaaaucauuccuauggacacaaagucugagacgugaacucaguggauacugcaguaacauaaaacuacaaguaguaaaagaugcacaagcauuacuacacggacuagauuucagcgaagucucaaauguacaaagacuaaugagaaaagaaagacgugacgacaaugauuuaaaaagacuucgagaucuaaaucaagcagugaauaaucuggucgaacuaaaaucaacacaacaaaagagugucuuaagaguagguacacuaaccagcgacgaccuauuaguucuagcagcagaucuagaaaaacuaaaaucaaaaguaacuaggacagagagaccauuaucugcaggaguauauaugggaaaucuauccucacaacaacuagaucaaaggagagcuuuauuaaguaugauaggaaugucaggaggaaaccaaagagcucaagcuggaagagacggaguaguaagagugugggauguuaaaaacgccgaauuauuaaacaaccaauuuggaaccaugccuuccuuaacauuagcaugccuuaccaaacaaggccaaguagacuuaaaugaugcaguacaagcauuaacggauuuaggauuaauauacacaguaaaauauccaaaugcuucagaccuagaucgacuuacacaaucacacccaauuuuaaauaugauagacacaaagaaaagcagcuuaaauauaucaggauauaacuuuucccuaggagcagcaguaaaagcaggagcauguaugcuagacggaggcaauauguuagaaacaauaaaaguaucaccacaaacaauggacggaaucuuaaaauccauauuaaaaguuaagaaaacccuaggaauguuuauaagugauacaccuggagaaagaaauccauaugaaaacauauuauacaaaauaugcuuaucaggagauggauggccauauaucgcaucacgaacaucaaucacaggcagagcuugggaaaauacgguaguagaucuagaaaguaacggaaaaccacaaaaagcagacaguaacucaagcaauaaaucauuacaaucagcuggauucacagcaggacuuacauacagucaauuaaugacauuaaaagaugcaauguuacaauuagauccaaaugcaaaaacauggauggacauagaaggaagacccgaagaucccguagaaauagcuuucuaucaacccaguuccgguugcuacauacacuuuuucagagaaccaacagaccucaaacaauuuaaacaagacgcaaaauacagccauggaauagacguaacagaccuauuugcagcccaaccaggauuaacaagugcaguaauugacgcuuuaccacgaaacauggucaucacaugccaagguucagacgacauuagaaaacuuuuagaaucucaaggaagaaaagauauaaaauuaauagauauagcauuaucaaaaacugauucaagaaaauacgaaaaugcaguaugggaucaauacaaagacuuaugucauaugcauacaggaguaguaguagaaaagaagaaaagaggaggaaaagaagaaauuacuccccauugugcauuaauggauugcauaauguuugacgcggcaguaucaggaggacucaacacacuuguacuaagagcaguacuaccaagagacaugguauucaggaccuccacaccaagaguagugcuauaa

SEQ ID NO: 2870 - RNA, 1710 nt, Artificial Sequence
  derived and/or modified CDS sequence (opt6) from Lassa virus__AIT17259__NP
augagcgcuucaaaagaaauaaaaagcuucuuauggacccaauccuuacgaagggaauuaucuuccuauuguaguaacauaaaauuacaaguaguuaaagaugcacaggcacucuuacauggucuagacuuuucagaaguuucuaauguacaaagacuuaugagaaaggaaagaagagaugauaacgaccuuaaaagacuucgagaccuaaaucaagcaguaaacaauuuggucgaacuaaagucaacucaacagaaaaguauauuaagaguaggaacauuaacaagcgaugaccuauuaauacucgcagcggaccuagaaaaauuaaaaaguaaaguaacaagaaccgaaagaccacuaagcgcagguguauauaugggcaacuuaucaagucaacaacuugaccaacguagagcauuacucaauauguuaggaaugaguggauccaaccaaggugcacgugcaggacgggauggaguaguacgaguaugggauguuaaaaaugcagaauuacuaaauaaccaauucggaacaaugccaucacuaacucuagcaugcuuaaccaaacaaggucagguagacuuaaaugaugcaguacaagcauuaacagaccuuggacuaauauauacagcuaaauauccaaauacguccgacuuagauagacuaacucagagucacccaauauuaaacaugauagauacaaaaaaaucaucauuaaauauaucaggauauaauuucucucuaggugcagcaguaaaagcaggcgcauguaugcuagacggaggaaauauguuagaaacuauaaaaguuaguccacaaacuauggauggaauacuaaaaucaauauuaaaaguuaaaaaagcacuugggauguucauaucagauacaccaggagaaagaaauccauaugaaaauauauuauacaaaauuuguuugucaggagauggcuggccauacaucgccagcagaaccucuauaacaggaagagcaugggaaaauacaguaguagaccuagaaucugauggaaaaccacaaaaagcaggaucaaauucaucaaacaaaucccuacaaucagcgggcuucacagcaggucuuacauacucccaacuaaugacucucaaagaugcuauguuacaacuugauccaaacgccaaaacauggauggacauagaaggaagaccagaagauccaguagaaauagcucuauaccaaccaucaucaggaugcuauauacauuuuuuucgugaaccaacggaucucaagcaauuuaaacaagacgcaaaauauucacacggaaucgauguaacagacuuguuugcagcacaaccaggauuaacaucagcaguaauugacgcacuaccaagaaacaugguuauaaccugccaaggcucagacgacauucguaaauuauuagaaucucaagguagaaaagacauaaaacuuauagauauagcguuauccaaaacagauucuagaaaauaugaaaacgcaguaugggaucaauacaaagacuuaugucacaugcauacaggaauaguuguagaaaaaaaaaaaaggggaggaaaagaagaaauaacaccgcauugugcucuaauggauuguauuauguuugacgcagcaguaucaggaggacuaaacgcaucaguuuugcgugcaguccuaccaagggauaugguauuccgaacuuccacaccaagaguaguacucuaa

SEQ ID NO: 2871 - RNA, 1710 nt, Artificial Sequence
  derived and/or modified CDS sequence (opt6) from Lassa virus__AIT17263__NP
augagcgcaucaaaagaaauaaaaucauuucuauggacacaaucacuaagaagagaacucaguggcuacuguucaaacauaaaauuacaaguaguaaaagacgcacaagcccuauugcacggacuagauuucuccgaaguaucuaauguccaacgauuaaugagaaaagaaagaagagaugacaacgaucuaaaaagauuaagagauuuaaaccaagcagugaauaaccuaguagaacuaaaaaguacacaacaaaaaagcguacuaagaguaggaacauuaacaagugacgaccuuuuaauacuagcggcagaucuagaaaaacuaaaaaguaaaguaauacgaacagaaagaccucuaagugcaggcguauauaugggcaaccuaagcucacaacaacuagaucaaaggagagcacugcuuaacaugauaggcaugggaggcucaaaucaaggcgcuagagcgggaagggacggagugguaagaguaugggauguaaaaaacgcagaauuacuaaauaaucaauuuggaacaaugccaagucuaacacuagcaugcuuaacaaagcaaggucaagucgacuuaaaugaugcaguacaagcuuuaacagaccuaggauuaaucuacacagcaaaauauccaaauacaucagaccuggacagacuaacucaaucccacccaauacuaaauaugauagauacaaaaaaaucaucauuaaacauaucaggauacaacuuuaguuuaggugcagcaguaaaagccggagcuuguaugcuagacggaggaaauauguuagaaacuauaaaaguaucaccgcaaacaauggacggaauauuaaaaucuauucuuaaaguaaaaaaggcucuuggaauguucauaucagauacaccaggagaaagaaauccauaugaaaacauacuauacaaaauaugucuaaguggagauggauggccauauauagcaucaagaacuagcauaaccggaagagccugggaaaauacaguaguagaucuagaaucagauggaaaaccacaaaaagccggaucaaacggaucaaacaaaagccuccaaucagcuggauucacagcaggucuaacauauucacaacugaugacacuuaaagaugcgauguuacaacuugacccaaauacuaaaacauggauggauauagaaggaagacccgaagacccagucgaaguagcccuauaucaaccuucaucaggcuguuauauacacuuuuucagagaaccaacagaucuuaaacaauucaaacaagaugcaaaauauagucauggaauagacguuacagaucuauucgcagcacaaccaggauuaacuucggcugucauagaugcucuaccacgcaacaugguaauaaccugucagggaucagaugacauaagaaaacuauuagaaucacaaggaagaaaagacauaaaauuaauagauaucgcacuaucaaaaacggauucaagaaaauacgagaacgccguaugggaccaauauaaagaccuaugccauaugcauacaggaauaguaguagaaaaaaaaaaaagaggcgguaaagaagaaauaacaccccauugugcauuaauggacuguauuauguucgacgccgcaguaagcggaggacucaacacaucaguauuacgagcuguacuaccaagagauaugguuuucagaacaaguacaccaagaguaguauuauga

SEQ ID NO: 2872 - RNA, 1710 nt, Artificial Sequence
  derived and/or modified CDS sequence (opt6) from Lassa virus__AIT17267__NP
augucagcaagcaaagaaauaaaaaguuuccuauggacacaaucauuaagaagggaacuaucagguuauugcucaaauaucaaacuucaaguuguuaaggacgcacaagcguuauuacacggacuagacuuuucagaaguaucaaauguacaaagacuaaugagaaaagaaagacgagaugauaacgaucuaaaaagguugagagauuuaaaucaagcuguaaacaaccuaguagaacuuaagaguacacaacaaaagucagucuuaagaguaggaacauuaacaucagaugacuuacucauacuagcagcagauuuagaaaaauuaaaaucaaaaguaacaaggacagaacgaccccuuucagcaggagucuauaugggaaaccuaucaagucaacaacuagaucaaagaagagccuuauuaaauaugauaggaaugucaggcggcaaucaaggagcacgagcgggacgagacggaguaguuagaguaugggauguaaaaaaugcagaacuccucaauaaccaauuuggaacuaugccaucacuaaccuuagcaugcuuaacaaaacaaggacaaguagacuuaaacgacgcaguacaagcauuaacagauuuagguuuaauauauacagcuaaauacccgaacacaucagacuuagaccgacuaacucaaucacauccaauacuaaacaugauagauacaaaaaaaucaaguuuaaauauaucaggcuacaacuuuagucuaggagccgcaguaaaagcaggagcaugcauguuagauggcggaaauauguuagaaacuauaaaaguauccccacagacaauggacucuauacucaaaaguauacugaaaguaaaaaaagcacuaggaauguucauaucagauaccccaggagaaagaaauccauacgaaaacauacucuacaaaauaugucuaucaggagacggauggccauacauagcauccagaacaagcauaacaggaagagccugggaaaacaccguaguagaccuagaaucagaugguaaaccacaaaaagcaggaaguaacaauaguaauaaaagccuacaaagcgcuggauuugcagcaggauuaacauauucacaacuaaugacuuuaaaagacgccaugcuacaacuagacccaaaugcaaaaacauggauggacaucgaaggaagacccgaagacccaguagaaauugcauuauaucaaccaucgucagguuguuauauacacuuuuucagagaaccaacagaccuaaaacaauuuaaacaagaugccaaauacagccauggcauagauguaacagaucuauuugcagcacaacccggauuaacaucagcaguaauagaugcguuacccagaaacaugguaauaacuugucaaggaagugaugacauuagaaaacuccuagaaucucaagguagaaaagacauaaaacuuauagauauagcauugucuaaaaccgacucaagaaaauacgaaaacgcaguuugggaccaauauaaagacuuaugucacaugcacaccgguguaguaguagaaaaaaaaaaaagaggagggaaagaagaaauaacaccucauugugcacuaauggauugcauaauguuugaugcagcaguuucaggcggccucaacacaucaguucuaagggcaguccugccuagagauaugguauuuagaacaacaacacccagaguaguauuauaa

SEQ ID NO: 2873 - RNA, 1710 nt, Artificial Sequence
  derived and/or modified CDS sequence (opt6) from Lassa virus__AIT17271__NP
augagugcuuccaaagaaauaaaaagcuucuuauggacacaaucauuaagaagagaacuaaguggauacugcaguaacauaaaauuacaaguugucaaagacgcgcaagcacuucuacauggacucgauuucucagaaguuucaaauguacaaagacuaaugagaaaagaacgaagagaugauaacgaccuaaaaagauuaagagacuuaaaccaagcaguaaauaaucuaguagagcuaaaaagcacacaacaaaaaucaauauuaagagugggaacacuaacuucagacgaucugcuaauacuagcagccgaucuagaaaaacuaaaaaguaaaguaacacgaacagaaagacccuuaucugcagguguauacaugggaaacuuaagcagucaacaauuagaccaaagacgagcauuauuaaacaugauaggaaugucaggaggaaaccaaggagcaagagcaggaagagacgguguaguacguguaugggauguaaaaaacgcugagcuucuaaauaaccaauucggaacaaugccaucauuaacauuagcaugucuaacaaaacaaggacaaguagaccuaaaugaugcagugcaagcacuaacagaccuuggacuaauauauacagcaaaauacccaaauacaucagauuuagauagacuaacacaaucacacccaauucuuaauaugaucgacacgaaaaaaucuagcuuaaacauuaguggauacaauuucagccuaggagccgcaguaaaagccggugcauguauguuagacgggggaaauaugcuugaaacaauaaaaguaucaccacaaaccauggacggaauacuaaaaacaaucuuaaaaguaaaaaaagcauuaggaauguucauaucagauaccccuggagaaagaaauccauacgaaaauauauuauauaagaucuguuuaucaggcgauggauggccauauauagcaucccgaacaucaauaacgggaagggcaugggaaaauacaguaguagauuuagaaucagauggcaaaccacaaaaaacaggcucuaauaacagcaauaaaucacuucaaucugcagguuuugcagcagguuuaacauauagccaauuaaugacauuaaaagacgcaaugcuacaauuagauccaaaugcaaaaacauggauggauauagaaggaaggccagaagaucccguagaaauagcgcuauaccaacccaguaguggaugcuauauacauuuuuuucgggaaccuacugaucuaaaacaauucaaacaagacgcaaaguacagucauggaauagacguuaccgaccuauuugcagcacaaccaggucuaacauccgcaguuauagaugcauuaccaagaaauaugguuauaacaugccaagguucggaugacauaagaaaauuauuagaaagucaaggccgaaaagacauaaaauuaaucgauaucgcgcuaucaaaagcugauucaagaaaauacgaaaacgcagucugggaccaauauaaagacuuaugccacaugcauacagguguaguaguugaaaaaaaaaaaaggggaggaaaagaagaaauaacaccacauugugcauuaauggauugcauuauguaugacgcagcagucagcggaggauuaaguacaagcguauuaagagcaguacuaccaagagacaugguauucagaacaucaacaccaagaguaguacuauaa

SEQ ID NO: 2874 - RNA, 1710 nt, Artificial Sequence
  derived and/or modified CDS sequence (opt6) from Lassa virus__AIT17275__NP
augagcgcaucaaaagaaauaaaaucauuccucuggacucaaucccuacgacgagaacuaucaggauauugcucaaacauaaaauuacaagucguaaaagaugcacaagcccuacuacaugguuuagauuucagugaaguaucaaauguacaaagacugaugagaaaacaaagaagagacgauggagacuuaaaaagauuaagagacuuaaaucaagcagucaauaacuuaguagaacuaaaaucuacucaacaaaaaucaguauuacgaguaggcacacuuacgagugaugacuuacuaacauuagcagccgaucuggaaaaacucaaauccaaaguaaccagaacugaaagaccccuaucagcaggaguauacaugggaaacuugucaagucaacaauuagaucaaaggagagcucuauuaaauaugauaggaaugucaggaggaaaucaaggagcaagaacagggaaagacggagucguaagaauaugggacguaaagaacgcagacuuguuaaauaaucaauucggaacaaugcccucauuaacacuagcauguuuaacaaaacaaggacaaguagaccuaaaugauguaguacaagcacuaacagacuuaggauuaauauauacagcaaaauaccccaauauaucugacuuagauagauuagcacaaucacauccaauauuaaaaaugauagauacaucgaaaucuagcuuaaacauuaguggcuacaauuucuccuuaggggccgcaguaaaagcaggagcaugcauguuagauggcggaaauauguuagaaacgguaaaaguaucaccacaaacaauggaugguauacucaaaucaauauuaaaaguaaagaaaaguuuaggaauguuuauuagcgacacaccaggagaacgcaaucccuaugaaaauaucuuauauaaaauaugccuaucaggagacggauggccauauauagcaucaagaacaucaaucacuggacgagcaugggaaaauacaguaguagacuuagaaagcgacgguaaaccucaaaaaguaggauccaauaauucaaauaaaucauuacaauccacaggauuuacggcaggauuaacauacagucaacuaaugacuuuaaaagacgcgaugcuccaacuagacccuaaugcaaaaacauggauggauauagaaggacgaccagaagauccaguagaaaucgcucuauaucaacccucaaguggcugcuauauccacuucuuucgagaaccgacagaucucaaacaauuuaaacaagaugcaaaauacagccacggaauagauguaacagaucuauuugcagcacaaccuggauuaacaagcgcgguuauagauacucuaccaagaaacaugguaauaacaugccaaggauccgaugacauaggaaaacuauuggaaucccaaggucgcaaagacauuaaauuaauagacauagcauuaucuaaaacugacaguaggaaauacgaaaaugcuguaugggaucaguacaaagacuuaugucauaugcauaccggaguagucguagagaaaaagaaacgaggaggaaaagaagaaauaacaccacauugugcauuaauggauugcauaauguuugacgcugcaguaagcggaggauuaaaugcgucaguuuuaagagcaguccuuccaagagauaugguauucaggacuucuacaccaagagucguacuauaa

SEQ ID NO: 2875 - RNA, 1710 nt, Artificial Sequence
  derived and/or modified CDS sequence (opt6) from Lassa virus__AIT17277__NP
augagcgcuaguaaagaaauaaaaucauuccuauggacacaaucauuaagaagagaauuaucaucauacugcucgaacauaaaacuacaaguagucaaagacgcacaggcacuccuacacggacuagauuucucagaaguaucaaauguccaacgauuaaugcgaaaagaaagacgagaugacaaugauuuaaaaagauuaagagauuuaaaucaagcaguuaauaacuuaguagaacuuaaaucaacucaacaaaaauccauacuaagaguaggaacacuaaccucagacgaucucuuaauacuagccgcagauuuagagaaauuaaaaucuaaaguaacaagaaccgaaagaccacuaagcgccggaguauacaugggaaaccuaucaucacaacaauuagaccaaagaagagcucuacuaucaaugaucggaaugaguggaaguaaccaaggggcuagagcuggaagagauggaguagugagaguuugggacguaaaaaacgcagaauuauuaaauaaccaauucggcacuaugccaagcuuaacauuagcaugcuuaacuaaacaaggacaaguagacuuaaacgaugcaguucaagcacuaacggauuuaggauuaauauacacugcaaaauauccaaauaccucagacuuagaucgauuaacacaaagucacccuauacuaaacaugaucgacacuaaaaaaucaucauuaaauauuucagguuacaacuucucauuaggagcagcaguaaaagcaggagcauguaugcuagacgguggaaacauguuagaaacaauaaaaguauccccacaaacaauggauggaauacuaaaauccaucuuaaaaguaaaaaaagcgcuaggaauguuuauaucagacaccccaggagaaagaaacccauacgaaaauauacuauacaaaauaugucuaucaggagauggauggcccuauaucgccaguagaacaaguauaacgggaagagcaugggaaaauacugugguagauuuagaaagcgauggaaaaccccaaaaagcaggaaguaacaauucaaauaaaucuuuacaaagugcuggauuuacagcaggucuaacauauagccaauugaugacacuaaaagacgcaauguuacaacuagauccaaaugccaaaacauggauggauaucgaaggaagaccugaagacccagucgaaguagcacuuuaccaaccaagcucaggaugcuauauacacuuuuuuagagaaccaacagauuuaaaacaauuuaaacaagacgcuaaauauagccauggaauagacguaacagauuuguucgcggcacaaccaggauuaacaagugcaguuaucgacgcuuugcccagaaauaugguuauaacaugccaaggaucagaugacauuagaaaacuccuagaaagccaaggaagaaaagacauuaaauuaaucgacauagcucuaucaaaaacagacucucgaaaauaugaaaacgcaguaugggaccaguauaaagauuuaugccauaugcauacaggaguuguagucgaaaaaaaaaaacgcggagggaaagaagaaaucacuccucauugugcacuuauggauugcaucauguuugacgcagcaguuuccggaggacuaaacacgaguguacuacgagcuguauuaccuagagauaugguuuucagaaccuccacaccacgaguaguacuauaa

SEQ ID NO: 2876 - RNA, 1710 nt, Artificial Sequence
  derived and/or modified CDS sequence (opt6) from Lassa virus__AIT17281__NP
augagugcaucaaaagaaauaaaaucauuccuauggacacaaucauuaagaagagaacuaaguggauauugcaguaauauaaaacugcaaguuguuaaagacgcccaagccuuacuucacggauuagacuuuagcgaaguauccaacguacaaagauuaaugcgaaaagaaagaagagacgauucagauuuaaaacgauuaagagaccuaaaucaagcaguaaauaacuuaguagaauuaaaaucaacacaacaaaaaucuguacuacgaguaggaacauuaacaagcgacgacuuacuaguacuagcagcagaccuugaaaaauugaaaaguaaaguaacacgaaccgaacgaccucuuagcgcaggaguuuauauggguaaucuaucaucacaacaacuagaucaaagaagggcauuacucucaaugauaggaaugagcgggggaaaccaaggcgcaagagcaggcagagacggagucguacgaaucugggauguaaaaaaugccgaacuucuaaauaaccaauucggaacaaugccuagccuaacacuagcaugccuaacaaaacaaggacaaguagaccuaaacgauguaguacaagcacucacagacuuagggcuuauauauacagccaaauauccaaacacaucagauuuagacagacucacacaaucucauccaauacuaaauaugauagauaccaaaaaaucuucauuaaauauaucaggauauaacuuuucacuaggagcagcaguaaaggccggggcaugcaugcuagacgguggaaauaugcuagaaacaauaaaaguaaguccacaaacgauggauggaauacuuaaaucaauauuaaaaguaaaaaaagcauuaggaauguucauaagcgauaccccaggagaaagaaacccauacgaaaauauauuauacaaaauauguuuaaguggcgauggcuggccuuacauagcuuccaggacaagcauuacaggaagagcaugggaaaauacaauaguugaccuagaaagugacggaaaaccacaaaaaacaucaacaacaaauaguaauaaaucacuccaaagcgcuggcuuugcagcaggcuuaacauacagccaacuaaugacccuuaaagacgcaaugcuacaauuagacccgaaugcaaaaacauggauggacauagaaggaagaccagaagauccaguagaaauagcacucuaucagccaucuucagggugcuacauacacuucuuccgugaaccaacagaucuaaaacaauuuaaacaagaugcaaaauauucacauggaauugacguaacagauuuauuugcagcacaaccaggauuaacuucagcagucauagacacucugccacgaaacaugguuaucacaugucaaggaagugaagacauuagacgcuuacuagaaucacaaggaagaaaagacaucaaacuaauagauauagcucuauccaaaacagauaguagaaaauaugaaaacgcugucugggaccaauauaaggacuuaugccauaugcacacaggaguaguagucgaaaaaaaaaaaaaaggagguaaagaagaaauaacaccacacugugcgcuaauggacugcauuauguucgacgcagcagucucuggaggacucaauaccucaguauuaagggcaguauuaccacgugauaugguuuuuagaaccucaacaccacgaguaguacuauaa

SEQ ID NO: 2877 - RNA, 1710 nt, Artificial Sequence
  derived and/or modified CDS sequence (opt6) from Lassa virus__AIT17285__NP
augucagcgucaaaagaaauaaaaagcuuccuauggacacaaucauuacgaagagaacuaucaggauauugcucaaauauuaaacugcaaguagucaaagaugcucaagcacuauuacacggacuagacuuuagugaagucuccaauguacaaagaucaaugagaaaagaaagaagggaugacaaugauuuaaaaagacuuagagaccucaaucaagcaguuaacaaucuaguagaauuaaaaucgacacaacaaaaaucaaucuuaagaguaggaacucugacaucagaugacuuacuaauacuagcugcagaucuagaaaaauuaaaaucaaaaguaaccagaacagaaagaccacuaucugccgguguauauaugggcaaccuaaguucacaacaacuagaucaaagacgagcuuuauuaaacaugauaggaaugucaggaucaaaucaaggagcaagagcaggaagagacgguguaguaaggguaugggacguuaaaaaugcagaauuacuaaauaaucaguuuggaaccaugccuucuuuaacauuagcauguuuaacaaaacaagggcaaguugaccuaaacgacguagugcaagcacuaacagacuugggauuaauauauacagcaaaauacccaaaugcaagcgacuuagauagacuuacacaaagucauccaauauuaaauaugauagauacgaaaaaaucaucacuaaacauaucaggcuauaauuuuucucuaggcgcagcagugaaagcaggagcauguaugcuugacggcggaaauaugcuugaaacaauaaaaguaucaccacaaacaauggacggaauauugaaaaguaucuuaaaaguaaaaaaagcacuaggaauguucauaucagauacaccaggagaaagaaauccauacgaaaacauauuguacaaaauuugucuuucgggagacgguuggccauauauugcaucaagaacgucaauaacaggaagagcaugggaaaacacaauuguagauuuagaaucugauggaaaaccacaaaaagcaggaaauaaugguucaaauaaaagucuacaaagcgcaggauuuacagcuggacuuacauauucgcaauuaaugacuuuaaaagaugcaauguuacaacuagauccaaacgcaaaaacauggauggauauagaagguagaccagaagaccccguagaaauagcacuguaucaaccaucaaguggauguuauauccauuucuucagagaaccaacagauuuaaagcaguucaaacaagacgcuaaauauagccacggcauagauguaacagaucuuuucgccgcucaacccggauuaacaucugccgucauagacgcucuaccaagaaauuuaguaauaacaugccaaggaucagaugacauaagaaaacuauuagaaucucaaggaagaaaggauauaaaacuuauagauauugcuuuaaguaaaacugacucacgaaaauacgaaaacgcaguaugggaccaauauaaagauuuaugucauaugcauacaggaaucguaguagaaaaaaaaaaacguggaggaaaagaagaaauuacaccacauugugcauuaauggacuguauaauguuugacgcugcaguuaguggaggauuaaauacaaguguauuaagagcaguacuaccaagagauaugguauucagaacuagcacaccacgaguaguauuguaa

SEQ ID NO: 2878 - RNA, 1710 nt, Artificial Sequence
  derived and/or modified CDS sequence (opt6) from Lassa virus__AIT17289__NP
augucagcaagcaaagaaauaaaaucauuucuauggacacaaaguuuaagaagagaacuaucaggcuacugcagcaacauaaaauuacaagucguaaaagacgcacaagcacuacuacacggacuagauuucuccgaaguuaguaacguacaaagauuaaugagaaaagaaagaagagacgauagcgaucuuaaacgacuaagagaucugaaucaagcaguaaacaauuuaguagaacucaaauccacacaacaaaaaucaguacuaagagucggaacauuaacaucagaugaucuauuaguucucgcagcagauuuagaaaaacucaaaagcaaagucaccagaaccgaaagaccacuauccgcaggaguauauaugggaaaccugucaucgcaacaacuagaucaaagaagagcacuauuaucaaugauaggaaugaguggaggaaaccaaggagucagagcagguagagacgguguuguucgaauaugggacguaaaaaaugcagaauuacuaaacaaccaauucgggacaaugccaucccuaacauuagccuguuuaacaaaacaaggacaaguagacuuaaacgacguaguacaagcacuaacggaucuugggcuaauauauacagccaaauacccaaauacaucagauuuagacagauuaacacaaucccacccaauacuaaacaugauagacacaaaaaaaucaucauuaaacaucucaggauacaauuucucgcuaggagccgcaguaaaagccggagccuguauguuagauggaggaaacauguuagaaacuaucaagguauccccccaaacaauggacggaauccucaaaucaauacuaaaaguaaaaaaagcacuaggaauguucauaagcgacacaccuggagaaagaaauccauaugaaaacauauuauauaaaauuugccuuucaggagauggcuggccauauauagcgaguagaacaucaauaacaggaagggcaugggaaaacacaauagucgaccuagagagugaugguaaaccccaaaaaacuggaaguauaaauagcaauaaaucuuuacaaagcacuggauuugcagcuggacuaacauauagccaacuaaugacauuaaaagacgcaauguuacaguuagacccaaacgcaaaaaccuggauggauaucgaaggaagaccagaagauccaguagaaauugcacuuuaucaacccagcucugguuguuacauacacuucuuuagagaaccaaccgacuuaaaacaauucaagcaagacgcuaaauacucacacggaaucgacguaacagaucuauucgcagcacaaccaggccuaacaagugcgguuauagacgcacuaccaagaaacaugguaauuacaugucaagguuccgaugacauaagaaaauuauuagagucacaaggaagaaaagacauaaaacuaauagauauagcauuaucaaaaacagacagccgaaaauacgaaaacgcaguuugggaccaauacaaagacuuaugucauaugcacacaggaauaguuguugaaaaaaaaaaaagagguggaaaagaagaaauaacaccacauugcgcuuuaauggauuguauaauguuugaugcagcaguaucaggaggauuaaacaccucaguauuaagagcaguacuaccaagagauaugguauucaggacaagcacaccaagaguuguauuauaa

SEQ ID NO: 2879 - RNA, 1710 nt, Artificial Sequence
  derived and/or modified CDS sequence (opt6) from Lassa virus__AIT17293__NP
augucagcuaguaaagaaauaaaaucauucuuauggacacaaagucugagaagagaacuuucaggauauugcagcaacauaaaauuacaaguaguaaaagacgcacaggcauuauuacauggacuagauuucagugaaguaaguaauguacaaagauuaaugagaaaacaaagaagagacgauaaugaccucaaaagauuaagagauuuaaaucaagcaguaaauaacuuaguugaacuaaaaagcacacaacaaaaaucaguuuuaagaguuggaacacuuacaagugaugaucuucucguuuuagccgcagauuuagaaaaauuaaaaaguaaaguaacacgaacagaaagaccacuaagugcaggcguauacauggguaaccuaucaacacaacagcuggaccaaagaagagcauuacuaaacaugauagguaugucaggaggaaaccaaggagcaagagcaggacgagacggaguaguaagaguaugggauguaaaaaacgcagaccuauuaaacaaucaauucggaacaaugccaagucuaacauuagcaugccucacaaaacaaggacaaguagaucuuaacgauguaguacaagccuuaacagaccuuggacuaauauacacagcuaaauauccaaauacaucagauuuagacagacuaacacaaagucacccuaucuuaaauaugauagauacaaauaaaagcuccuugaauauaaguggauacaauuucuccuuaggagcagcaguuaaagccggagccugcauguuagauggugguaauaugcuagaaacaauaaaaguuaguccacaaacaauggauggaauacuuaaaucaauauuaaaaguuaagaaagcccuaggaauguucauaagugauacgccaggggaaagaaacccauaugaaaauauauuguacaaaaucugccuaaguggagauggcuggcccuauaucgcaucaagaacaaguauaacaggaagagcaugggaaaauacuguaguagaucuagaaagugacggaaaaccccaaaaagcuggaggaaacaauaguaacaaaucucuacaaagcgcuggauucacagcuggauuaacuuauagccaacuaaugacauuaaaagaugcaauguugcaacuagauccuaaugcaaaaacguggauggacauagaaggaagacccgaagauccuguugaaauagcuuuauaccaaccaaguucaggcuguuacauacacuuuuucagagaaccaacagauuuaaaacaguuuaaacaagaugcaaaauacucacauggaauagauguaacagaccuauucgcugcucaaccaggacuaacaagugcaguaauagaugcacuuccaaggaauaugguaauaacaugucaaggaagcgaugacaucagaaaauuauuagaaagucaagggagaaaagauauaaaacuaauugauauagccuuauccaaaacagacagcagaaaauacgaaaaugcaguaugggaucaauacaaagauuuaugcaauaugcacacgggaauaguuguagaaaaaaaaaaaagggguggaaaagaagaaauaacaccucacugugcguuaauggacuguauaauguuugacgcagcaguaaguggaggaaugaacacaagcguauuaagagcaguacuaccaagagauaugguuuucagaacaaguacaccaagaguaguacuauaa

SEQ ID NO: 2880 - RNA, 1710 nt, Artificial Sequence
  derived and/or modified CDS sequence (opt6) from Lassa virus__AIT17295__NP
augagugcaucgaaagaaauuaaaagcuuccuauggacgcaaagccuaagaagagaacuaagcggguacugcaguaacauuaaacuccaaguaguaaaagacgcacaagcacucuuacacggacuugauuucuccgaaguaucaaauguacaaagacuuaugagaaaagaacgaagagaugauaaugaccuaaaaagacuuagagaucucaaccaagcaguaaacaauuuaguagaguuaaaaaguacacaacagaaaagcguacuucgagucggaacacuaacaagugaugacuuacucauacuagcagccgaccuagaaaaacuaaaaucaaaaguaauacgaacagaaagaccucuaucagcaggaguguacaugggaaaucuaagcucacaacaacuagaccaacgaagagcucuuuuaaacaugauaggaauggguggaucaaaccaaggagccagagcagguagagacggaguaguuagaguaugggauguaaaaaaugcagaauuacuaaacaaccaauuuggaacuaugccaucucucacacuugcaugucuuacaaaacaaggacaaguagauuuaaacgaugcagugcaggccuuaacugauuuagguuuaauauacacagcaaaauacccaaacacaagugauuuagaccgucuaacacaaucacauccaauacucaacaugauagauacaaaaaaaucaaguuuaaauauuucaggauacaacuucucccuaggcgccgcagucaaagcaggugcauguaugcuagauggagguaauauguuagaaaccauaaaaguaucaccccaaacaauggaugggauauuaaaaaguauauuaaaaguaaaaaaggcauuaggaauguuuaucagcgauacaccuggcgaacgaaaucccuaugaaaacauacuauacaaaauaugucuaucaggagauggauggccauauauagcuucccgaaccuccauaacaggaagagcuugggaaaauacaauaguagaucuggaauccgacgguaaaccacaaaaagcaggaucaaacggaaguaacaaaucacuacaaucagcaggcuuuacagcaggauuaaccuauucacaacuaaugaccuuaaaagaugcaaugcuccaacucgacccaaaugccaaaacauggauggauauagaaggaagaccagaagacccaguagaaauagcacuuuaccaaccaucaucaggauguuacauacacuucuucagagaaccaaccgauuuaaaacaauuuaaacaagacgcaaaauauucacacggaauugacguaacagaucuauucgcagcacaaccuggacuaaccucagcaauaauagacgcauuaccaagaaacaugguaauaaccugccaaggcucggaugauauaagaaaacuacuugaaagucaaggaagaaaagauauaaaauuaauagauauagcuuuaucgaaaacagacaguagaaaauacgaaaaugcuguuugggaucaauauaaagaucuaugccacaugcacaccggaauaguagucgaaaaaaaaaaaagaggagguaaagaagaaauaacaccacauugugcacuaauggacuguauaauguucgaugcagccguauccggaggacuaaacacauccguuuuaagagcaguauuaccaagagacaugguauuccgaacuucuacuccaagagucguauuauaa

SEQ ID NO: 2881 - RNA, 1710 nt, Artificial Sequence
  derived and/or modified CDS sequence (opt6) from Lassa virus__AIT17299__NP
augucagcuucaaaagaaauuaaaucauuuuuauggacacaaagucuaagaagagaacuaucaggcuauugcucuaacauaaaauuacaaguaguaaaagacgcccaagcauuacuacacggauuagacuuuagugaaguaagcaauguacaaagacuaaugagaaaagaaagaagagacgauaacgaccuaaaacgacuacgcgaucucaaucaagcugucaauaaucucguagagcuaaaaaguacacaacaaaaaaguguauuaagagucggaacacuaacaucugaugauuuguuaguccuagcagccgauuuggaaaaauuaaaaucuaaagugacaagaacggaaagaccucuaucagcaggaguauauauggguaacuuauccucacaacaauuagaucaaagaagagcauuacuaucaaugauuggaauguccggaggaaaccaaggagcaagaacaggacgagacggagucguuagaguaugggacguaaaaaaugcagaacuacuuaacaaccaauuuggaacaaugccgucauuaacacucgcaugccuaacaaaacaaggacaaguagauuuaaacgacgucguucaagcacuaaccgauuuaggauuaauauacaccgcaaaauacccaaacacgucggacuuggaucguuuaacccaaucacaucccaucuuaaauaugauagauacaaaaaaguccucacuaaacaucucagguuauaacuucucauuaggagcugcaguaaaggcuggagccuguauguuagacggaggcaauaugcuagaaacaauaaaaguaucgccacaaacaauggacgggauauuaaaaucuauauuaaaaguaaaaaaagcauuaggcauguuuauaagugauacaccuggagaaaggaaucccuaugaaaauauauuauauaaaauaugcuuaucuggagauggauggccauauauagcaucacgaacaucaauuacagguagagcaugggaaaacacaguaguugaucuagaaagcgauggaaaaccacaaaaagcaggaucaaauaauagcaauaaaaguuuacaaucagccggauucacagcuggauuaacauacucacaauuaaugacacuaaaagaugcuaugcuacaacuagauccaaacgcgaaaacuuggauggacauagaaggacguccagaagacccgguagaaauagcauuauaucaacccucaaguggaugcuacauacacuuuuuccgagaaccaucagaucuuaaacaauuuaaacaagacgcgaaauauagccauggcauagauguaacagacuuauuugcagcacaaccaggauuaacaagugcaguaaucgacgcauuaccaagaaacauggucauuacaugucaaggaucagaugacauacgaaaacuauuugaaucacaagggcgaaaagauauuaaauuaaucgauauagcauuaucaaaaaccgacucaagaaaauacgaaaaugcuguaugggaucaauacaaagaccuaugccacaugcacacaggagucguaguggaaaaaaaaaaaagaggagguaaagaagaaauaacaccacacugugcuuuaauggauugcauaauguuugacgcagccgucagugguggacuaaauagucuaguacuaagagcaguacuaccucgugauaugguauuucgaacaaguacaccaagaguaguacuauaa

SEQ ID NO: 2882 - RNA, 1710 nt, Artificial Sequence
  derived and/or modified CDS sequence (opt6) from Lassa virus__AIT17303__NP
auguccgcaagcaaagaaauaaaaaguuuucuuuggacacaaagccuaagaagagaacuuucaggauauugcaguaacauaaaauuacaaguaguaaaagacgcacaagcauuauuacauggacuagacuucucagaaguaaguaacguacagcgauuaaugagaaaacaacgaagggaugacagcgaucuaaaacgauuacgagaucuaaaucaagccgucaauaauuuaguagaauuaaaaagcacucaacaaaaaucaguauuacgaguugguacucugacaucagaugauuuacuaguauuagcagccgauuuagaaaaauuaaaaucaaaaguaauaagaacagaaagaccacuaucaaguggagucuauauggggaaccuaucaagccaacaacuagaucaaagaagagcacuacuaaacaugauaggaaugucagggggaaaccaaggagcacaaguaggaagagacggaguaguaaggguaugggauguaaaaaaugcagaccuacuaaacaaucaauucggaacgaugcccucguuaacacuagcaugcuuaacaaaacaaggacaaguugacuuaaaugacguaguacaagccuuaacagacuuaggcuuaauauacacagcaaaauacccaaauacaagcgaccuagacagauuaguacaaucacauccaauuuuaaacaugauagacacuaaaaaaagcucacuaaauauaagcggauacaacuucucauuaggagcagcuguaaaagcaggagcaugcaugcuggacggaggaaauaugcuugaaaccauaaaaguaucaccccaaaccauggacggaauacuaaaaaguauacuaaaaguaaaaaaagcacuaggaauguucauaagugaaacuccaggagaaagaaaccccuacgaaaacauacucuacaaaauaugcuuaucaggagauggauggccuuauaucgcaagcagaaccaguauuacaggaagagcaugggaaaauacgauaguagacuuagaaucagauggaaaaccccaaaaagcugguucaaauaacucaaacaaaucacuucaaagcgcaggauucacagccggucuaacauacagccaacucaugacauuaaaagacucaaugcuacaacuagacccaaaugcaaaaacauggauggauauagaagggagaccagaagauccaguagaagucgcacuauaccagccaucaucaggaugcuauauacacuuuuuuagagaaccaacagaccuaaaacaauucaaacaagaugcaaaauacucacacggaauagauguaacagaucuauuugcugcccaaccaggacucacaagugcagucauagaagcucucccaagaaacaugguaauaacaugccaaggaucagacgauauacgaaagcuauuggaaagucaaggucgaaaagauauaaaacuaaucgacauagcccucaacaaaacagauucaagaaaauaugaaaacgcaguaugggaucaauacaaagaccuuugccauaugcauaccggaguaguaguagaaaaaaaaaaaagagguggaaaagaagaaauaacaccacauugugcccuuauggacuguauaauguucgaugcagccguaucaggaggacuaaaaacacuaguacuaagagcagucuuaccaagggauaugguauucagaaccucaaccccaaaaguaguauuauaa

SEQ ID NO: 2883 - RNA, 1710 nt, Artificial Sequence
  derived and/or modified CDS sequence (opt6) from Lassa virus__AIT17307__NP
auguccgccagcaaagaaauuaaaagcuucuuauggacacaaucacuaaggagagaauuaucagguuacugcucaaacaucaaauuacaaguaguuaaagacgcucaagcacuauuacacggauuagacuuuagcgaaguaucaaacguccaaagauuaaugagaaaagaacgacgcgacgauaacgacuuaaaaagacuaagagacuuaaaucaagcaguaaacaaucuuguagaacuaaaauccacacaacaaaaaucaguacuuagaguagguacacucacaucugaugaccuacuaauucuagcagcagaccuagaaaaacuuaaaagcaaaguaacaagaacggaacgaccauuauccgcaggcguauauaugggaaauuuaucaucccaacaacucgaccaaaggcgagcucuauuaagcaugauuggaaugucaggaggaaaucaaggugcaagaacaggcagagacggaguuguucgaguaugggacguaaaaaacgcagaacuacuaaacaaucaauucggaacuaugcccucacucacacuagcaugccuaacaaaacaaggacaagucgacuuaaacgaugucguucaagcacuaacagacuuaggacugauauauacugcaaaauauccaaauacaucagaccuagaccgacuuacucaaucucauccaauauuaaacaugaucgacacgaaaaaauccucauuaaacauaucaggauacaauuucucauugggugcagcaguaaaagcaggagcauguauguuagacggugguaacauguuagaaacaauaaaaguauccccccaaacaauggauggaauauuaaaaucaauacuaaaagugaagaaagcacuuggaauguucauaucagacacaccaggagaaagaaacccauaugaaaacauacucuacaaaauauguuuaucaggugacggauggccauacauagcaucaagaaccagcauaacaggcagagcaugggaaaacacuguagucgaccuagaaagcgaugguaaacuacagaaaacagguucaaauaauucaaauaaaucacuccaaucagcaggauucacagcaggauuaacauacagucaacuaaugacauuaaaagaugcaaugcuacaauuagauccaaacgcaaaaauauggauggauauagaaggaagaccagaagacccaguagaaauugcauuauaucaacccagcucuggauguuacauacauuucuucagagaaccaaccgacuuaaaacaauucaaacaagacgcaaaauacucacacggcauagauguaacugaucuauuugcagcacaaccaggucuaacaagcgccguaauagacgcauuaccaaggaacaugguaaucaccugccaaggaucagaugacauccggaaauuauuagaaagccaaggcagaaaagacauaaaauuaaucgauauagcauuaaauaaaacagauaguagaaaauacgaaaacgcaguaugggaccaauauaaagaucuuugucauaugcauaccgggguaguaguagaaaaaaaaaaaaaaggaggaaaagaagaaauaacaccccauugcgcacuaauggauugcauaauguucgaugcagcaguaucuggcgggcucaacacuucaguauuaagagcaguacuaccacgagauaugguauuuagaacuucaacaccaagaguaguacuauaa

SEQ ID NO: 2884 - RNA, 1710 nt, Artificial Sequence
  derived and/or modified CDS sequence (opt6) from Lassa virus__AIT17311__NP
auguccgcaaguaaagaaauaaaaucauuucuauggacucaaucacuaagaagagaauuaagugguuauugcuccaacauaaaauuacaaguaguaaaagaugcucaagcauuacuacacggauuagauuuuuccgaagucaguaauguucaaagauuaaugagaaaagaaagaagagacgacaacgaccuuaaaagguuaagagauuuaaaucaagcaguaaauaaccuaguagaacuaaaauccacucaacaaaaaucaguacuaagaguaggaacauuaacaucagaugacuuacuaauacuagcggcagaucucgaaaaauuaaaaaguaaaguaauaagaacagaacgcccccuaagugcaggcgucuauauggguaacuuaaguucacaacaauuagaucaaaggcgagcacuacuaaacaugauuggaaugggaggaaguaaccagggagcaagagcaggucgagacggagucguaagaguaugggaugucaaaaacgcagaacuauuaaauaaccaauucggaacaaugcccucacuaacacuagcaugcuuaacaaaacaaggacaaguagacuuaaaugacgccguacaagcacuuacugacuuagguuuaauauauacagcaaaauauccaaauaccucagacuuagacagguuaacgcaaucacauccaauacucaacaugauagauacaaagaaauccucacuaaauauaucagguuauaauuuuagucuaggagccgcaguaaaagccggagcuuguauguuagauggaggaaauauguuagaaacaauaaaaguaucaccacagacaauggauggaauauuaaaaucaauauuaaaaguaaagaaagcacuaggaauguucauaucagauacacccggcgaaagaaacccuuaugaaaauauauuauauaaaauaugucuaucaggagauggauggccauacauagcuaguagaacaucgauaaccgggagagcaugggaaaauacuguaguagaucuagaaagcgauggaaaaccccaaaaagcuggaaguaacgguucaaauaaaucauuacaaucagccggguucacagcaggucuaacauauucacaauuaaugacauuaaaagaugcaauguuacaacuagacccaaaugcaaaaacauggauggauauagaaggaagacccgaagacccaguagaaguagcuuuauaucaaccaucaucuggaugcuauauacacuucuuuagagaaccaaccgaucucaaacaauucaaacaagacgcaaaauacucucauggaauagauguaacagauuuauuugcugcacaaccaggacuaacaucagccguaauagacgcacuaccaaggaauaugguaauaacgugccaaggaucagacgacauaagaaaauuacuagaaucacaggguagaaaagauauaaaacuuaucgauauagcacuaucaaaaaccgacucucgaaaauacgagaaugcaguaugggaucaauacaaggaccuaugccacaugcauacaggaauaguugucgaaaagaagaaaagaggaggaaaagaagaaaucacaccgcauugugcccuuauggauuguauaauguuugacgcagccguaaguggagguuuaaauacaagcguccuaagagcaguauuaccacgagacaugguauucagaacaucaacaccaagaguaguacuuuag

SEQ ID NO: 2885 - RNA, 1710 nt, Artificial Sequence
  derived and/or modified CDS sequence (opt6) from Lassa virus__AIT17315__NP
augagcgcauccaaagaaauuaaaaguuuucuauggacacaaucauuaagaagagaguuaucaggauauugcucaaacauaaaacuacaaguaguaaaggacgcucaagcucuauuacacggccuagauuucucugaaguaucaaauguacaaagacuaaugagaaaagaacgaagagaugauaacgauuuaaaaagauuacgagaucugaaucaagcaguaaacaacuuaguagaacuaaagucuacacaacaaaaauccguacuaagaguaggcacacucaccucagaugauuuacuaauauuagcagcagauuuagaaaaauuaaaaucgaaagucacaagaacagaaagacccuuaucagcaggaguauauaugggaaacuuaucaucacaacaacuugaucaaagaagagcacuauuaaauaugauaggaaugagugguucaaaccaaggcgcaagagcaggaagagacggaguaguaagaguaugggacgucaaaaacgucgaauuauugaacaaucaauuugguacuaugccaucucuaacucuagcuugucuaacaaaacaaggacaaguagauuuaaacgacgcuguacaagcccuuacagacuuaggacuaauauacaccgcaaaauacccaaauaccucagaccuggauagauuaacacaaucacacccuauauugaauaugauagacacaaaaaaauccucccuuaacauaagcgguuacaacuucucccuaggagcagcaguaaaagcaggagcauguaugcuagacggaggaaacaugcucgaaacuaucaaaguaucaccacaaaccauggacggaauacuaaaauccauacuuaaaguaaaaaaagcauuaggaauguucauaucagacacaccaggugaaagaaauccauacgaaaauauuuuauacaaaauauguuuaucaggagauggauggcccuauauagcaaguagaacaagcauaaccggcagagcaugggaaaauacaguuguagaucuugaaucagacggaaaaccacaaaaagcaggcucgaacaguucuaacaaaaguuuacaaagcgcaggcuuuacagcuggauuaacauauagucaacuaaugacauuaaaagacgcaaugcuccaacuugacccaaacgcaaaaacauggauggauauugaagguaggccagaagacccaguugaaauagcacuauaucaaccaucuucuggaugcuacauacauuucuucagagaaccaacugaccucaaacaauuuaaacaagaugccaaauauucacauggaauagauguaaccgaucuauuugcagcgcaaccaggauuaacaagugcaguaaucgaugcauuaccaagaaacaugguaauaacaugucaaggcucagacgauauaagaaaacuacucgaaucacaaggcaggaaagauauaaaauuaaucgauauagcuuuaaguaaaaccgauagccgaaaauacgaaaaugcaguaugggaucaauacaaagauuuaugccauaugcauacaggaauaguaguugaaaaaaaaaaaaaaggaucaaaagaagaaauaacaccucacugcgcacucauggauugcauuauguuugaugcggcaguaagcggaggacuaaacgcaucaguccuaagagcaguauuaccaagggacauggucuucagaaccucaacaccaagaguagugcuauaa

SEQ ID NO: 2886 - RNA, 1710 nt, Artificial Sequence
  derived and/or modified CDS sequence (opt6) from Lassa virus__AIT17319__NP
augucggcuaguaaagaaauaaaaucauuuuuauggacacaaucauuacgaagagaauuaucaggauacugcuccaacauaaaauuacaaguaguaaaagaugcucaagcacuauuacacggacuagacuucagugaaguaagcaauguucaaagacuaaugcgaaaacaaagaagagaugauucagacuuaaaaagauugagagauuuaaaccaagcaguuaauaaccuaguagaacuaaaaucaacgcaacaaaaaucaguauuaagaguagggacgcuaacaagcgaugacuuauuaguauuagcugcagaucucgaaaaacucaaaucaaaaguaauaagaaccgaaagaccauuaaguuccggaguauacaugggaaauuuaucaucucaacaacuagaucaaagaagagcacucuuaaacaugauaggaaugagcggagguaaccaaggagcacaaguaggaagagaugguguaguaaggguaugggauguaaaaaacgcagauaugcucaacaaucaauuuggaacaaugccaagccuuacccuagcaugccuaacaaaacaaggacaaguagacuuaaacgacguuguacaagcauuaacagacuuaggauuaauauacacagcaaaauacccaaauacaucagaucuagauagauuagcgcaaagucauccaauacuaaauaugauagacacaaaaaaaucaagcuuaaauaucucaggauacaacuuuagucuaggagcagcaguuaaagcaggagcauguaugcuagacggagguaauaugcuagaaacaauaaaaguaucaccacaaacaauggauggaaucuuaaaaucaauauuaaaaguaaaaaaagcauuagggauguucauaucagaaacaccaggagaaagaaacccauacgaaaauauacuauauaaaauaugccuuucaggcgauggauggccauauauagcaucaagaaccuccauaaccggccgugcaugggaaaacacaauaguagaccuagaaucugacggaaaaccacaaaaagcagggucuaacaacucaaacaaaucacuccaaagcgccggauucacugcaggacuaacauacucacaacuaaugacauuaaaagacucaauguuacaauuagauccaaaugcaaaaacauggauggauauagaaggaagaccagaagauccagucgaagucgcacuauaccaaccaucaaguggguguuacauacauuucuuucgagaaccuacagacuuaaaacaauucaaacaagacgcaaaauauagucacggaauagacguaacagauuuauucgcagcccaaccaggauuaacaucugcaguaauagaagcacuaccaaggaauaugguaauaacuugucaaggaagcgacgacauccgaaaacuauuagaaucacaaggacgaaaagacauaaaauuaauagauauaguacuaaacaaaacagacaguagaaaauaugaaaaugcagucugggaucaauauaaagauuuaugccauaugcauaccggcguaguaguagaaaaaaaaaaaagaggaggcaaagaagaaauuacaccucacugugcuuuaauggacuguauaauguuugaugcagcgguaagcggaggacuaaaaacaaugguccucagagcuguccuaccacgagacaugguguuccgaacauccacaccaaaaguaguucuauaa

SEQ ID NO: 2887 - RNA, 1710 nt, Artificial Sequence
  derived and/or modified CDS sequence (opt6) from Lassa virus__AIT17323__NP
augucagcaaguaaagaaauaaaauccuuccuauggacucaaucuuuaagaagagaacucaguggcuacuguucaaacauaaaacuacaaguaguuaaagaugcacaagcacucuuacauggacuagacuucagcgaaguaucaaauguucaaagauuaaugagaaagcaaagaagagacgacagcgaucuaaaacgacuaagagaucuaaaucaagcugucaauaaucuaguagaacucaaaucaacgcaacaaaaaucaguucuccgaguaggcacauuaacgagcgacgacuuacuaguauuagcugcugaucuagaaaaauuaaaaucaaaaguaaucagaacugaaagaccacuaagcaguggcgucuacaugggaaaccuaagcagucagcaacuagaccaaagacgagcauuauuaaauaugauuggaaugagcggaggaaaucaaggagcacaaguaggaagagauggaguagucaggguuugggacguaaaaaaugcagaucuacuaaacaaccaauuuggcacaaugccgagccucacacuagcauguuuaacuaaacaaggacaaguagacuuaaacgauguaguacaagcccuaacagacuuaggcuuaauauauacagcaaaauacccaaauacaucagaccuugauagauuagcacaaucacacccaauacuaaauaugauagauacaaaaaaaucaucauuaaauauaagcggauauaauuucagcuuaggagcagcagucaaagcaggagccuguaugcuagacgguggcaauauguuagaaacgauaaaaguaucaccacaaacuauggauggaauacuaaaaaguauauuaaaaguaaaaaaagcacuaggaauguucauaucugaaacaccaggagaaagaaacccauaugaaaauauacuauauaaaauaugucuaucaggugacggauggccauacauagcaagcagaacaucaauaacaggcagagcaugggaaaauacaauaguagaccuugaauccgaugggaaaccacaaaaagccggaaguaauaauucaaauaaaagucuucaaagcgcaggauucaccgcaggcuuaaccuauucucaacuuaugacauuaaaagacucuaugcuacaacuagaccccaacgccaaaaccuggauggacauagaaggaagaccagaagacccugucgaaguagccuuauaucaaccaucaucaggcugcuacauccauuuuuucagagaacccaccgaccuaaaacaauucaaacaagacgcuaaauauucccaugguauagauguaaccgacuuauucgcagcucaaccaggcuuaacaucagcaguaauagaggcacugccacgaaauaugguuauaacaugccaaggauccgaugauauacguaaauuacuagaaucacaaggaagaaaagacauaaaacuaauagacauagcucuaaauaaaacagauucuagaaaauacgaaaacgcuguaugggaccaauacaaagacuuaugccacaugcacacuggcguaguaguagaaaaaaaaaaacgaggaggaaaagaagaaauaacuccacauugcgcacuaauggauugcaucauguucgacgcagcuguaucuggaggauuaaaaacacuaguauuaagagcaguacuaccacgagauaugguuuuuagaacaucaaccccaaaaguaguauuauaa

SEQ ID NO: 2888 - RNA, 1710 nt, Artificial Sequence
  derived and/or modified CDS sequence (opt6) from Lassa virus__AIT17325__NP
augagcgcaucaaaagaaauaaaaucauuuuuauggacacaaagccuaaggagagaacuaagcggauauuguucaaacauaaaacuacaaguaguaaaagacgcacaagcacuacuacacggucuagauuuuagugaaguaaguaauguacaaagacuaaugcgaaaacaaagaagagaugacaacgacuuaaaaagacuacgagaucuaaaccaagcaguaaauaauuuagucgagcucaaaucaacacaacaaaaauccguucuaaggguaggcacauuaacaucagaugaucuacuuguacuagcagcagauuuagaaaaauugaaaucuaaaguaacaagaacagaacgaccucuaucagccggaguuuacaugggcaaccuaucaucacaacaacuagaccaaaggagagcauuauuaaauaugauaggaaugacgggagguuccagaggagcacaagcaggcggagaugguguaguuagagucugggauguaaaaaacgcagauuuacuaaauaaccaauucggcacaaugccaucuuuaacacuagcauguuuaacuaaacaaggacaagucgaccuaaacgacguuguacaagcauuaacagauuuaggauuaauauauacagcaaaauacccaaauaccucagauuuagacagauuaacacaaucacacccuauacuaaacaugauugacacaaaaaaauccagucugaacauaaguggauacaacuuuaguuuaggagcagcaguuaaagcaggagcuuguaugcuagauggaggaaauaugcuggaaacgauaaaaguaaguccccaaacaauggauggcaucuuaaaaucaaucuuaaaaguaaaaaaaagccuaggaauguucauaucugauacucccggcgaaagaaauccauaugaaaacauacuuuacaaaauaugucuuagcggcgauggauggcccuacauagcauccagaacaaguaucacuggaagagcaugggaaaauacuguaguagacuuagaaagugauggaaaaccucaaaaagcaggaggaaacaauaguaacaaaucacuacaaagcgcaggauuuacagcaggauuaaccuauucacaauuaaugacucuaaaagacacgauguuacaacuagauccaaaugcaaagacauggauggacauagaaggaagaccagaagacccaguugaaguagcacuauaccaaccaagcucgggauguuauauacacuuuuucagagaaccaacagaccuaaaacaguuuaaacaagacgcaaaauauucacauggaauagacguaacagaucuauuugcagcacaaccaggacuuacaucagcaguaauagaagcacuaccacguaacaugguaauaacaugccaagguagcgaugauauucgcaaauuacuagaaagucaaggacgaaaagauauaaaacuaauagauauagcacucaguaaaguagacucacgaaaauaugaaaaugcaguaugggaucaauacaaagauuuaugucacaugcauacaggaguaguaguagaaaaaaaaaaaagaggcggaaaagaagaaauaacaccacauugugccuuaauggacugcauaauguuugacgcagcaguaagcggcggauuaaacacacuagugcuaagggcaguacuaccaagagauaugguauucagaacaucaacacccaaagucguauuauaa

SEQ ID NO: 2889 - RNA, 1710 nt, Artificial Sequence
  derived and/or modified CDS sequence (opt6) from Lassa virus__AIT17329__NP
augucagcaaguaaagaaaucaaaucauuucuauggacacaaucccucagaagagaacuaucaggauauugcucgaacauaaaauuacaagucguaaaagacgcacaagcccuacuacauggauuagauuucucagaaguaucaaauguacaaagguuaaugagaaaagaacgacgagaugacucagaucuuaagagacuccgagaucucaaucaaaccguaaacaauuuaguagaauuaaaaaguacacaacaaaaaucaauacucagaguuggcacuuuaacaucagaugacuuacuuauacuagcagcagauuuagaaaaauuaaaaucaaaaguaauaagaacagaacgaccucuaucugcaggaguauacaugggaaacuuaucuucacaacaacuagaucaaagaagagcacuauuaaauaugauaggaaugucaucaggaaaccaaggagcacaagcaggcagagacggaguaguacguguaugggauguaaaaaaugcagagcuacuaaauaaucaauucggaacaaugccaucauuaacacuagcaugcuugaccaaacaagggcaaguagacuuaaacgacgccguacaagcauuaacugaccuaggauuaaucuauacagcaaaauauccaaauacaagcgaucuagacagacuaacccaaucacacccaauacuuaacaugauugauacuaaaaaaaguagccuaaacaucucaggauacaacuuuucacucggagcugcaguaaaagcaggugcauguauguuagacggaggaaauaugcuagaaacaauaaaaguaucaccacaaaccauggacggaauacuaaaaucaauacugaaaguaaaaaaagccuuaggaauguucauaagcgauacuccaggagaaagaaacccauaugaaaauauauuauacaaaauaugucuauccggagauggcuggccauauauagcuaguagaacaucaauaacuggaagagcaugggaaaauacaguaguagaucuagaaagcgauggaaugccacaaaaagcuggcagcagcaguagcaauaaaucucuacaaagcgcaggcuucguagcaggauuaacauauucucaacuaaugacauuaaaagacgcaaugcuacaacuagauccaaaugcuaaaaccuggauggauauagaaggaagaccugaagacccgguagaaaucgcacuauaucaaccaucaucaggaugcuacauacauuuuuuccgagaaccaacugaucucaaacaauucaaacaagacgcaaaauauucucauggaauagaugucacugauuuauucgcagcacaaccuggcuuaacaucagccguaauagaugcauuaccgagaaacaugguaauaaccugucaagguuccgaugacauuagaaaacuacuagaaucgcaaggaagaaaagacauuaaauuaauagauauagcuuuaucuaaagcagacucuagaaaauaugaaaacgccguaugggaucaauacaaagacuuaugccacaugcauacaggaguaguaguugaaaaaaaaaaaagaggagggaaagaggaaauaacaccacacugugcauuaauggacugcauaauguaugacgcugcaguaagugguggacuaaauacauccguacuaagagcaguacuuccaagagacaugguauuccguacaucaacaccaagaguaguacuauaa

SEQ ID NO: 2890 - RNA, 1710 nt, Artificial Sequence
  derived and/or modified CDS sequence (opt6) from Lassa virus__AIT17333__NP
augucagcaucaaaagaaauaaaaucauucuuauggacucaauccuuaagacgagaacucaguggcuauuguaguaacauaaaacuacaaguaguaaaagaugcucaggcucuacuacacgguuuagauuucucagaaguaagcaaugugcaaagauuaaugagaaaagaacgacgagaugauaacgauuuaaaaagacuaagagacuuaaaucaagcaguaaacaaccuaguagaauuaaagucaacccaacaaaaaucagucuuacgaguaggaacacuaacaucagacgaccuacuaauacuagcagccgauuuagaaaaauuaaaauccaaaguaaccaggacagaaagaccuuuaucagcggguguauacaugggaaaucuaucgucacaacaauuagaccaaagacgagcacuauuaaauaugauaggaaugucaggugguaaccaaggagcaagagccgguagagacggaguaguaagaguaugggacgucaaaaacgcagaacuacuaaauaaucaauucggaacaaugcccuccuuaacacuagcuugccuaacaaaacaaggucaaguagaucuaaacgacgcaguacaagcauuaaccgaccucggacuuauuuauacagcaaaauauccaaauacaucagacuuagacagauuaacacaaucacacccaauauuaaauaugauagacacaaagaaaagcucauuaaacauaagcggauacaauuucucucucggagcagcaguaaaagcgggugcauguauguuagauggaggaaacauguuagaaacaauaaaaguauccccacaaacaauggacucaauauuaaaaucaaucuuaaaaguaaagaaggcuuuaggaauguuuauauccgauacaccaggagaaagaaauccauaugaaaacauacucuauaaaauaugucuaagcggcgauggauggccauacauagcaucaagaacuagcauaacagguagagccugggaaaauacaguaguagaucuagaaagugaugggaaaccgcaaaaagcaggcucaaacaauaguaauaaaucacuucaaagugcaggcuuugcagcaggacuuacauacucacaacuaaugacgcuaaaagaugcaaugcuacaauuagaucccaaugcaaaaaccuggauggauaucgaaggacgaccagaagauccagucgagauagcauuauaccagccaucaucaggcuguuacauucacuucuuuagagaaccaacugauuuaaaacaauucaaacaagacgcaaaauauagccauggaauagacguaacugauuuguuugccgcacaaccaggauuaacaagugcagucauugacgcauuacccagaaacaugguaauaacuugccaaggaucagaugauauaagaaaacuacuugaaucucaaggaagaaaagauauaaaauuaauagacauugcccuuucgaaaaccgacucaagaaaauaugagaaugcaguaugggaccaauacaaagacuuaugucauaugcauacaggaauaguaguagaaaagaagaaaagaggagguaaagaagaaaucacaccacacugugcauuaauggacugcauaauguuugacgcagcaguaucaggaggcuuaaauacaucuguacuacgcgcaguccuaccuagagacaugguauucagaacaucaacaccacgcguaguacuauaa

SEQ ID NO: 2891 - RNA, 1710 nt, Artificial Sequence
  derived and/or modified CDS sequence (opt6) from Lassa virus__AIT17335__NP
augagugcaucaaaagaaaucaaaucguuuuuauggacacaaaguuuaagaagggaacuuucaggcuauugcaguaacauaaaauuacaaguaguaaaagacgcccaagcucuuuuacacggacuagauuucucugaaguaucaaacguucagagauuaaugcgaaaagaaagaagagacgauagugaucuaaaaagacuaagagaucuaaaccaagcagucaauaacuuaguagaacuuaaaaguacacaacaaaaaucuauauuaagaguagguaccuuaacaagugaugaccuacuuauauuagcagccgaucuagaaaaacuaaaaucaaaaguaacuagaacagaaagaccauuaucagcaggaguauacaugggaaaucuuuccagccaacaauuagaccaaagacgagcucucuuaagcaugauagguaugucaagcggaguacaaggugcaagagcagggagagauggaguaguaagaguaugggaugucaaaaacgccgaacuucucaauaaucaauuuggaaccaugccgucccuaacuuuagcaugccuuacaaaacaaggccaaguagacuugaacgauguaguacaagcacucacagacuuaggacucauauacacagcuaaauacccaaacacaucagauuuagacagacucacacaaagucacccuauauuaaacaugauugacacaaagaaaucaucccuuaacauaagcggauauaauuucucacuaggcgcagcaguaaaagccggagcauguauguuagacggaggaaauauguuagaaaccauaaaaguaucaccacaaacaauggauggaauuuuaaaaucaauauuaaaagugaagaaagcauuaggaauguuuauaucugaaacaccgggugaaagaaauccauaugaaaauauacuauacaaaauaugucuaucaggagauggauggccauacauagcgagcagaacaaguauaacuggcagagcuugggaaaauacaguuguagaucuagaaucagacgguaaaccacaaaaagcaggaucuaacaauaguaauaaaagucuucaaagcaccggauuugcagcaggauuaacauauucccaacuaaugacauuaaaagacgcaaugcuacaacuagauccuaacgcaaaaaccuggauggauauagaaggacgaccagaagacccaguagaaguugcacuauaccaaccuucaucaggcugcuacauacacuucuuucgagaaccaacagaucuaaaacaauuuaaacaggacgcaaaauauucacauggcauagauguaaccgaucuauuugcugcccaacccggacuaacuagcgcaguaauagaugcacuaccaagaaacaugguaauaacuugccaaggaagcgaugauauaaagaaauuacuagaaagucaagggagaaaagauauaaaauuaauugacauagcauuaaguaaaacagacagcagaaaauaugaaaaugcaguaugggaccaauauaaagaccuaugucauaugcauacagguguuguaguagaaaagaagaaaagaggcggaaaagaggaaauuacaccgcacugugcauuaauggauugcauaauguucgacgcagcagugaguggaggacucaacacaucaguucucagagcaguacuaccaagagacaugguauucagaacaucuacaccaagaguugugcuauga

SEQ ID NO: 2892 - RNA, 1710 nt, Artificial Sequence
  derived and/or modified CDS sequence (opt6) from Lassa virus__AIT17341__NP
augagugcaagcaaagaaaucaaauccuuuuuauggacacaaucacuaagaagagaauuaagugguuacugcucgaacauaaaauuacaaguuguuaaagaugcacaagcauuauuacacggacuagauuucucagaaguaucaaauguccaaagauuaaugcgaaaagaacguagagacgauaacgaucuaaaaagauuaagagaucuaaaucaagcaguaaauaaucuagucgaauuaaaaucaacucaacaaaaaucaauucuaagaguagguacacuaacaagugaugauuuauuaauacuagcagcugaccuagaaaaauuaaaaaguaaaguaacaaggaccgaaagaccguuaucagcagguguauauaugggaaauuuauccucgcaacaacuagaucaaagacgagcuuuacuaaacaugaucgguaugaguggaggaaaccaaggagcgcgagcaggcagagacggagucguaagaguaugggauguaaaaaaugcagaacuacucaauaaucaauucggcacaaugccaucauuaacacuagcaugccuaacaaaacaaggacaaguugaccuaaacgaugcaguacaagcgcuaacagaucuaggauuaauauauacagcaaaauacccuaauacaagcgacuuagauagacuaacacaaucacacccaaucuuaaauaugauagauacaaaaaaaaguucauuaaauauaagcggauacaauuucagucucggugcagcaguaaaagcuggagcauguaugcuugacggaggaaauauguuagaaacaaucaaaguaucuccacaaacuauggacggaauacugaaaucaauacuaaaagucaaaaaagcucuaggaauguucauaucugacgcaccaggugaaagaaauccauacgaaaauauacuuuacaaaauauguuuaucaggagacggauggccuuauauagcaucaagaacaucaauaacuggaagagcaugggaaaauacuguaguugaucuagaaucagauggcaaaccucaaaaagcagguucaaaugguagcaauaaaucacuacaaagcgcaggauuuacugccggauuaacauauucacaacucaugaccuuaaaagacgcaaugcuacaacuugauccuaaugcaaaaaccuggauggauauagaaggucgaccagaagauccaguugaaauagcucuauaucaaccaagcucaggauguuacauacacuucuucagggaacccacagacuuaaaacaauuuaaacaagaugcaaaauauagucaugguauugauguuacagaccuauuugcagcucaaccaggauugacaucagccguaaucgaugcauuaccaagaaauaugguaauaacaugucaaggcucagacgacauuagaaaauuauucgaaucacagggaagaaaagauauaaaguuaauagauauugcuuuaucaaaagcugacucuagaaaauacgaaaaugccguaugggaucaauacaaagaccuaugccauaugcacacgggaguaguagucgaaaaaaaaaaacgaggcggaaaagaagaaauaacaccucauugugcauuaauggacugcauaauguuugaugcugcaguaucaggaggacuaaacacgucaguauuaagagcuguacucccaagagacaugguauuuagaacaagcaccccacgagugguacuguag

SEQ ID NO: 2893 - RNA, 1710 nt, Artificial Sequence
  derived and/or modified CDS sequence (opt6) from Lassa virus__AIT17345__NP
augagcgcuucaaaagaaauaaaaaguuuuuuauggacacaaucauuacguagagaacucucagguuacugcucaaacauaaaauuacaaguaguaaaagacgcacaagcauuauugcacggacucgauuucucagaaguauccaacguucaaagauugaugagaaaagaacggagagaugauaaugaccuuaaaagacuaagagaucuaaaucaagcuguaaauaauuuaguagaacuaaaaaguacucaacaaaaaucuauuuuacgcguaggaacacuuacuucugaugacuuacuaauauuagcugcagaccuagaaaaauuaaaaaguaaaguaacaagaacagaaagaccucuaucagcaggaguuuauaugggaaauuuaucaucucaacaacuagaucaaagaagagcacuauuaucaaugaucggaaugucaucaggaguacaaggcgcuagagcuggccgagacggugugguacgcguaugggacguaaaaaacgcagaguuacuaaacaaucaauuuggaacaaugccaucacuuacacuagcaugccugacaaaacaaggacaagucgauuuaaacgauguaguacaagcacuuacagaccuaggauuaauauauacagcaaaauauccaaauacuucugacuuggacagguuaacccaaagccacccaauuuuaaauaugauugauacuaaaaaaucaaguuuaaacauaucaggauacaauuucucacuuggagcagcuguaaaagcaggugcguguaugcuagacggcggcaacauguuagaaacgaucaaagucucaccacaaacaauggauggaauacuaaaaucaauacuaaaaguaaaaaaagcccuaggaauguuuauaucagaaacaccaggagaaagaaauccguacgaaaauauauuauauaaaauuuguuuaucaggagacggauggccauauauagcaucaagaacuucaauaacaggaagagcaugggaaaauacaguggucgaucuagaauccgauggaaaaccccaaaaagccgguucaaauaacagcaauaaaucucuccaaucagcagguuuuaccgcaggcuuaacuuauagccaauuaaugaccuuaaaagaugcaauguuacaauuagauccaaacgccaaaaccuggauggauauagaaggaagaccagaagauccagucgaaguagcacuauaccaaccuagcucaggauguuacauccauuuuuucagagaaccaacagaccuaaaacaauuuaaacaagaugccaaauauagccauggaauagacguaacugaccuauucgcugcacaaccuggacuaacaucagccguaauagaugcauuaccgagaaacaugguaauaacaugucaaggaucagacgauauaaaaaaacuauuagaaucacaaggacgaaaagacauuaaacuaaucgacauagcacuauccaaaacagacagcagaaaauaugaaaacgcaguaugggaucaauauaaagaccuaugccacaugcauacaggcgucguaguagaaaaaaaaaaacgagguggaaaagaagaaaucacaccacauugugccuuaauggauugcauaauguuugacgcagccguaaguggaggacuaaacacuaguguccuacgagccguacuaccaagagauaugguauucagaacaucaacaccuagaguaguauuauaa

SEQ ID NO: 2894 - RNA, 1710 nt, Artificial Sequence
  derived and/or modified CDS sequence (opt6) from Lassa virus__AIT17351__NP
augagcgcaucaaaagaaauaaagagcuuuuuauggacacaaucacuuagaagagaacuuagcggauauugcucaaauaucaaauuacaaguaguuaaagaugcacaagcccuccuacacgguuuagacuuuucagaaguauccaacguucaacgacuaaugagaaaacaaagaagagacgauggagauuuaaaaagauuaagagauuuaaaccaagcuguaaacaaucuuguagaacuaaaaaguacacaacaaaaaucaguccuacguguaggaacucugacaagugaugaucuacuaauacuagccgcagaucuagaaaaacuaaaaucaaaaguaauaagaacagaaagaccuuuaagcgccggagucuacaugggaaaccuaucaucccaacaacuagaacaaagacgagcucuacuaaauaugaucggaaugaguucuggcaaccagggugcaagaacaggaaaagaugguguaguaagaaucugggaugucaaaaacgcugauuuacuaaauaaccaauucgguacaaugcccucacuaacacuagcaugcuuaacaaaacaaggacaaguagauuuaaacgacguaguacaggcuuuaacagauuuaggauuaauauacacagcaaaauauccaaauacaucagaccuagacagacuaacacaaucacacccuauacuaaacaugguagauaccaguaaaaguaguuuaaacauuaguggauauaacuucaguuuaggagcggcagucaaagccggugcaugcaugcuagacggaggaaauauguuagaaacaaucaaaguaucaccacaaacaauggacggaauauuaaaaucaauacuuaaaguuaagaaaaguuuagguauguucguaagcgauacaccuggagaaagaaacccauacgaaaacauacuuuacaaaauauguuuaucuggagacggauggccauacauugcaaguagaacaucaauaacagguagagcaugggaaaauaccguaguagaccuagaaucaaacggaaaaccucaaaaagcaggaucaaacaauagcaauaaaucauuacaaagcacaggauuuacugcaggacuaaccuacagucaacuaaugacauuaaaagacgcaauguuacaacuagauccaaacgcaaaaacauggauggauauagaaggacgcccagaagacccaguagaaauagcacuauaucaaccaaguucaggauguuacauacacuucuuuagggaaccaacagacuuaaaacaauuuaaacaagaugcgaaauacagccaugguauagauguaacagaucuauuugcagcacaaccuggacuaacaucagcaguaauagauacuuuaccaagaaacaugguuauaacaugucaaggaagcgacgacauaagaaaacuauuagaaagucaagggcgaaaagacauaaaauuaaucgauauagcccugucaaaaauugacucaagaaaauaugaaaacgcaguaugggaccaauacaaagauuuaugucauaugcauacaggaguaguaguugaaaagaagaaaagaggaggaaaagaagaaauaacuccucacugugcacuaauggauugcauuauguuugacgcagcaguaucagguggccuaaaugcuuccguucugagagcuguacuaccccgagauaugguauucagaacuucaacacccagaguaguucuauaa

SEQ ID NO: 2895 - RNA, 1710 nt, Artificial Sequence
  derived and/or modified CDS sequence (opt6) from Lassa virus__AIT17359__NP
augagcgcuuccaaagaaauaaaaucuuucuuauggacacaaucauuaagaagagaacuaagcggauauugcucaaacauaaaacuacaaguaguuaaagacgcucaagcacuauuacacggucucgauuucagcgaaguaucaaauguacaaagacuuaugagaaaagaaagaagagaugauagugauuuaaaacgacuaagagaucuaaaucaagcaguaaacaaucuaguagaauuaaaaucuacacaacaaaaaucaauacuccgaguuggaacauuaaccucagacgaccuauuaauacucgcagcagauuuagaaaaacuaaaaaguaaagucacaagaacugaaagaccacucucagcaggaguauacauggguaacuuaucuagccaacaacuagaucaaagaagagcacuacuaaauaugcuaggaaugucuggaagcaaucaaggcgcaagagcaggaagagauggaguaguacggguaugggacgucaaaaacgcagaauuauuaaacaaccaauucgguacaaugccaucacucacauuagcuugcuuaaccaaacaaggacaagucgaccuaaaugaugcuguacaagcacuaacagaccuaggauuaauauauacugcaaaauacccaaauacaucggacuuagauagauuaacacaaucucacccaauacuaaauaugauagauacaaaaaaauccucacuaaauauaagcggauacaacuuuagucuaggagcagccguuaaagcaggagcauguauguuagaugguggaaauaugcuagaaacuaucaaaguaucaccacagacuauggacggaauauugaaaucaauuuuaaaaguaaaaaaagcauuaggcauguucauaucagauacaccaggcgaaagaaauccauaugaaaacauauuauauaagauaugccucucaggagauggauggccauauauagcaucucgaacaucaauaacuggaagagcaugggaaaauacaguuguagaccuugagucagacgaaaaaccacaaaaagcgggaucaaacaguagcaauaaaucuuuacaaucagcaggauuuacugcaggacuaaccuauucccaauuaaugacacuuaaagacgcaauguuacaacucgauccaaaugcaaaaacauggauggauauagaaggaagaccagaagacccuguagaaauagcgcuuuaucaaccaucuaguggcuguuacauacauuuuuucagagaaccuacagaucuaaaacaauuuaaacaagacgcaaaauauucacauggaauugauguaaccgacuuauuugcugcacaacccggcuuaacaagugccguaauagaugcauuaccaagaaacaugguuauaacaugccaaggaagcgaugacauacgaaaauuauuagaaagccaaggaagaaaagauauaaaacuaaucgacauagcccuaucaaaaacugacucccgaaaauacgaaaacgcuguaugggaccaauacaaagacuuaugccauaugcacaccggcauaguaguagaaaaaaaaaaaaggggaggcaaagaagaaauaaccccacacugcgcauuaauggauuguauaauguucgacgccgccguaucaggcggauuaaacgcauccguacuaagagcuguucuaccgagagauaugguauucagaaccagcacaccuagaguaguauuauaa

SEQ ID NO: 2896 - RNA, 1710 nt, Artificial Sequence
  derived and/or modified CDS sequence (opt6) from Lassa virus__AIT17361__NP
augagcgcgucaaaagaaauaaaaagcuucuuauggacacaaucauuaagaagagaauuaucagguuacugcaguaauaucaaauuacagguuguaaaagaugcacaagcacuauuacacggacuagacuuuucugaaguaagcaacguacagagguuaaugagaaaagaaagacgagacgauucagacuuaaaaagauugagagauuuaaaccaagcaguaaauaaucuaguagaauuaaaaaguacacaacagaaaucagucuugagaguaggaacacucacaagugaugaccuuuuaguccuagcagcagaucuagaaaaacucaaaucaaaaguaacuagaacagaaagaccacuaucagccggaguauauauggguaacuuaucaucccaacagcuagaccaaaggcgcgcacuacucaacaugauagguaugucuggaggaaaucaaggagcacgagcaggcagagacggaguaguaagaauaugggauguaaaaaacgcagaauuacucaauaaccaauucggaacaaugccaucacuaacacuggcaugucuuacaaaacaagggcagguagacuuaaacgacguaguacaagcgcuuacagacuuaggcuuaauauauaccgcaaaauaucccaauacuagcgaccuagaucgauuaacacaaucacauccaauauuaaauaugauagauacaaaaaaaucaucauuaaauauuucaggauacaauuuuagccuaggugcagcagucaaagcaggagcguguauguuagacggaggaaauaugcuagaaacaauaaaaguaucaccacaaacaauggauggaauauugaaaagcauacuaaaaguaaaaaaggcauuaggaauguucauaagcgauaccccaggagaaagaaauccauaugaaaauauauuauauaaaauaugucuaucaggagaugguuggccauauauagccagcagaacaaguauuacaggaagagcaugggaaaacacaauaguagauuuagaaucagauggaaaaccccaaaaaacaaacaauacaaauaguaauaaaucauuacaaagugcaggauuugcagcaggcuugacauauucccaacuaaugacauuaaaagaugcaauguuacaacuagauccaaacgcaaaaacauggauggauauagaaggacgaccagaagauccaguagaaauagcccuauaucaaccaucauccggauguuauauacacuuuuucagagaaccaaccgaucuaaaacaauucaaacaagaugcaaaauauagucacggaauagauguaaccgaucuuuuugcagcacaacccggauuaaccagugccgucauagacacacuaccacgaaauaugguaauaacuugucaaggaucagaagauauaagaagacuauuagaaucacaaggacgaaaagauauaaaauuaauagauauugcauuaaguaaaacagacuccagaaaauaugaaaacgcaguaugggaccaauauaaagaccucugucauaugcauacaggaguaguaguagaaaaaaaaaaaaaaggaggaaaagaggaaauaacaccacacugugcacuuauggauugcauaauguuugacgcagcaguaaguggaggauuaaacacaucagucuuaagagccgugcuaccccgagauaugguauucagaacaucaaccccaagaguaguauuguaa

SEQ ID NO: 2897 - RNA, 1710 nt, Artificial Sequence
  derived and/or modified CDS sequence (opt6) from Lassa virus__AIT17365__NP
augucagcuucaaaagaaauuaaaagcuuucuauggacacaaagccuaaggcgagaauuaucaggauauugcucaaacauuaaacuacaaguggucaaagacgcgcaagcacucuuacacggucuagauuuuagugaaguaucaaauguacaaagauuaaugagaaaagaaagaagagacgacaaugacuuaaagcgauuaagagaucuaaaucaagcuguaaauaaccuaguagaauugaaaagcacacaacaaaaaucaauacuaagaguaggaacacuaacaagcgaugaucuacuaauacuagcugccgaucuggaaaaauuaaaaucaaaagugacaagaacagaaagaccauuaucagccggaguauauaugggaaaucuaucaagucaacaguuagaucagcgaagagcauuauuaaacaugauagguaugucuggcucaaaccaaggagcacaagcaggaagagauggaguaguaagagucugggauguaaaaaacgcagaauuacuaaauaaccaauucggaacaaugccaagccuaacacuagcaugcuuaaccaaacaaggacaagucgacuuaaacgaugcaguacaagcauuaacagauuuaggucuaauauacacagcaaaauauccaaauacaucagaucuagauagguuaacgcaaagucacccaauauuaaauaugauagacacaaaaaaaucgucauuaaacauaucaggauacaacuuuagccuaggcgcagccguuaaagcaggagcuugcaugcuagacggugggaauaugcuagaaacaauuaaagucucaccacaaacaauggauggaauacuuaaaucaauauuaaaaguaaaaaaagcacuaggaauguuuauaagugaugcaccuggagaaagaaacccauacgaaaacauauuauacaaaaucugccuuagcggagauggauggcccuauauagcaaguagaacaucaauaacaggaagggcaugggaaaauacaguuguagacuuagaaucagacggaaaaccccagaaagcaggcaguaacggaucaaauaaaagccuacaaucagcgggauuuacugcaggacuaacauauagccaacuaaugacauuaaaggacgcaauguuacaacuugauccaaaugcaaaaacauggauggauauagaaggacguccugaagauccaguagaaaucgcguuauaccaaccuucaucaggcugcuacauacauuucuucagagaaccaacagaccucaaacaauucaaacaagaugcaaaauacucccacggcauagacguaacagauuuauucgcagcacaaccaggauuaacuucagcugugauagacgcucuaccaagaaauaugguaauuacuugucaaggcucagaugacauaagaaaacuauuugagucacaaggaagaaaagacauuaaauuaauagacaucgcauuaucaaaaacugacucccgaaaauacgaaaacgcuguuugggaucaauauaaagacuuaugccacaugcauacagggauuguaguagaaaaaaaaaaaagaggaggaaaagaggaaaucacuccacacugugcacuaauggacugcauaauguuugacgcugcgguuagcgggggguuaaacacaucgguauuaagagcaguucuaccaagagauauggucuucagaacaucaaccccaagaguaguauuauaa

SEQ ID NO: 2898 - RNA, 1710 nt, Artificial Sequence
  derived and/or modified CDS sequence (opt6) from Lassa virus__AIT17371__NP
augucagcuaguaaagaaauaaaaucauucuuauggacacaaucacuuaggagagaacuuaguggauacuguucuaacauaaagcuacaaguaguaaaagacgcgcaagcacuacuacauggauuagauuucucugaaguuucaaauguccaacgauuaaugagaaaagaaagaagagaugacaacgauuuaaaaagauuaagagauuuaaaucaagcaguaaauaauuuaguagaauuaaaaucuacucaacaaaagagcauacuuagaguaggaacauuaacaucagaugacuugcucauauuagcggccgauuuagaaaaauuaaaaucuaaaguaaccagaacagaaagaccauuaucugcaggaguuuacauggguaacuuaaguucacaacaacuagaucaacgaagagcacuacuaaauaugauaggaaugaguggaucaaaccaaggagcucaagcaggaagagauggaguuguaaggguaugggauguaaaaaacgcugaauuauuaaauaaucaauucggaacuaugccaagucuaacacucgcaugccuaacuaaacaaggucaagucgauuuaaacgacgcaguacaagcguuaacagaccucggacucauauacaccgcaaaauauccaaacacauccgacuuagacagacuaacacaaucucacccaauauuaaacaugauagauacaaaaaaaaguagcuugaauauaucaggcuauaauuucucauuaggagcagcaguaaaagcaggagcauguauguuagacggcggcaauaugcucgaaacuauaaaaguuucaccacaaacuauggauggaauacuaaaaucaauacuaaaaguaaaaaaagcauuagguauguuuauaagcgaugcaccaggagaaagaaauccauaugagaacauauuauauaaaauaugucuaagcggagacggcuggccauacauagcaaguagaacaucaaucaccggaagagcuugggaaaauacaguaguagaccuagaauccgauggaaaaccccaaaaagcaggaucaaauucaagcaauaaauccuuacaaagcgcaggauuuacagcaggauuaacauauagucaacuaaugacucuuaaagaugcaaugcuacaauuagauccaaaugcaaaaacuuggauggacauagagggaagaccagaagacccaguagaaauugcacucuaccaaccaaguucaggcuguuacauacacuucuucagggaaccaacagaccucaaacaauucaaacaagacgcuaaauauagucauggaauagacguuaccgacuuauucgccgcacaaccaggccuaacaagugcaguaauagaugccuuaccccgaaacaugguaauaaccugucaaggaagugacgacauaagaaaacuauuugaaagucaaggaagaaaagacauuaaauuaauagauauagcucuaagcaaaaccgauagcagaaaauacgaaaacgcuguaugggaucaauauaaagaucuaugucauaugcacaccggaauagucguagaaaaaaaaaaaagaggaggaaaagaagaaauaaccccacauugcgccuuaauggacuguauaauguuugaugccgcgguaaguggaggauuaaacacaaguguguuacgagcaguacuaccaagagauaugguauuuagaacaucaacaccaagaguaguacuauaa

SEQ ID NO: 2899 - RNA, 1710 nt, Artificial Sequence
  derived and/or modified CDS sequence (opt6) from Lassa virus__AIT17379__NP
augucagcaaguaaagaaauaaaaaguuuuuuauggacucaaucauuaagaagagaauuaagcggauauugcaguaacauuaaauuacagguaguaaaagacgcacaagccuuguuacacggacuagauuuuagcgaagucucaaacguacaacgacuaaugagaaaagaaagaagggaugacagcgaucuaaaaagacuucgugaccuaaaucaagcagucaauaauuuaguagaacuaaaauccacacaacaaaagucaguauuaagagucggaacacucacaucugaugaccugcuaauauuagcagcagaccuugaaaaacuaaaaagcaaagucacaaggacagaaagaccguuaucagcaggaguauauaugggaaauuuaaguucacaacaauuagaucaaagacgagcacuacuaaauaugauagguaugucaucagggaauagaggagcacaagcaggaagggacggaguaguaagaguaugggauguaaaaaaugcagaacuauuaaauaaccaauuuggaacaaugccuucauuaacacuagcaugccuaaccaaacaaggacaaguugaccuaaaugacgcaguccaagcauuaacagacuuaggacuaauauacacagcaaaauaucccaauaccucagaccuagauagguuaacacaaagccauccaauacuaaauaugguagauacaaaaaaaucgagcuugaacauaagcggcuacaauuuuucucuaggugcagcagucaaagccggagcauguauguuagaugguggaaauauguuagaaacaauaaaaguaucaccccaaacuauggacggaaucuuaaaaucaauacuaaaaguaaaaaaagcauuaggaauguuuauaucagauaccccaggagaaagaaaucccuaugaaaauauacuauauaaaauaugcuugucaggugauggauggccguauauagcaucaagaacaaguauaacaggaagagcaugggaaaauacaguuguagauuuagaaucagauggaaaaccccaaaaagcaggaucaaacaauaguaauaaaagucuucaaagugcaggauucgcagcgggcuuaacauauucccaauuaaugacacuuaaagacgcaauguuacaacuagaucccaacgcaaaaacauggauggacauagaaggacgaccagaagacccaguagaaauagcacuuuaucaaccaagcucaggauguuacauacauuucuuucgagaaccgacagaucuaaaacaauuuaaacaagaugcaaaauauucccauggaauagacguaacagaccuauucgcagcgcaaccgggacucacaucagcaguaauagacgcacuuccaagaaauaugguaauuacaugucaaggaagcgaugacauaagaaaacuacuagaaagucaaggucgaaaagauauaaaauuaauagauauagcacuaagcaaaacagacagcagaaaauaugaaaaugcaguaugggaccaauauaaagaucugugccacaugcauacaggaauaguaguagaaaaaaaaaaaagagguggaaaggaagaaauaacaccacacugcgcauuaauggauugcauaauguuugacgcagcaguaagcggagguuuaaacacaaguguacuaagagcaguuuuacccagagauauggucuuucguacaagcacaccaagagucguauuauaa

SEQ ID NO: 2900 - RNA, 1710 nt, Artificial Sequence
  derived and/or modified CDS sequence (opt6) from Lassa virus__AIT17381__NP
augagugccucaaaagaaauaaaaucuuuuuuauggacucaaagucuuagaagagaacuuucaggauacugcucaaacauaaaacuacaaguaguaaaagaugcccaagcauuacuucauggauuagacuucagugaagucucuaacguacaaagacuaaugagaaaagaaagaagagaugauagcgauuuaaaaagacucagagaucuaaaucaagcaguuaauaacuuagucgaauuaaaaucaacucaacaaaaaagcguacuccgaguaggaacacuaacaucagaugacuuauuaguauuagcagccgaucuagaaaaacuuaaaaguaaaguaacaagaacugaaagaccuuuaagugcaggaguauauaugggaaaccuauccucacaacaacuugaccaacgacgagcucuacuaucaaugauuggaaugucaggaggaaaccaaggagcuagagcaggaagagacggcguaguaagaauaugggacguaaaaaacgcagaauuauuaaacaaccaauuuggaacaaugccaucauuaacauuagcguguuuaacaaaacagggccaagucgacuuaaacgacguaguacaagcauuaacagauuuaggauuaauauacacagcaaaauacccaaacacgucagaucuagacagacuaacacaaagucauccuauauuaaauaugauugauacaaaaaaauccucauuaaacauaucagguuacaauuucucauuaggcgcagccguaaaagcaggugcauguauguuagacggaggaaauaugcuagaaacuauaaaaguaucuccacaaacgauggaugguauacuaaaaucaauccucaaaguaaaaaaagcauuaggaauguucauaucugacacaccuggagaaagaaauccauacgaaaauauacuuuacaaaauaugucuaagcggugacggcuggccauacauagcuagcagaacaucaauuacagguagagcuugggaaaauacaauagucgauuuagaauccgauggaaaaccacaaaaaacaucaaacacaaauucaaacaaaagcuuacaaagcgcaggauuugcagcaggccuaaccuauucacaauuaaugacucuaaaagaugccauguuacaauuagaccccaaugccaagacauggauggauauagaaggaagaccagaagacccaguagaaauagcacuauaccaaccauccucaggauguuauauacacuucuuccgagaaccaaccgaccuuaaacaauuuaaacaagaugcaaaauauucacauggaauagauguaacagaccuauuugcagcacaaccuggacuaacaucagcaguuauagaugcacuacccagaaauaugguuauaaccugucaaggaucagaagacauaagaaaacuacuagaaagucaaggaagaaaagacauaaaacuaauagauauagcacuguccaaaacggacaguagaaaauaugaaaacgcagucugggaccaauacaaagaucuuugccacaugcauaccggaguaguuguagaaaaaaaaaaaaaagggggaaaagaagaaauaacgccacacugcgcauuaauggauuguauaauguuugacgccgcagucucaggaggauuaaacacaagcguacuaagagcaguccuaccaagagacauggucuuuagaacaucaacaccuagaguaguauuauaa

SEQ ID NO: 2901 - RNA, 1710 nt, Artificial Sequence
  derived and/or modified CDS sequence (opt6) from Lassa virus__AIT17389__NP
augagcgcuucaaaagaaauuaaaaguuuucucuggacacaaucuuuaaggagagaauuaucaggauauuguucuaacauuaaacuacaaguaguaaaagaugcacaagccuuacuacacgguuuagauuucucugaaguuucaaauguacaaagacuaaugcgaaaacaaaggagggaugacggagacuuaaaaagauuaagagacuuaaaccaagcaguaaauaacuuaguagaauuaaaaucaacccaacaaaaaucuguauuaagaguaggaacacuaacuagcgaugaccuacuaauuuuagcagcagauuuagaaaaauuaaaaagcaaaguaacgcgcacagaacgaccacuaucagcuggaguauauaugggaaauuuaucaagucaacaacuagaccaaaggagagcccuauuaaauaugaucggaaugaguggcggaaaccaaggagcaaggacaggaaaagauggagucguuagaauaugggaugucaaaaacgcagauuuauuaaauaaucaauucggaacuaugcccuccuuaacacuagcaugccuaaccaaacaaggccagguagacuuaaacgauguaguacaagcacuuacagaccuaggauuaauauauaccgcuaaauauccaaauacaucagacuuagacagauuaacacaaucacacccuauacuaaauaugauagacacuucaaaaagcucacucaacauaaguggauacaauuucucucuuggugcagcaguaaaagccggagcauguauguuagacggaggcaacauguuagaaacaauaaaaguuucaccacaaacaauggauggcauacuaaaaucaauccuaaaaguuaagaaaagucuaggaauguuuauuagcgacacaccaggagaacguaauccuuaugagaauaucuuauacaaaauaugccuaucaggagacggauggccauauauagcaucaagaacaucaauaacaggcagagcaugggaaaacacaguuguugaucuagaaucagauggaaaaccccaaaaagcuggaucgaacaacagcaacaaaagccugcaaucaacagguuuuacagccggcuuaacuuauucacaacuaaugacacuaaaagaugcaauguuacaacuagacccaaacgcuaaaacauggauggauauagaaggaagaccagaagauccaguagaaauagcauuauaucaaccaagcucaggaugcuacauucacuuuuucagagaaccaacagauuuaaaacaauuuaaacaagaugccaaauauucacauggaauagacguaacagauuuauuugccgcacaaccagguuuaacaagugcaguuauagauacccuacccaggaacaugguaauuacaugucaaggaagcgacgacauaagaaaauuacuagaaucccaaggccgaaaagacauaaaacuuauugauauagcacuaaguaaaacagacaguagaaaauacgaaaacgcuguaugggaucaauacaaagauuuaugucauaugcauacaggaguaguaguugaaaagaagaaacgaggcggaaaagaagaaauaacaccgcauugugcacugauggauugcauaauguuugacgcagcaguuucagguggacuaaauguuucaguucuuagagcgguacuaccuagagauaugguauucagaacaucuacaccuagaguuguauuauaa

SEQ ID NO: 2902 - RNA, 1710 nt, Artificial Sequence
  derived and/or modified CDS sequence (opt6) from Lassa virus__AIT17399__NP
augucagcaucuaaagaaauaaaaucauucuuauggacacaaucacuucgaagagaacugagcggauauugcuccaacauaaaacuucaagucguaaaagacgcucaagccuuauuacacggucucgauuuuucagaaguuucuaacguccaacgacuaaugagaaaacaaagaagagacgacucagauuuaaaaagauuaagagaccucaaucaagcagucaauaaucuaguagaacuuaaaucgacacaacaaaaaucaguucuacgaguaggaacacuaacaagugacgaucuauuaguacuagcagcagacuuagaaaaauuaaaaucuaaaguuauaagaacagaaaggccacuaucaucaggaguauacaugggaaacuuaucaucccaacaacuagaccagagaagagcacuacucaacaugauaggaaugagcggaggaaaccaaggcgcgcaaguagggagagauggaguaguaagaguuugggacgucaaaaacgcagauuuacuaaauaaccaauucggaacaaugccaucacuaacacuugcaugucuaacaaaacaaggacagguagaccuaaaugauguaguacaagcacuuacagauuuaggauuaauauauacugcaaaauauccaaauacaucagacuuagacagacuagcucaaucccacccuauccuaaacaugauagacacuaaaaaaucaaguuuaaauauuucaggauacaauuucucacuaggagcagcaguaaaagcaggagcaugcauguuagacggcggaaacauguuagaaacuauaaaaguaacaccacaaacaauggauggaauucuuaaaucaauacuuaaaguaaaaaaagcauuaggcauguuuauaucagaaacaccaggcgaaagaaauccauaugaaaauauacucuacaaaaucugccuaucaggcgacggcuggccauauauagcaucaagaacauccaucacaggaagagcuugggaaaacaccguaguagaccuagaaucagauggaaaaccacaaaaagcuggaaauaauaacucuaacaaaucauuacaaagugcaggcuucacagcaggacuaacauacagucaacuaaugaccuuaaaagauagcaugcuacaauuagauccaaacgccaaaacauggauggacaucgaaggaagaccagaagacccaguagaaguagcauuauaucaaccaucaucaggcugcuacauacauuuuuucagagaaccaacagaucugaaacaauuuaaacaagacgcaaaauauucccacggaauagacguuaccgaccuuuucgcaacccaacccggacuuacaagcgcugucauagaagcacuuccacgcaacaugguaauaacaugucaagguucagaugauauaagaaaauuauuagaaucacaaggucgaaaagacauaaaacucauugauaucgcccuaaauaaaacagacucuagaaaauacgaaaacgcaguaugggaccaauacaaagaucuaugccauaugcauacugguguaguaguagaaaaaaaaaagagaggaggaaaagaagaaauaacaccacacugugcacuaauggacuguauaauguuugacgcggcaguaaguggaggauuaaaaacuuuagcacucagagcuguucuaccgagagacaugguauucaggacaaguacaccaaaaguuguuuuauaa

SEQ ID NO: 2903 - RNA, 1710 nt, Artificial Sequence
  derived and/or modified CDS sequence (opt6) from Lassa virus__AIT17405__NP
augucaguaucaaaagaaguuaaauccuuucuauggacacaauccuuaagaagggaacuuucagguuauuguucaaauaucaaauugcaaguaguaaaagaugcacaagcacuacuacauggucucgacuuuucagaaguaucaaauguacaaaggcuaaugagaaaacagaaaagagaugauagugacuuaaaaagacuacgagaccuaaaccaagcaguaaauaauuuaguagaacucaaaucaacacaacaaaaaucuauacuaagaguaggaacacucacaagugaugaccuacucacccuagcugcagacuuagaaaaauuaaaaucaaaagucauacgaacggaaagaccacuaaguagcggcguuuauauggguaacuuaucuacacaacaauuagaacaaagacgagcauuacucaauaugauagguaugguaggaggagcacaaggaacacaaccaggaagagauggaguaguaagaguuugggauguuaaaaacccagaucuacucaauaaucaauucgguacuaugccaagccuuacacuagcuugcuuaacaaaacaaggacaaguagacuuaaacgacgcaguucuagcauuaacagauuuagguuuaauauacacagcaaaauauccaaauucaucagaccuagacagacuaucacaaucacauccaauacuaaacaugguagauaucaagaaaucaucauuaaauauaagcggauacaauuucucauuaggcgcagccguaaaagcaggggcauguaugcucgaugguggaaauaugcuagaaaccauaaaaguaacaccacaaacaauggacggaauacuaaaaucaauauugaaaguuaaaagaucauuaggaauguuuguuucagauacaccuggugaacgaaauccauacgaaaacaucuuauauaaaauaugcuuaucaggagacggauggccauacauagcuucaagaacaucgauaguaggacgagcaugggaaaauacaacaguagaucuagaaucagauggaaaaccacaaaaagugggcagcgcaggaaguaacaaaucauuacaauccgccggauuucccacaggcuuaaccuauucccaacuaaugaccuuaaaagauuccaugaugcaauuagauccaucagcaaaaaccuggauagauauagaaggaagaccagaagacccagucgaaauagcauuauaccaaccuaugucuggauguuacauacacuuuuucagagaaccaacagaccucaaacaauuuaaacaagaugcaaaauauagucaugguauagauguagcagaucuauuucccgcccaaccuggacuaacaagcgcagucauagaagcacuaccuagaaacaugguauuaaccugccaaggaagugaugauauuaaaagauuacuagauucacaagguagaagagacauaaaauuaauagauauugcacuaucaaaagcagacucaagaagauucgaaaaugcuguaugggaucaaugcaaagauuuaugucauaugcauacuggaguaguagucgagaaaaagaaaagaggagguaaagaagaaauaacaccacacugugcacuaauggauugcauaauguaugaugcugcaguuuccggaggauuaaacaucccaguucuaagagccguauuaccacgagauaugguauucagaacaagcucaccuaaaguuguauuauga

SEQ ID NO: 2904 - RNA, 1710 nt, Artificial Sequence
  derived and/or modified CDS sequence (opt6) from Lassa virus__AIT17409__NP
augucagcaagcaaagaaguaaagagcuucuuauggacccaaucacuaagaagggaauuaucuggauauugcaguaauauaaaacugcaaguuguaaaagacgcacaagcucuauuacauggacuagauuucucagaaguuucuaauguacaaagguuaaugagaaaacagaaaagagaugauggagaucuuaaacgauuaagagaucuaaaucaagcaguaaauaaccuaguagaacuuaaaaguacacaacaaaaaucaauauuaagagugggaacccucacgucagaugaccuauuaacacuagcagcagaucuagaaaaauuaaaaucaaaaguaauaaggacugaacgaccacuaucaucaggaguuuauaugggaaaccucucaacgcaacaauuagaacaaagacgagcuuuauuaaauaugauaggaaugguaggaggagcucaaggcacucaaccaggaagagacggaguugugagaguuugggacgucaaaaacccagauuuacuaaauaaucaauuuggaacaaugccaucauuaacauuagcaugccuaaccaaacaaggacaaguagaccuuaaugacgccguacuagcacuaacagaccuaggauuaauauacacagcuaaauaucccaauagcucagaccuagauagauuaucacaaucacauccuauacuaaauaugguagauacuaagaaaucaucccuaaacauaagcggauauaauuucaguuuaggagcagcaguaaaagcgggugcauguauguuagacggaggaaauaugcuagaaacaauaaaaguaacgccacaaacaauggauggcauauuaaaaucaauccucaaagugaaaaagagcuuaggaauguucguaucagacacaccaggugaaagaaacccauaugaaaauauauuauacaaaauaugcuuaaguggcgauggauggccauauaucgcaagucgaacaaguauuguagguagagcaugggaaaauacaacaguugaucuagaaagcgacggaaaaccucaaaaaguaggaacagcagguucaaauaaaaguuuacaaucagcaggcuucccaacaggacuaacuuauucucaacuaaugacucuaaaagacaguaugaugcaacuagauccaucagcaaaaacauggauagauauagaaggaagaccagaagacccaguagaaauagcauuauaucaaccuaugucagguuguuacauucacuuuuucagagaaccaacagaucuaaaacaauucaaacaagacgccaaauauucacacggaauagauguaacagauuuguucagcgcucaaccaggacuaacaucagcaguaaucgaagcauuaccaagaaauaugguacuuacaugccaaggaagcgacgauauaaaaagacuauuagacucucaaggaagaagagacauaaaauuaauagacauagcauuaaauaaagcagauucaagaagauuugaaaaugcaguaugggaccaaugcaaagauuuaugucacaugcauacuggaguaguaguagagaaaaagaaaagaggaggaaaagaagaaauaaccccacauugugccuuaauggauuguauuauguaugacgccgcaguuaguggcgguuuaaauauaccaguacuuagagcgguacuaccaagagauaugguguucagaaccucaucaccaaaaguaguacuauaa

SEQ ID NO: 2905 - RNA, 1710 nt, Artificial Sequence
  derived and/or modified CDS sequence (opt6) from Lassa virus__AIT17413__NP
augagugcuaguaaagaagucaaaucauuuuuauggacacaaucauuaagaagagaguuaaguggauauugcucaucgauaaaacuacaaguuguaaaagacgcucaagcauuauuacauggauuagacuucucagaaguaucaaacguacaaagacuaaugagaaaacaaaaacgagaugauucagauuuaaaaagauuaagagauuuaaaucaagcaguaaacaauuuaguagaauuaaaaucaacucaacaaaaaucuauucucagaguagggacccuaacaagcgacgacuuacuuacauuagcagcagaucuagaaaaauuaaaaucaaaagugauaagaacagaaagaccucuaagcucaggaguuuacaugggcaacuuaaguacacaacaauuagaacaacguagagcauuauugaacaugauaggaaugguaggaggagcucaaggaacacaaccaggaagagauggaguaguaagaguaugggaugugaaaaacccagaucuucugaauaaucaauucggaacaaugccaucacuaacuuuagcaugccuaacaaaacaaggucaaguagacuuaaaugaugcaguacuagcuuuaacagaucuaggccuaauauacacagcaaaauauccaaauucaucugaucuagacagauuaucacaaagucacccuauauuaaacaugguagacaccaagaaaagcucauuaaacauaaguggauauaauuuuagucuuggugcagcuguaaaagcaggagccuguaugcuagaugggggaaauauguuagaaaccauaaaaguaacaccacaaacuauggacggaauauuaaaaaguauauuaaaagucaaacgaaguuuaggaauguucguaagcgaugccccaggugaaagaaacccauaugaaaauauuuuauacaaaauaugcuugucaggugacggauggccauacaucgcaucaagaaccucaauaguagguagagccugggaaaauacaacuguagaccuagaaucagauggaaaaccacagaaaaugggaacagcaggaaguaauaaaaguuuacaaucagcgggauucccaacaggauuaacauacagccaacuaaugaccuuaaaagacaguaugaugcaauuagauccuagugccaaaacuuggauagauauagaaggcagaccagaagacccaguagaaauagcauuauaccaaccaaugucaggauguuacauacauuucuuuagagagccaacugaccuaaaacaauuuaaacaagaugcaaaauacagccacggaaucgauguagcagauuuauuuccagcacaaccaggucucaccucagcaguaauagaagcacuaccuagaaauaugguacuaacaugccaaggaagcgaugauauaaagaaauuauuagauucacaagguagaagagacauaaaacuaauagauauugcuuuaagcaaagcagauucuagaagauuugaaaacgccguuugggaccaauguaaagauuuaugccauaugcauacaggagucgucguagagaaaaagaaaagaggaggaaaagaagaaauaacaccacauugugcauuaauggacugcauuauguacgaugcagcaguaaguggaggguuaaacaucccaguauuaagagcaguacuuccaagagauaugguuuuuagaacaaguucaccaaaaguagugcuauaa

SEQ ID NO: 2906 - RNA, 1710 nt, Artificial Sequence
  derived and/or modified CDS sequence (opt6) from Lassa virus__AIT17421__NP
augucagcaucaaaagaagugaaaucauuucuauggacacaaucacuaagaagagaauuaucaggauacugcaguaacauaaaacuacaaguaguaaaagacgcacaagcuuuacuccauggucuggauuucagcgaaguaucaaauguacaaagacuuaugagaaaacaaaaaagagacgauagcgaucuaaaaagauuaagagaucuuaaucaagcaguaaacaacuuaguagaacucaaaagcacacaacaaaaaucaaucuuaagaguaggaacauuaacuuccgaugaccuauuaacucuagcagcagauuuagaaaaauuaaaaaguaaaguaauaagaaccgaaagaccauuaaguagcggaguauauaugggcaacuuaagcacacaacagcuagaacaacggcgagcacuauuaaauaugauaggaaugguauccggagcucaaggaacccaaccaggacgagauggaguaguuagagucugggacguaaaaaacccagaccuauuaaacaaccaauucggaacaaugccgucauuaacacuagcauguuuaacaaaacaaggacagguagaucucaaugacgcaguauuggccuuaacagauuuagguuuaauauacacugcaaaauauccaaauagcagugaccuagacagacuuucgcaaagccacccaauauuaaauaugguagauauaaaaaaaagcagcuuaaauauaucaggauacaacuucucacuaggagcagcuguaaaagcgggugcauguaugcuagaugguggaaauaugcuugaaacaauaaaaguaacaccacaaacaauggaugguauacucaaaucaauauugaaaguaaaaagaucacuaggaauguuuguaagcgauacaccaggagaaagaaauccauaugaaaauauauuguacaaaauuugucuaaguggagauggauggcccuauauagcaaguaggacaucaauagucggaagagcaugggaaaauacaaccguagaucuagaaagcgauggaaaaccucaaaaaaugggaagugccggaaguaauaaaucccuacaaagugcaggauuuccaacaggacuaacauauucacaauuaaugacauuaaaagacagcaugaugcaacuagacccaagugcaaaaacauggauagacauagaaggaagaccagaagauccgguggaaauagcacuauaccagccaauguccggauguuacauacauuucuucagagaaccaacagauuuaaaacaauuuaaacaggacgccaaauauagucauggaauugauguagcagacuuauucccugcucaaccaggccuaacaucagcaguuaucgaagcacuaccaagaaacaugguacuaacuugucaaggaucugaugacauaaaaagacuucuagauucacaaggccgacgagauauaaaauuaauagacaucgccuuaaguaaagcagauucccgaagauucgaaaacgcaguaugggaccaaugcaaagaucuaugccacaugcacaccgguguaguaguagaaaaaaaaaaacgaggggguaaagaagaaauaacaccacauugcgcccugauggauugcauaauguacgacgcggcaguaaguggaggauugaauauaccaguauuaagagcaguauuaccuagagauaugguauucagaacaucaaguccaaaaguaguauuauaa

SEQ ID NO: 2907 - RNA, 1710 nt, Artificial Sequence
  derived and/or modified CDS sequence (opt6) from Lassa virus__AIT17425__NP
augucagcaaguaaagaaguaaaaucauucuuauggacgcaaucacuaagaagggaauugucuggauauugcucaaguauaaaacuucaaguagucaaagaugcacaagcauuauuacacgguuuagauuuuagugaaguaucaaauguacaaagacuaaugagaaaacaaaaaagagacgauagugauuugaaaagacuacgagaccucaaucaagcagucaacaaccuaguagaacuaaaaucaacucaacaaaaaucaauacuaagaguagggaccuuaaccagugaugaccuacuaacauuagcagcagaucuugaaaaauuaaaaucaaaaguaauaagaaccgaaagaccauuaaguucaggagucuauaugggaaaucuaucaacacaacaacuagaacaaagaagagcacuccuuaauaugauaggcauggugggaggugcacaaggaacacaaccuggaagagauggagucguaagaguaugggacgucaaaaacccagaccuacuaaauaaccaauucgguacaaugccaucauuaacacucgcaugcuugacaaaacaaggacaaguagacuuaaaugaugcgguacuagcauuaacagaccuaggauuaauauauacagcaaaauacccuaauaguucagacuuagacaggcuaagucaaucacacccaauauuaaacaugguugacacaaaaaaaucuucauuaaacauaucaggcuacaauuucagccuaggagccgcaguuaaagcaggagcauguauguuagacggaggaaauauguuagaaacaauaaaaguaacaccacaaaccauggauggaauacuaaaaucuauuuugaaaguaaaaaaaagcuuaggaauguucguaucagauacaccaggagaaagaaacccauacgaaaauauuuuguauaaaauaugucuauccggcgauggauggccuuauaucgcaaguagaacaaguaucguaggcagagcaugggaaaauaccaucguagauuuagaaucagauggaaaaccccaaaaaguuggaacagcagguaguaacaaaagccuccaaucagcaggauucccaacaggacuaacauauucacaacucaugacauuaaaagauaguaugaugcaacuagacccaucugcaaaaacauggauagacauagagggcagaccagaagacccuguagaaauagccuuauaucaaccaaugaguggauguuauauccauuuuuuuagagaaccaacagaccuaaaacaauucaaacaagacgcaaaauacagucacggcaucgauguagccgauuuauuuccagcacaacccggauuaacuucagcaguaaucgaagcauuacccagaaauaugguacuaacaugucaaggaagcgaugauauaaagagacuauuagauucacaaggaagaagagauauaaaauuaauagacauagcucuaaguaaggcagauucuagacguuucgaaaacgcaguaugggaccaaugcaaagacuuaugccauaugcacacagguguaguuguagaaaaaaaaaaaaggggaggcaaagaagaaauaacaccacauugugcccucauggacugcauuauguaugacgcugccguaaguggaggacuuaauauaccaguauuaagagccguuuugccaagagacaugguauuuagaaccucuagcccaaaaguaguacuuuga

SEQ ID NO: 2908 - RNA, 1710 nt, Artificial Sequence
  derived and/or modified CDS sequence (opt6) from Lassa virus__AIT17429__NP
augucagcaucaaaagaaguaaaaaguuuuuuauggacacaaagucuaaggcgagaauuaaguggauacugcucaaauauaaaauuacaaguaguaaaagaugcacaagccuuacuacauggcuuagauuuuuccgaagugaguaacguucaaagauuaaugagaaaacaaaaaagagacgauagugauuuaaaaagacuaagagauuuaaaccaagcaguaaauaaccuuguagaauuaaaaucaacccaacaaaaaaguauacuuaggguaggaacacuaacaucugaugacuuauuaacacuagcagcugaccuagaaaaauuaaaaucaaaaguaauaagaacugaaagaccauuauccagcggcgucuauaugggaaauuuauccgcacaacaauuagaacaaagaagagcacuauuaaacaugauaggaaugguaggaggagcacaaggaacccaaccaggaagagacggaguaguaaggguaugggauguuaaaaacccagaccuacuaaauaaccaauucggaacaaugccuaguuuaaccuuagccugucuaacuaaacaaggacaaguugaucuaaaugacgcaguacuagccuuaacggaucuaggauuaauauauacagccaaauacccgaacucaagcgacuuagauagauuaagccaaucacacccaauacuaaacauggucgacaccaaaaaaagcagucuaaacauaucaggauauaauuuuagcuuaggagccgcaguaaaagcaggagcuuguauguuagacggcggaaauauguuagaaacaauuaaagucacuccacaaacaauggacggaauacuaaaaaguauuuuaaaaguaaaaagaucauuaggaauguucguaagugacgcaccgggagaaagaaaucccuaugagaauauacuauacaaaauaugucuuaguggagacggauggccauauauagcaagcagaacuagcauaguuggaagagccugggaaaauacaacaguugaucuugaauccgacggaaaaccccaaaaaguagguacagcgggaucuaacaaaagcuuacaaucagcagguuucccaacaggacuuacauauucacagcuaaugacuuuaaaagacucaaugaugcaauuagaccccucagcuaaaacauggauugauauugaaggaagaccagaagauccuguagagauagcauuauaccaaccuaugucaggaugcuauauacacuuuuucagagaaccaaccgauuuaaaacaauucaaacaagacgcaaaauauucacauggaauagacguagcagaccucuucccagcacaaccaggauuaacaagugccguaauagaagcauuaccccgaaauaugguacuuacaugucaaggcagugacgacauaaaaagacuauuagacucacaaggaagaagagacauaaaauuaauagauauagcauuaagcaaagcagacagccgacgauuugaaaaugccguaugggaucaaugcaaagaccuuugccauaugcacacaggaguuguaguggaaaaaaaaaaaagaggagggaaagaagaaauaacaccucacugugcacucauggauuguauaauguacgacgccgcaguaaguggggguuuaaauauuccaguguuaagggccguacuaccaagagacauggucuucaggacaucaucaccaaaaguuguauuauaa

SEQ ID NO: 2909 - RNA, 1710 nt, Artificial Sequence
  derived and/or modified CDS sequence (opt6) from Lassa virus__AIT17431__NP
augagugcaagcaaagaaguuaaaucuuucuuauggacucaaucauuacgacgugaacuaucuggauauuguucgaauauaaaauuacaaguaguaaaagacgcccaagcauuacuacacggauuagauuuuucagaaguaaguaauguacagagauuaaugagaaaacaaaaaagagacgauucagaccuaaaaagauuaagagaucuaaaccaagcaguaaauaaucuuguugaacuaaaaucaacucaacaaaaaagcaucuuaagaguagguaccuuaacaagugaugauuuauuaacucuagcagcagaucuagaaaaauuaaaaagcaaaguuauaagaacagagagaccacucagcucagguguuuacaugggaaaucuaucaacacaacaauuagaacaacgacgagcauuacuaaauaugauagggauggugggaggagcucaaggaacacaaccaggcagagacgguguuguacgaguaugggauguuaaaaacccagaccuacuuaacaaccaauucggaaccaugccaagucuaacacucgcauguuuaacaaaacaaggacaaguagauuuaaaugaugcgguguuagcuuuaacagaccuaggauuaauauauacagcaaaauacccaaauucaagugaccucgacagauuaucucaaucacacccaauauuaaauaugguagacacaaaaaaaaguucauuaaauauaucagguuucaacuucagccuaggugcagcaguaaaagcaggcgcauguauguuagauggaggaaauauguuagaaacaauaaaagugacaccacaaacaauggacggaauacuaaagucgauacuuaaagugaaaaaaucgcuaggcauguuuguaucugacacuccuggcgaaagaaauccuuacgagaacauuuuauauaaaauauguuuaucuggagacggauggccauacauagcaagcagaacaaguauaguuggaagagcaugggaaaauacaacaguagaccuagaaagugacggaaaaccacaaaaaguagguaccgcaggaucaaacaaaagucuacaaagugcaggcuucccaacuggacuaaccuauagucaauuaaugacauuaaaagauaguaugaugcaauuagauccaagugcgaaaacauggauagacaucgaaggaaggccagaagaccccguagaaauagcauuauaucaaccaaugaguggauguuacauacacuuuuuuagagagccaacagaucuaaaacaauuuaaacaagacgcaaaauacagucauggaauagaugucgcagauuuauuuccagcccaaccaggacuuacaucagcagucauagaagcauuaccaagaaauaugguacuaacaugccaagguucugaugauauaaaaagacuauuagauagccaaggaagaagagacauaaaacuaaucgacauagccuuaucaaaagcagacagcagacguuuugaaaaugccguaugggaucaaugcaaagaucuaugccauaugcauacaggaguuguaguagaaaaaaaaaaaaggggaggaaaagaagaaaucacaccacauugugcacuaauggauugcauaauguacgacgcagcuguaagcggagguuugaacauuccaguauuaagggcaguacuaccaagagauaugguuuucagaacagcaucaccaaaagucguccuuuaa

SEQ ID NO: 2910 - RNA, 1710 nt, Artificial Sequence
  derived and/or modified CDS sequence (opt6) from Lassa virus__AIT17439__NP
auguccgccucaaaagaaguaaagucauuccuauggacacaaagucuaaggagagaauugaguggauacugcaguucaauaaaauuacaaguaguaaaagacgcacaagcacuacuacacggucuagacuuuagugaaguaucaaauguacaaagauuaaugagaaaacaaaaaagagaugauagcgaccucaaaagacuaagggacuuaaaucaagcaguaaacaacuuaguagaauuaaaaucaacacagcaaaaaucaauccuaagaguaggaacauuaacaucagacgaucuccuaacauuagcagcagaucuugaaaaauuaaaaucaaaaguuauaagaacagaaagaccauuaucaucaggagucuacaugggaaacuuaagcacucaacaauuagaacaaagaagagcauuauugaauaugauaggaaugguaggaggcgcacaagguacacaaccaggaagagacgguguaguacgcguaugggauguuaaaaauccagacuuauuaaacaaucaauuuggaacaaugccaucauuaacauuagcaugccuaacaaaacaaggccaaguagaccuaaacgaugccguacuagcuuuaacagaccucggauuaauauauacagcaaaauauccaaauagcagugaccucgaccgacucucacaaucucacccaaucuuaaacaugguagacacaaaaaaaucaagcuugaauauaucuggauuuaauuuuagcuuaggugcagcaguuaaagcgggagccuguaugcuagauggagguaacaugcuagaaacaauuaaaguaacgccacaaacgauggauggaauacuaaaaaguauacuaaaaguuaaaagaucauuagguauguuugugagugauacacccggagaaagaaauccauaugaaaauauacuuuauaaaauaugccuaucgggagaugguuggccuuauauagcaucacgaaccaguauagucggaagggcaugggaaaauaccacaguugauuuagaaucagauggaaaaccccaaaaaaugggaacagcaggaaguaauaaaagucuacaaagcgcaggcuuuccaacagguuuaacauacucacaauuaaugacauuaaaagacucaaugaugcaacuagauccaagcgcaaaaacauggauagauauagaaggaagaccagaagacccaguagaaauagccuuauaucaaccaguaucaggcuguuacauacauuucuuuagagaaccaacagaucuaaaacaauuuaaacaagacgcaaaauauucacaugguauagaugucgcagaucuauuuucagcgcaaccaggauuaacaucagcugugauagaagcacuuccaagaaauaugguauuaacuugccaggguucagaugacauaaaaagauuacuagacucacagggcagaagagauauaaaacuaauugauauagcucuaucaaaagcagacagucgaagauucgaaaacgcaguaugggaccaauguaaagauuuaugccauaugcauacaggaguaguaguagaaaaaaaaaaacgaggaggaaaagaagaaauuacgccucacugugcacuuauggauuguauaauguaugaugcagcugugucaggaggacuaaacauacccguauuccgagcaguauuaccaagagauaugguauuccgaacuaguagcccaaaaguuguauuauaa

SEQ ID NO: 2911 - RNA, 1710 nt, Artificial Sequence
  derived and/or modified CDS sequence (opt6) from Lassa virus__AIT17443__NP
augagugcaagcaaggaagucaaaucauuccuauggacacaaagucuaagaagagaacucucuggauauuguucaaguauaaaauuacaaguaguaaaagacgcucaagcacuuuuacacgguuuagacuucagugagguaucaaauguacagagauuaaugagaaaacaaaaaagagacgauucagauuuaaaaagacucagagaucuuaaucaagcaguaaacaaucuagucgaauuaaaaaguacucaacagaaaucaauauuaagaguaggaacacuaacaucagacgaucuacuaacgcuugccgcagaucuagaaaaauuaaaaucaaaaguaauacgaacagaaagaccuuuaagcagcggaguauauaugggaaaucuauccacacaacaauuagagcaaagaagagcacuguuaaacaugauagguauggucggaggugcacaagguacucaaccuggucgagacggagucguaagaguaugggauguuaaaaacccagacuuacuaaauaaccaguucgguacuaugcccagucuaacauuagcuugccuuacaaaacaaggacaaguagacuuaaacgaugccgugcuagcacucacagacuuagguuuaauauauacagcaaaauauccaaauucaucagauuuagacagauuaucacagucacauccaauacucaacaugguggacacaaaaaaaucuucacucaacauaagcgguuauaauuucucccuaggagcagcaguaaaagccggugcaugcauguuagauggcggaaauauguuagaaacaauaaaaguaacaccccaaacuauggauggaauauuaaaaucaauacucaaaguaaaaagaucauuaggaauguuuguaagugacgcaccaggcgaacgaaacccuuaugaaaauauauuauauaaaauaugucuaaguggagacgguuggcccuauauagcaucacgcacaaguauaguaggcagagcaugggaaaauacaacaguugauuuagaaucagaugguaaaccacaaaaaguuggcacagcaggaaguaauaaaaguuuacaaucugcgggcuuuccaacaggacucacauauucacaacuuaugacacuaaaagacucaaugaugcaacuagauccaagcgcaaaaacauggauagacauagaaggaagaccagaagacccaguggaaauagcucuauaccaaccaaugucaggaugcuacauacacuuuuucagagagccaacugaucuaaaacaauuuaaacaagaugccaaauauucacauggaauugauguugcugauuuauuuccagcccaaccaggcuugacaucugcaguaauagaagcauuaccuagaaacaugguauuaaccugucaaggaucagaugauauaaaaaaauuauuagauagccaaggaagacgagacauaaaacuaauagauauagcacugucgaaagcagauucacguagauuugaaaacgcaguaugggaccaauguaaagaccuaugucacaugcauaccggaguaguaguagaaaaaaaaaaaagaggaggaaaagaagaaauaacaccacacugugcauuaauggauuguauaauguaugacgcagcaguaucaggaggacuuaauauaccaguauuacgagcaguacuaccaagagacaugguauucagaacaaguagcccaaaaguaguauuauaa

SEQ ID NO: 2912 - RNA, 1710 nt, Artificial Sequence
  derived and/or modified CDS sequence (opt6) from Lassa virus__AIT17447__NP
augucggccuccaaagaaguuaaaucauuucuauggacacaaucacuccgaagagaacuaaguggauacugcucaaacauaaaacuacaaguaguaaaagaugcucaagcauuauuacacggcuuagauuucucagaaguauccaacguucaaagacuaaugagaaaacaaaaaagagaugacagugaccugaaaagauuaagagauuuaaaccaagcaguaaauaaucuaguagaacuaaaaucaacccaacaaaaaucaauacuaagaguagggacauuaacaagugacgaccuauuaacacucgcugcagaccuagaaaaacugaaaagcaaaguaauacgcacagaacguccuuuaagcucaggaguauauaugggaaaccuaucaacacaacaacuagaacaaaggagagcgcuauuaaauaugauaggaaugguugggggagcgcaaggaacccaaccaggaagagacgggguaguaagaguuugggacguaaaaaacccagaccuacuaaauaaucaauucggaacaaugccuagucuaacauuggcaugucuuacaaaacaaggacaaguagaccuaaaugacgcuguacucgcccuuacagauuuaggauuaaucuacacagcaaaauauccaaauagcagcgaucuagauagacuaucacaaucacauccaauacuaaauauggucgauacaaaaaaaaguucuuuaaauauaucuggauacaauuucagccuaggugcugcagucaaagcaggagcauguaugcuagauggcggcaacaugcuagaaacaaucaaaguaacaccacaaaccauggacggcauauuaaaaaguauccuaaaaguaaaaaaaucauuaggaauguuuguaagcgacacaccaggcgaacgaaacccauaugaaaauauauuauauaaaaucuguuuaucaggagacggauggcccuauauagcaucaagaaccucaauuguaggaagagcaugggaaaacacaacaguagaucuagaaucugaugguaaaccacaaaagguaggaacaacaggcuccaacaaaucauuacaaucagcaggauuuccgacaggacucacauacucacaacuaaugacucucaaagauaguaugaugcaauuagaccccagcgccaaaacauggauagacauagaaggaagaccagaagacccaguugaaauugcauuauaccaaccaaugucagguugcuauauacauuucuuuagagaaccgacagaucuaaaacaauuuaaacaagaugcaaaauauucucacggcauagauguaacagauuuauuccccgcacaaccaggacuaacaagugcaguuauagaagcauuaccaagaaacaugguauuaacaugccaaggaagcgaugauauaaaaagacuacuagacucacaaggaagacgagauauaaaacuaauagacauagcacuaagcaaagcugacucaagaagauucgaaaacgcaguaugggaucaauguaaagaucuaugccacaugcacacaggcguaguagucgaaaaaaaaaaaagaggagguaaagaagaaauaacuccgcacugugcacuuauggauugcaucauguaugaugcagcaguaucaggaggauuaaacauacccguucuaagagcuguuuuacccagagacaugguuuucagaacaucaucaccaaaaguaguacuauaa

SEQ ID NO: 2913 - RNA, 1710 nt, Artificial Sequence
  derived and/or modified CDS sequence (opt6) from Lassa virus__AIT17451__NP
augagcgcaucuaaagaaguaaaaucauuccuauggacacaaagccuaagacgagaacuuucugguuauugcucaaauauaaaauuacaaguuguaaaagacgcacaagcucuauuacauggauuagacuucucagaaguaucuaauguccaaagacuaaugcgaaaacaaaaaagagaugauuccgaucuuaaaagauuacgagaccuaaaccaagcuguaaauaacuuaguagaauuaaaaagcacacaacaaaaaucaauacuacgaguaggaacuuuaacaagcgaugacuuacuaacuuuagcagccgauuuagaaaaauuaaaauccaaaguaauaagaacagaaagaccuuuaucaucaggaguauauauggguaacuugucaacacaacagcuagaacaaagaagggccuuacuaaauaugauaggaauggugggcggagcacaaggaacacaaccaggaagagacggaguaguuagaguaugggauguaaaaaauccagacuuacuuaauaaccaauucggaacaaugccaagcuuaacacucgcauguuuaacaaaacaaggacaaguagacuuaaacgacgcagucuuagccuuaacagauuuaggauuaauauauacagccaaauuccccaauucaucagaucuugaccgacuaagccagagccauccaauuuuaaacaugguagauacaaaaaaauccagcuuaaacauaagcgguuacaacuucaguuuaggagccgcaguaaaagccggcgcaugcaugcuggauggaggaaauaugcuagaaaccauaaaaguaaccccucaaacaauggauggaauacuaaaaagcauacuaaaggucaaaaaaucauuaggcauguuugucucugacacacccggcgaaagaaaucccuaugaaaacauacuguacaaaauauguuuaucaggcgacggauggccauacaucgcaucaagaacaucaauaguaggaagagcuugggaaaauacaacaguagaucuagaaucagaugguaaaccacaaaaaguuggcacaacagguucaaauaaaagucuacaaucagcaggauuuccaacuggguuaacauacucacaauuaaugacacuaaaagauucaaugaugcaauuagauccaucagcaaaaacauggauagauaucgaaggaagaccagaagacccuguagaaauagcacuuuaucaaccaaugucaggauguuauauacauuuuuuuagagaaccaacagaucuaaaacaauuuaaacaagacgcaaaauauagucacggaauagacguagcagaucuauuuccagcucaaccaggauuaacuucagccguaauagaagcauuaccaaggaauaugguauuaacgugccaaggaucagaugacaucaaaagacuacucgacucacaaggaagacgugauaucaaacuaauagacauagcacuaucaaaagcagauucaagaagauuugaaaaugcaguaugggaccaaugcaaagacuuaugccauaugcauacugguguaguaguagaaaaaaaaaaaagaggugguaaagaagaaauaacaccccacugugcauuaauggauugcauaauguaugacgcagcaguaagcggaggacugaacauuccaguacuacgagcaguauuaccaagagacaugguauucagaacaucaucaccaaaaguaguauuauaa

SEQ ID NO: 2914 - RNA, 1710 nt, Artificial Sequence
  derived and/or modified CDS sequence (opt6) from Lassa virus__AIT17455__NP
augagugcaagcaaagaaguuaaaagcuuccuauggacucaaucacuaaggagagaauuaagugguuacugcaguucaauaaaauuacagguuguuaaagacgcacaagcauuauuacacggacuugauuucucagaaguauccaauguacaaagacuuaugcguaaacaaaaacgcgacgacucagaucucaaacgauuaagagauuuaaaccaagcaguaaauaaccuaguagaauuaaaaucaacacaacagaaaaguguauuaagaguaggaacuuuaacaucagacgacuuacuaacuuuagcagcugauuuagaaaaacuuaaaucaaaaguaauuagaacagaaagaccauuaucaucaggaguauauaugggaaacuuaucaacucagcaacuagaacagagaagagcacuauuaucaaugauaggaaugguaggaggagcacaaggaacacaacccggaagagacgguguaguacgcguaugggacguuaaaaauccagauuuauuaaauaaccaauucggaacaaugccuucacuaacauuagcauguuuaacaaaacaaggacaaguugacuuaaacgacgcaguacuagcauugacagaccuaggguuaauauauacagcaaaauauccaaauucaucagaccuagacagauuaagccaaagccaucccauucugaauaugguagacacaaaaaaaucaucucuuaauauauccggauacaauuuuucacuaggagccgcaguaaaagcaggggcaugcaugcuagauggagguaauaugcuagaaaccauuaaagucacaccacaaacaauggacgggauauuaaaaucaauucucaaaguaaaaagaucacuaggaauguucguaucagauacaccuggcgaaagaaauccauaugaaaauauacucuacaaaauauguuuaucaggagauggauggccauauauagcuagcagaacaucaauaguagguagagcuugggaaaacaccacaguagaccuagaaagugauggaaaaccacaaaaaguuggaacggcaggaaguaauaagagucuacaaucagcaggauuuccaacaggacucacauauucccaauuaaugacauuaaaagauucaaugaugcaacuagacccaucagcaaaaacauggauagauauagaaggaagaccagaagauccuguagaaauagcauuauaucaacccaugucaggauguuacauacacuuuuucagggaaccaacugaccuaaaacaauuuaaacaagacgcuaaauauucacauggaauagacguugcugauuuauuuccugcacaaccaggacuaacaucagcaguaauagaagcauuaccaagaaacaugguauuaacaugccaaggaucagaugacauaaaaagauuauuagauucacaaggaagaagagauauuaaacuaauagauauagcccuauccaaagcagacucaagacgauuugaaaaugcuguaugggaccaauguaaagacuuaugccacaugcacacaggaguaguuguagaaaaaaaaaaacgaggaggcaaagaagaaauaaccccacauugugcgcuaauggauuguauaauguaugacgcagcuguaucagguggcuuaaacauuccaguauuacgcgccguacuuccucgagauaugguauuucguacaagcuccccuaaagugguacuguaa

SEQ ID NO: 2915 - RNA, 1710 nt, Artificial Sequence
  derived and/or modified CDS sequence (opt6) from Lassa virus__AIT17459__NP
augagugcaucaaaagaaguaaaaagcuuucuauggacacaaucacuaagacgggagcuaucaggauacuguuccagcauuaaauugcaaguaguuaaagacgcucaagcauuacuacauggguuagauuuuucagaaguaucaaauguacaaagacuaaugagaaaacagaaaagagaugauagugaucuaaaaagacuacgagauuuaaaucaagcaguaaacaaccucguagaauuaaaauccacacaacaaaaaucaaucuuaagaguaggaacauuaacaucagaugaccuacuaacucuagcagcagauuuagaaaaacuaaaaagcaaaguaauuagaaccgaaagaccccuaucaucaggaguauacaugggaaauuuaaguacucaacaauuagaacaaagaagagcauuacuaaauaugauagguaugguaggcggagcucaaggaacacaaccaggaagggacggugucguaagaguaugggacguaaaaaacccagaccuauuaaacaaccaauuuggaacaaugcccagcuuaacacuagcaugucuaacaaaacaaggacaaguagacuuaaacgaugcuguacuagcguuaacggaccuagggcuaauauacacagcaaaauauccuaauucaagugauuuagaucgacuaagucaaagccacccaauauuaaacauggucgauacuaaaaaaucaaguuuaaacauuucagguuacaauuuuucacuaggagcagcaguaaaagcaggcgcaugcaugcuugacggagguaauaugcuagaaacaauaaaaguaacaccacaaaccauggauggaauauuaaaaucgauauuaaaaguaaaaagaagccuaggaauguuuguuucggauacaccaggagaacgaaauccauacgaaaacauacuauauaaaauauguuuaucaggagacggauggccauauauagcaagcagaaccucaauuguaggcagagcuugggaaaacacaacaguagaccuagaaagcgaugguaaaccacaaaaaaugggcacagcagguagcaacaaaagucugcaaucagcuggauuuccaacaggacuuacuuauucacaauuaaugacauuaaaagauaguaugaugcaacuagacccaucagcgaaaacguggauagacauagaaggcaggcccgaagauccagucgaaaucgcucuauaucaaccaguuaguggaugcuauauucacuucuuuagagaaccgaccgacuuaaaacaauuuaaacaagacgcaaaauacucucauggaauagacguagcagauuuauuuccagcacaaccaggauuaacaucagcuguuauagaagcauuaccuagaaauaugguauuaacaugucaagguucugaugauauaaagagauuauuagacucacaaggaagaagggacauaaaacuuauagauaucgcacuaagcaaagcagauucacguagguucgaaaaugcuguuugggaucaaugcaaagauuuaugccauaugcacaccggaguaguaguagaaaaaaaaaaaagaggcggaaaagaagaaauaacaccacauugugcacuuauggauuguauaauguaugaugcagcuguaaguggcggguuaaacauuccaguauuaagagcaguacuaccaagggacaugguauuuagaacaucaaguccuaaaguaguuuuauaa

SEQ ID NO: 2916 - RNA, 1710 nt, Artificial Sequence
  derived and/or modified CDS sequence (opt6) from Lassa virus__AIT17463__NP
augucugcaucaaaagaaguaaaaagcuuccuauggacucaaucacucagaagagaauuaucagguuauugcuccuccauuaaacuacaaguaguaaaagaugcucaagcacuauuacauggacuagauuucucagaaguaucaaacguucaacgacuaaugagaaaacacaagagagacgauuccgaccucaaaagacuacgcgaucuaaaucaagcgguuaacaacuugguugaauuaaaaagcacacaacaaaaaucuauacuucgaguaggaacuuuaacuagcgaugaccuacuaacauuggcugccgauuuagaaaaacuaaaaaguaaaguaauaagaacggaaagaccuuugaguucaggaguauacaugggaaaucuaaguacacaacaacuagaacaaagaagagcucuacuuaacaugaucggcaugguaggaggagcacaaucaacacaaccagguagagaugguguaguaagaguaugggacgucaaaaacccagaucuauuaaacaaucaauuuggcacaaugccaucuuuaacuuuagcaugcuuaacaaagcaaggacaaguagaccuaaacgaugcaguacuagcuuuaacagaccuaggauuaauauauacggcaaaauacccaaauucaagugaccuagacagauuaucgcaaucacacccuauacuaacaaugguagacacaaaaaaaucuaguuuaaacaucucagguuuuaauuucucauuaggugccgccguaaaagcaggagccugcauguuagacggaggaaauaugcuagaaacaauaaaaguaacaccacaaacaauggacggaauauuaaaaaguauauuaaaaguuaaaaaaucauuaggaauguucguaucagauacaccuggagaaaggaauccuuaugaaaauauacuguacaaaauaugucuaucaggagauggcuggccauacaucgcuaguagaaccucuauaguuggacgagcaugggaaaauaccauaguagauuuagaaacagacggaaaaccacaaaaaguaggcacagcuggcucaucucgaucauuacaaagugcagguuuucccacgggacuaacauacucacagcuaaugacauuaaaagacucaaugaugcaauuagauccaagugcaaaaacauggauugacauagaaggaaggcccgaagacccgguagaaauagcucuauaccaaccuaugucuggaugcuacauacacuuuuuuagagaaccaacagaccuaaaacaauuuaaacaagacgcaaaauauucacacggcaucgauguagcagaccuuuuuccagcacaaccaggauuaacaucagcaguaauagaagcacuuccaagaaacaugguauuaacaugucaaggcagugacgauauaaaaaaacuauuagauagucaaggcaggagagacauaaaacuaauagacauagcacuaagcaaagcagacaguagacgauuugaaaacgcaguaugggaucaaugcaaagauuuaugucauaugcauacaggaguagucguagaaaaaaaaaaaagaggcggaaaagaagaaauaacaccgcacugugcccucauggacugcauaauguacgacgccgcaguaagcgggggucuaaauauaccaguauuaagagccguauuaccuagagacaugguuuuuagaacaucaaguccaaaaguagucuuauaa

SEQ ID NO: 2917 - RNA, 1710 nt, Artificial Sequence
  derived and/or modified CDS sequence (opt6) from Lassa virus__AIT17467__NP
augucugcaagcaaagagguaaaaucauuucuauggacacaaucauuacgaagagaacucucaggauauugcuccucaauaaaacuacaaguaguaaaagacgcacaagcauuacuacacggacuagauuucucagaaguaagcaauguccaaagauuaaugagaaaacaaaaaagagacgacucagaccugaaacgucuaagagacuugaaccaagccguaaauaaccuaguagaacuaaaaaguacccaacaaaaaagcauacuaagagucggaacacuaacaagcgaugacuuacuaacucuagcagcagaucuagaaaaacuaaaaucaaaaguaaucagaacugaaagaccucucaguucaggaguauauaugggaaaccuaucgacacaacaauuagaacaaagaagagcuuuauuaaauaugaucggaauggucggaggaacacaaggaacacaaccaggacgagauggaguaguaagaguaugggauguaaaaaacccagauuuauuaaacaaucaauucggaacaaugccaucauuaacacuagcaugucuaacaaaacaaggacaaguagaccuaaacgaugccguucuagcauuaacagaccuaggacuaauauauaccgcaaaauacccaaacucaucagauuuagacagacucucgcaaucacacccuauacuaaacaugguagauaccaaaaaaagcucacuaaauauaaguggauauaauuuuucacuuggagcagcaguuaaagcaggagcauguaugcuagacggaggaaacaugcuagaaacaaucaaaguaacaccucaaacaauggacgguauauuaaaaucaauccuaaaaguuaaaaaaucacuaggaauguuugucagugauaccccaggagaaaggaacccuuacgaaaauauacuauacaaaauaugccuaagcggagacggauggcccuauauagcaagccgaacuuccauaguugggagagcuugggaaaacacaacaguugaccuagaaucagacggcaaaccacaaaaaguaggaacagcuggaucaaacaaaucacuacaaucagcugguuuccccacagguuuaaccuauagccaacuaaugacauuaaaagauagcaugaugcaacuagauccaagcgccaaaacauggauagacauagaaggucgaccagaagaucccguagaaauugcacuauaucaaccaaugaguggaugcuauauacacuuuuuucgagaaccgacagacuuaaaacaauucaaacaagacgccaaauauucacauggcauagauguagcagaccuauuuccagcacaaccuggauuaaccucagcuguaauagaagcacuaccaagaaauaugguauuaacaugccaaggaucagacgauauaaaaagauuauuagacagucaagguagaagagauauaaaauuaauagacauaucacuaaguaaagccgacagucgaagauucgaaaacgccguaugggaucaaugcaaagaccuaugccacaugcauacaggaguaguaguagaaaaaaaaaaaagaggaggaaaagaagaaauaacaccacacugugcacuaauggacugcauaauguacgaugcagcaguaaguggaggauuaaauauaccaguauuaagagcaguauuaccucgggauaugguauuucgaacaucaucaccaaaaguaguauuauaa

SEQ ID NO: 2918 - RNA, 1710 nt, Artificial Sequence
  derived and/or modified CDS sequence (opt6) from Lassa virus__AIT17471__NP
augucagcaaguaaagaaguaaaaucauucuuauggacucaaucauuaagaagagaacuuaguggauacugcucuagcauaaaguuacaaguuguuaaagacgcacaagcacuuuuacacgguuuagauuucuccgaaguaucaaacguacaaagacuaaugaggaaacaaaaaagagacgauagcgacuuaaaaagguuaagagaucuaaaucaagcaguaaacaacuuaguugaauuaaaaaguacacaacaaaaaagcauauuacgaguuggaacauuaacaagcgaugacuuacuuacucuagcagcagaccuagaaaaacuuaaaagcaaaguuauaagaacagaaagaccacuaucauccggaguauauaugggaaaccuaucuacacaacaauuagaacaaagaagagcauuacuaaauaugauaggaaugguaggaggagcacaaggaacacaaccaggaagagacggugucgucagaguaugggaugucaaaaacccagaucuccuaaauaaccaauucgguacaaugccaucacuaacacuagcaugcuuaaccaaacaaggacaaguagaccuaaacgacgcaguauuagcccugacugacuuaggucuaauauacacugcuaaauauccaaacucaagugaccuagaucgauuaucccaaucacauccuauacuaaacaugguagauaccaaaaaaucaaguuuaaauauaucaggauauaauuuuucucuaggugcagcaguaaaagcaggugcauguaugcuagauggaggaaauauguuagaaacaauaaaaguaacaccucaaaccauggauggaauauuaaaaucaauacuaaaaguaaaaagguccuuaggaauguuugugucagacacaccaggagaacgaaauccauacgaaaauauucucuacaaaauaugcuuaucaggagauggauggccauauauagcgucaagaacaucgauaguaggcagagcaugggaaaacacaacuguugaucuagaaagugaugguaaaccacaaaaaaugggaacaacaggaagcaacaaaagccuacagucagcaggcuucccuacuggauuaacauauucucaguuaaugacacuaaaagacucaaugaugcaacuugacccuucagccaagacuuggauagacauagaaggaagacccgaagauccuguagaaauagcauuauaccaaccaaugaguggcuguuauauacauuuuuuuagagaaccuacugaucuuaaacaauucaaacaagacgccaaauacucacacggaauagauguggccgacuuauuuccagcacaaccaggacuaacaucugcaguuauagaagcuuuaccaagaaauaugguauuaacaugccaaggaucagaugacauaaaaaaacuuuuagauucacaaggaagaagagacauaaaauuaauagauaucgcacuaaguaaagcagauaguagaaaauucgaaaacguagugugggaccaaugcaaagacuuaugccauaugcauacaggaguuguaguugaaaaaaaaaaaagaggagguaaagaagaaauaacaccacacugugcauuaauggacugcauaauguaugacgcagcaguaucaggagguuuaaacauaccaguuuuacgagcaguauuaccaagagauaugguauuuagaacaucgucaccuaaaguaguccuauaa

SEQ ID NO: 2919 - RNA, 1710 nt, Artificial Sequence
  derived and/or modified CDS sequence (opt6) from Lassa virus__AIT17475__NP
augucugcaucaaaagaaguaaaaagcuuccuguggacacaaucuuuaagaagagaacuaaguggauacuguaguagcauaaaauuacaaguaguaaaagaugcacaagcauuacuacauggacuugauuuuagcgaaguaagcaaugugcaaagacuaaugagaaaacaaaaacgagacgauucagauuugaaaagauuaagagacuuaaaucaagcaguaaauaaccuaguagaauuaaaaagcacacaacaaaaaucaguacuccggguaggaacacuaaccucagacgacuuacuuaccuuagcagcagaucuagaaaaacuaaaaagcaaaguuauaagaacagaacgaccucuaaguucagguguauauaugggaaaucuaagugcucaacaacuugaacaaagaagagcauuacuaucuaugauaggaaugguuggaggugcacaaggaacgcaaccaggaagagacggaguaguaagaguaugggacguaaaaaauccugaccuauuaaauaaccaauuuggaacaaugccaucuuuaacauuagcaugccuuacgaaacaaggacaaguagaucucaaugauacaguacuagcacuuacagacuuaggacuuaucuauaccgcuaaguaucccaacagcucagaucuagacagguuaagccaaucucacccaauacuaaauauggucgauacaaaaaaaucaucacuaaacauuaguggauauaacuucucauuaggagcagcuguaaaagcaggagcauguauguuagacggaggaaauauguuggaaacuauaaaaguuaccccucaaacaauggaugguauauuaaaaucaauauuaaaagucaaaaggaguuuagguauguucguaagcgauacuccaggggaacgaaacccauacgaaaauaucuuauauaaaauaugccuaucaggagauggauggccauauauagcaagccgaacaucaauaguagggagggcaugggaaaauacaacagucgaccuagaaagugauggcaaaccacaaaaaguaggaaccgcaggaaguaauaaaagucuacaaagcgcaggauucccaacagguuuaacauauucacaauuaaugacacuuaaagauuccaugaugcaauuagaucccucagcaaaaacauggauagauauagaaggacgaccagaagacccaguagaaaucgcauuauaucaaccuauaagcggauguuacauacauuucuucagagaaccgacagaccuaaaacaauuuaaacaagacgcuaaauauucacauggaauagacguaacagaucuauuuccagcacaacccggauuaacgagugcgguaauagaagcacuaccaagaaacaugguacuuacuugccaaggaagugaugauauaaaacgacuauuagacagccaaggaagaagagauauaaaaauaauagauauagcauuaucaaaagcugauagccgaagauuugaaaaugcaguaugggaccaauguaaagauuuaugucacaugcauacagguguuguaguagaaaaaaaaaaaagggggggaaaagaagaaauuaccccacauugugccuuaauggacuguauuauguacgacgcagccgugucaggaggauuaaacauaccaguacuuagagcaguacuaccuagagauauggucuuuagaaccucuucaccaaaaguaguauuauaa

SEQ ID NO: 2920 - RNA, 1710 nt, Artificial Sequence
  derived and/or modified CDS sequence (opt6) from Lassa virus__AIT17479__NP
augagugcaaguaaagaaguaaaaucauuuuuauggacacaaagucucagaagagaacucaguggauauugcucgaacauuaaauuacaaguaguaaaagaugcacaagcacucuuacacggacuagacuuuagcgaagugagcaauguacaaagauuaaugagaaaacagaaaagggaugauagcgaccuaaaaagauuaagagauuuaaaucaagcaguuaauaaccuaguagaauuaaaaagcacacaacaaaaaagcguacuaagaguagguacccuuacaagugaugaccuauuaacccuugcagcagaccuagaaaaauuaaaaucaaaaguaauaagaacugaaagaccauuaucaagugguguauauaugggaaauuuaagcacacaacaauuagaacaaagaagggcacuacuaaacaugauuggaaugguagggggcgcacaaggaacacaaccugguagagacggugucguacgagucugggacguaaaaaauccagauuuauuaaauaaccaauuuggaacaaugccaucacuaacacuagcaugcuuaacaaagcaaggacaaguagacuuaaacgaugcaguauuagcauuaacagaccuaggauuaauuuauacagcaaaauauccgaacucaucugaccuagauagacuaucacaaagccacccuauacuuaacauggucgauacaaaaaaaaguucauuaaauauaagcggauauaauuucaguuuaggagcagcaguaaaagcuggagcguguaugcucgacggaggcaacauguuagaaacaauaaaaguaacgccacaaacuauggauggaaucuuaaaaaguauacuaaaaguuaaaagaucauuaggcauguuugucagugacacaccuggugaacguaauccauaugaaaauauauuauacaaaauauguuuaucaggagauggauggccauauauagcaucaagaacaucaauaguagguagagccugggaaaauaccacaguagaucuagaaagugauggaaaaccgcagaaaguaggaacagcaggaucaaauaaaucacuucaaucagccggauuucccacuggacucacuuauucucaauuaaugacacuuaaagauaguaugaugcaauuagacccaucagcaaaaacuuggauagacauagaaggacgacccgaagauccaguagaaaucgcauuauaucaaccaaugaguggcugcuacauucauuuuuucagagaaccaaccgaucuaaaacaauuuaaacaagaugcaaaauauucacauggcauagacguagcagaucuauuuccugcgcaaccuggacuaacaucagcagugauagaagcuuuaccaagaaacauggucuuaacaugccaaggaagcgaugacauaaaaaaacuauuagacucucaaggaagaaaagacauuaaauuaauagacauagcauuaaguaaaguagauucucggagauuugaaaacgcuguaugggaccaauguaaagauuuaugucauaugcauacagggguaguaguugaaaaaaaaaaacgaggcggaaaagaagaaauaacaccacacugugcgcuaauggauugcauaauguaugacgcagccguaaguggaggauuaaacauaccaguauuaagagcaguucucccccgcgacaugguauucagaacaucaagcccaaaaguaguauuauaa

SEQ ID NO: 2921 - RNA, 1710 nt, Artificial Sequence
  derived and/or modified CDS sequence (opt6) from Lassa virus__AIT17491__NP
augucagcaaguaaagaagucaaaaguuucuuauggacacaaagcuuaagaagagaacuaaguggauauugcaguaacauaaagcugcaaguaguuaaagacgcucaagcacuauuacacggacucgauuucucagaaguaucaaacguccaaagacuaaugaggaaacaaaaaagagacgauggagaucucaaaagauuaagagauuuaaaucaagcaguaaauaacuuagucgaauuaaaaucaacacagcaaaaaaguguacuaagaguaggaacuuuaacuagugaugacuuacuuacauuagcagcagauuuagaaaaacuaaaaucaaaaguaauaagaaccgaaagaccauuaucaucaggaguauauauggguaacuuaucaacacaacaacuagaacaaagaagagcacuuuuaucaaugauuggaauggucgguggagcacgaggaacucaaccaggaagagacgguguaguaagaguaugggacguaaaaaacccagaccuucuuaacaaucaauuuggaacuaugccaagucuaacauuagcuugcuuaacaaaacaaggacaaguagacuuaaacgauguaguuuuagcauuaacagaccuagguuuaauauacacagcuaaauacccuaacucaagugaccuagacagauuaagccaaagucacccuauacuuaacaugguagauacaaaaaaaaguagcuuaaauauaucaggauauaauuuuucacuaggagcugcuguaaaagcaggagcauguauguuagauggagggaacauguuagaaacaauaaaaguuacaccacaaacaauggauggcauucuaaaaucaauauuaaaaguaaaaaaaaguuuaggaauguuuguaucagacacaccaggcgagagaaauccuuaugaaaauauacuauacaaaauauguuuaucaggagacggauggccauauauagcuucacgaacuucaauagucggaagagcaugggaaaauacaacaguagaucuagaaucagacggaaaaccucaaaaaguaggagcugcgggaucaaacaaaucguuacaaucagcugguuuuccaacaggauuaacauacucacaauuaaugacuuuaaaagauucaaugaugcaauuggauccauccgccaaaacguggauagauauagaaggaagaccggaagaucccgucgaaauagcucuauaccaaccaaugucaggaugcuacauacauuuuuucagagaaccuacggaucuaaaacaauuuaaacaagaugcuaaauauucacaugggauagauguaacagauuuauuuuccgcacaaccaggacucacaucagcaguaauugaagcacuuccaagaaacaugguguuaacaugucaaggaagcgacgacaucaaacgacuauuagauucacaaggacgaagggacauaaaacucauugacauagcauuaagcaaagcugauagccgaagauuugaaaaugcuguaugggaucaaugcaaagaccuuugucacaugcauacaggugucguaguagaaaaaaaaaaacgagguggcaaagaagaaauaacuccacacugcgcacuuauggauugcauaauguacgacgcugcuguaucggguggacuaaacauaccuguacuaagagccguuuuaccaagagauauggucuuccgaacaagcucaccaaaagugguacuauag

SEQ ID NO: 2922 - RNA, 1710 nt, Artificial Sequence
  derived and/or modified CDS sequence (opt6) from Lassa virus__AIT17495__NP
augucugcaucuaaagaaguaaaaucauuccuuuggacacaaagucuaagaagagaacugucaggauauugcucaaauaucaaauuacaaguuguuaaagaugcacaagcacuauuacacggauuagacuucucagaaguaucaaacguacagcgauuaaugagaaaacaaaaaagagacgauucagacuuaaaacgacuaagagaccucaaucaagccguaaacaauuuagucgaacuaaaaucuacucaacaaaaaagcauucuaagaguaggaacacuaacaagugaugauuuauuaacacuagcugcagaucuagaaaaacuuaaaucaaaaguuauaagaaccgaacgaccuuuaucaucuggagucuacaugggaaaucuuucaacacaacaacuugaacaaagaagagcacuuuuaaacaugauaggaaugguuggaggagcccaaagugcacaaccuggacgagauggcguaguaagaguaugggacguaaaaaauccggaucuacucaauaaccaauucggaacaaugcccagucuaacauuagcaugccugacaaaacaaggacaaguugacuuaaacgaugcaguacucgcucuaacugaccuaggauuaauauauaccgcgaaauauccaaauucaucagaccucgacagauuaucacaaucacacccaauauuaaauaugguagauacaaaaaaaucaucacuaaacauaagcggauuuaauuucucauuaggagcagcaguaaaagccggagccuguaugcuagauggcggaaauauguuagaaacaauaaaaguaacaccccaaaccauggacgggauauuaaaaucaaucuuaaaaguaaaaagaagcuuaggaauguucguaucagaugcaccaggcgaaagaaauccauaugaaaacauacuauauaaaauaugucucucaggagauggauggcccuauauagcaucaagaacaucaauaguaggccgagcaugggaaaacacaacugucgacuuagaaucagauggcaaaccacaaaaaguaggaacugcgggaagcaauaagucacuacaaucagcaggauuucccacgggacuaacauacagucaacuaaugaccuuaaaagacagcaugaugcaauuagacccuagugcaaagaccuggauugacauagaaggccgaccagaagauccaguagaaauagcacuauaucaaccaaugucaggaugcuacauucauuuuuucagagaaccuacagaucuuaaacaauuuaaacaagaugcaaaauauucacacggaauugacguugccgaucuuuuuccagcacaaccaggcuugaccucugcugucauagaagcucuaccucgaaauaugguacuaaccugucaaggaagcgacgacauaaaaaaacuauuagacucucaaggaagaagagacauaaaacuaauagacauugcauuaucaaaagcagacucacgucgcuucgaaaaugcaguaugggaccaauguaaagacuuaugccauaugcauacaggaguaguggucgaaaagaaaaaaagagguggaaaagaagaaauaacaccacacugugcacuuauggauugcauaauguaugaugcugcaguaucaggaggauuaaauauacccguacuaagagcaguuuuaccaagagacaugguauuccgaacaagcucacccaaaguaguacuauaa

SEQ ID NO: 2923 - RNA, 1710 nt, Artificial Sequence
  derived and/or modified CDS sequence (opt6) from Lassa virus__AIT17499__NP
augagcgcaaguaaagaaguuaaaucauuccuauggacccaaucauuacgaagggaauuaucaggauauuguagcucaauaaaauuacaagucguuaaagaugcucaagcacuauuacaugggcuagauuuuucagaaguaaguaauguacaaagacuaaugcggaaacaaaaaagagacgauagcgaccuaaaacgauuaagagaucuaaaucaagcaguaaauaacuuaguagaauuaaaaucaacacaacaaaaaaguauacuuagaguaggaacacuaacaagugaugauuuacuuacacuagcagcagaccuagaaaaacuuaaaucaaaaguuauaagaacugaacgaccacuaaguucaggaguauauaugggaaacuuauccacacaacaacuagaacaacgaagagcauuauuaaauaucauaggaaugguaggaggagcucaaggaacacaaccaggaagagauggaguaguccgaguaugggaugucaaaaacccugacuuacuaaacaaucaauucggaacaaugcccucacucacccuagccugccuaaccaaacaaggccaaguagaccuaaaugacgcgguucuagcauuaacagaucuuggauuaauauauacugcaaaauauccaaacuccagugauuuagaccgauuaagucaaucucaucccauauuaaauaugguugacacaaaaaaaagcagccuaaacauaaguggauacaacuucucccuaggagcagcaguaaaagcuggagccuguaugcuagauggaggaaauaugcucgaaacaauaaaaguaacuccacagacaauggauggaauacuaaaaucaauacuaaaaguaaaaagaagcuuagggauguuuguaucagauacaccuggagaaagaaacccauaugaaaauauucuuuacaaaauauguuuaucuggagauggauggccauauauagcaagcagaacaucaauaguaggaagagcaugggaaaauacuaccgucgaucuugaaucagauggaaaaccucaaaaaguaggagcagcagguucaaauaaaucccuccaauccgcaggauuuccgacaggacuuacauacucccaauuaaugacacuaaaagacucaaugaugcaauuagauccaucagcaaaaacuuggauagauauagaaggcagaccagaagacccaguagaaauagcuuuauaucaaccaaugaguggauguuauauacacuuuuuuagagaaccaacagaucucaaacaauuuaaacaagacgcaaaauacagccauggaauagacguagcugaccuauuuccagcacaaccuggacuuacaagugcaguaauagaagccuuaccaagaaauaugguacuaacaugccaaggaucugaugauguaaaacgucucuuagauagccaaggaagaagagauauaaaauuaauagauauagcacuaucaaaagcagacucaagaagauucgaaaacgcaguaugggaccaaugcaaagaucuaugucauaugcacacaggaguaguagucgaaaaaaaaaaaagaggaggcaaagaagaaauaacaccacauugugcacuaauggauugcauaauguaugacgcagcaguaaguggaggauuaaauauaccaguuuuacgagcuguauugccacgagacaugguguucagaacuucaucuccuaaaguaguacuuuga

SEQ ID NO: 2924 - RNA, 1710 nt, Artificial Sequence
  derived and/or modified CDS sequence (opt6) from Lassa virus__AIT17503__NP
auguccucaucaaaagaaguaaaaucuuuuuuauggacacaaucuuuaagaagagaacuuuccggauacugcaguucuauaaaacuccaaguaguaaaagacgcccaagcacuccuucacgguuuagacuucucagaaguaucaaacguacaaagauuaaugagaaaacaaaaaagagacgacucagaucuaaaaagauuaagagaccuaaaccaagcaguaaauaacuuaguagaauuaaaaucaacgcaacaaaaaucaauauuaagaguaggaacucuuacuucagaugaucuauuaacacuagcagcagaucuagaaaaauugaaaaguaaaguaauuagaacagaaagaccucuaucuucaggaguauauauggguaacuuaucagcacaacaauuagaacaaagaagagcuuuacugaacaugauugguaugguuggaggagcacaaggaacacaaccaggaagagacggaguuguaagaguaugggacguaaaaaaccccgacuuauuaaauaaucaauuuggaaccaugccaucacucacacucgcuugccuaacaaaacaaggacaaguagaucuaaacgaugcaguacucgcauuaaccgacuuaggccuaauauauacagcaaaauauccaaacaguucagauuuagauagacucucacaaagucaucccauacuaaauaugguagauacuaaaaaaaguucacucaauauaaguggguauaauuuuucauuaggcgcggcuguuaaagcaggcgcguguauguuagacggaggaaauauguuagaaacaauaaaaguaacuccacaaaccauggauggaaucuuaaaaucaauacuaaaagugaaaaaaucuuuaggaauguucgugucagacacuccaggagaaaggaauccauacgaaaacauauuauacaaaauaugcuuaaguggagauggcuggccuuauauagcgucaagaacuucaauaguaggaagagcaugggaaaacacaacuguugauuuagaaucagauggaaaaccccaaaaagucggaaccgcaggaucuaacaaaucacuacaaucagcaggauuucccacaggacucacauauucccaauuaaugacacuaaaagauucaaugaugcagcuagacccauccgcaaaaacauggauagauaucgaagguagaccagaagacccaguagaaaucgcacuuuaccaaccaaugucaggauguuauauacauuuuuucagagaaccaacugaccuuaaacaauuuaaacaagaugcuaaauauucacacgguauugauguagcagacuuauuuccagcacaaccaggacuaaccuccgcagucaucgaagcucuuccacgcaacaugguacuaaccugucaaggaucagaugacaucaaaagauuacuagacucacaaggaagaagagacauaaaauuaauagacauugcauuaaguaaagcagacagucguagauuugaaaaugcaguuugggaccaauguaaagaucuaugccacaugcacacggguguaguuguagaaaaaaaaaaaagaggaggaaaggaagaaauaacaccccacugugcauuaauggauugcauaauguacgacgcagcugucucaggcggauuaaacauaccaguacucagagcaguccuaccuagagauaugguuuuucgaacuagcucaccaaaaguuguucuauaa

SEQ ID NO: 2925 - RNA, 1710 nt, Artificial Sequence
  derived and/or modified CDS sequence (opt6) from Lassa virus__AIT17507__NP
augagugccagcaaagaaguaaaauccuucuuauggacucaaucucuuagacgagaacuaagcggauauugcaguaacauaaaacugcaaguaguaaaagaugcacaagcgcuccuacauggauuagacuuuagugaaguaaguaauguacaaagauuaaugagaaaacaaaagagagacgauagcgaccuaaaaagauuaagagaucuaaaucaggcaguaaauaacuuaguagaacuaaaaagcacccaacaaaaauccauccuuagaguaggaacacuaacgucugaugauuuacuaacauuagcugcagaucuagaaaaauuaaaaucaaaaguuauacgaacagaacgaccucuaagcucaggaguauacaugggaaaucuaucgacacaacaauuagaacaaagacgagcacuacucaacuuaauaggaaugguaggaggagcucaaggaacacaaccaggaagagaugguguaguaagaguaugggacgucaaaaacccagauuuauuaaauaaccaauuuggaaccaugccaucacuaacacuugcaugcuuaacaaaacaaggacaaguagacuuaaaugaugcaguauuagcacuaacagauuuaggacuaauauacacagcaaaauauccaaacagcagcgaucuagacagauuaucucaaucacaucccauacuaaauaugguagauacaaaaaaaucaagucuaaacauaucaggguucaauuucucauuaggagcagcaguaaaagccggagcauguauguuagacggaggaaauaugcuugaaacaauaaaaguaaccccacaaaccauagacggcauacuaaaaucaauauuaaaaguaaaaaaaucucuaggaauguuuguaucagacaccccaggggaaagaaauccauaugaaaacauauuauacaaaauaugcuuaagcggagauggauggccauauauagcaaguagaacaucaauuguaggucgagcuugggaaaacacaacaguugaccuagaaucagauggcaaaccacacaaaguuggcacagccggaagcaauaaaucacuacaaagugccggcuuucccacaggacuaacauauucacaacucaugacacuaaaagacucaaugaugcaacuugauccaagugcaaaaaccuggaucgauauagaaggacgaccagaagacccaguagaaauagcuuuauaccaaccaaugucaggcuguuauauacacuuuuuuagagaaccaacagauuuaaaacaauuuaaacaagaugcaaaauauagccauggcauagauguagcagaccuauuuccagcacaaccaggacuaacuagcgcuguaauagaagccuuaccaagaaauaugguacuaacaugucaaggaucagaugacauaaaacgacuauuagacucucaaggaagaagagauauaaaacuuauagacauugcauuaucaaaaguagacaguagaagauucgaaaaugcuguuugggaucaauguaaagauuuaugccacaugcacacaggaguaguaguagaaaaaaagaaaagggguggcaaggaagaaauaaccccgcacugugcacuaauggauugcauuauguaugacgccgcagucuccggcggguuaaacauaccaguacuaagagcaguauuaccaagagauaugguuuuccgaacaaguagucccaaaguuguacuauaa

SEQ ID NO: 2926 - RNA, 1710 nt, Artificial Sequence
  derived and/or modified CDS sequence (opt6) from Lassa virus__AIT17511__NP
augucagcaucaaaagaaguaaaaucauuuuuauggacucaaagucuaagaagagaacuuucaggauauugcucaaauauaaaauuacaaguaguaaaagaugcacaagcauugcuucacggauuagauuucucugaaguaaguaacguccaacgauuaaugagaaaacagaaaagagaugauggagaccuaaaaagauuaagagaucuaaaucaagcaguaaauaacuuaguugaacuaaaaaguacucaacagaaaaguauccuaagaguaggcacacuaacaucagaugaccuucuaacguuagcagcagaucucgaaaaauuaaaaagcaaaguaauuagaaccgaacgaccacuaucaucaggaguuuauaugggaaaccuaucaacacaacaacuagaacaaagacgagcacuacucaacaugauaggaaugguuggaggggcacaagguacacaaccaggcagagauggagucguaagagucugggacguuaaaaauccagacuuauuaaauaaccaauucggaacuaugccaucauuaacuuuagcaugcuugacaaaacaaggacaaguagauuuaaacgaugcaguacuagcauuaaccgaccuaggacuaauauacacagccaaauauccaaauuccagugacuuagacagauuaucucaaucacauccaauccuaaacaugguagauaccaagaaauccagucuuaacauuagcggauacaauuuuucacuaggagcagcaguuaaagcaggagcaugcauguuagacggaggaaacauguuagaaacaauaaaagugacaccccaaaccaucgacggaauacugaaaucaauacuaaaaguaaagaaaucauuaggaauguuuguaagcgacacaccaggagaaagaaauccauacgaaaauauauuauacaaaauauguuuaucaggagauggcuggccauauaucgcauccagaacaagcauaguagguagagcaugggaaaauacaacaguagacuuagaaucggauggaaaaccacaaaaaguaggaacagcaggaagcaacaaaagucuccaaucugcaggauuuccaacaggauuaacauacagucaacuaaugacucuaaaagauucaaugaugcaacuagacccauccgcaaaaaccuggauagauauagaaggaagaccugaagacccaguagaaauugcguuauaccaaccaaugaguggaugcuacauacacuucuuuagagaacccacagauuuaaaacaauuuaaacaagaugcuaaauacucccacggaauagauguaacagauuuauuuuccgcacaaccuggauuaacaagugcaguaaucgaagcauuacccagaaacaugguccuaacaugccaaggaucugacgacauaaaaagauuauuagacagucaaggcagaagagacauaaaauuaauugacauagcacuaagcaaagcagauucaagaagauuugaaaaugcaguaugggaucaauguaaagauuuaugccacaugcacaccggaguuguuguagaaaagaagaaaagaggaggaaaagaagaaauaacaccgcacugugcauuaauggauugcauaauguaugaugcggcaguaaguggaggauuaaacauacccguccuaagagcaguacucccgagagauaugguauuucggacaaguaguccaaaaguaguauuguaa

SEQ ID NO: 2927 - RNA, 1710 nt, Artificial Sequence
  derived and/or modified CDS sequence (opt6) from Lassa virus__AIT17515__NP
augagugccagcaaagaaguaaaaucguucuuauggacacagucccuacgaagagaacuaucaggauauuguagcucaauaaaauugcaaguuguaaaagacgcccaagcacuucugcauggacuagacuucucagaaguuucaaacguacaaagacuuaugagaaaacaaaaaagagaugauagugaucuaaaaagauuaagagaucuaaaccaagcaguaaauaauuuagucgaauuaaaaaguacccaacaaaaaucaauacucagaguagguacucuaacaucagaugacuuauuaacacucgccgccgauuuagaaaaauuaaaaucuaaaguaauaagaacagaaagaccucuaaguuccggaguauacaugggaaacuuguccacacaacaacuggaacaaagaagagcuuuauuaaacaugauaggaaugguaggaggagcacagggcacacagccaggaagagacggaguaguaagaguaugggauguaaaaaacccagaccuacuaaacaaucaauucggaacaaugcccucauuaacuuuagcauguuuaacaaagcaaggucaaguagaccuaaacgaugcaguacuagcucuaacugaccuaggacuaauauauacagcaaaauauccaaauagcagugaucuagaucgauuaucacaaagccauccaauacucaauaugguugacacaaaaaaaucaucacuaaacauaucagguuacaauuucucacuaggcgcggcaguaaaagcaggagcauguaugcuagacggcgguaacaugcuagaaacaauaaaaguaacaccacagacaauggacggaauccuaaaaaguaucuuaaaagucaaaagaagcuuaggcauguucguuucagacacaccuggugaaagaaacccauaugaaaacauacuauauaagauaugccuaagcggggauggauggcccuauauagcaucacgaaccucaauaguaggaagagcaugggaaaauacaacuguagaucuggaaagcgacggcaaaccacaaaaagucggagcugcaggcaguaguaaaucauuacaaagcgcaggauucccaacaggcuuaacauacucacaauugaugacacuuaaagauucuaugaugcaacuagacccaucagcaaaaacauggaucgauauagaaggccguccagaagacccagucgaaauagcacuauaucaaccaguaucaggaugcuauauacacuucuuuagagaaccaacagaucuaaaacaauuuaaacaagaugcgaaauauagccauggaaucgacguagcagauuuauuuccagcacaaccuggacuaacuucagcaguaauagaagcauuaccaagaaacaugguacuaaccugccaaggaucagacgauauuaaaagauuacuagacucacaaggaagaagagauauaaaacuaauagauauugcacuaaguaaagccgauucaagaagauuugaaaaugcuguaugggaccaauguaaagaccuaugucauaugcauacaggaguuguaguagaaaaaaaaaaaagaggaggaaaagaagaaauaaccccacacugugcauuaauggacuguauaauguacgacgcugcaguuagcggaggacuuaacauaccaguauuaagagcaguacuaccuagagacaugguauuccgaaccucaucaccaaaagucguauuauaa

SEQ ID NO: 2928 - RNA, 1710 nt, Artificial Sequence
  derived and/or modified CDS sequence (opt6) from Lassa virus__AIT17519__NP
augucagcaucaaaagaaguaaaaucuuuccucuggacacaaucauuaagaagggaacucaguggauauugcaguaauauaaaacuacaagucguaaaagaugcacaagcauuauuacacggacucgacuuuagugaaguaucaaauguccaaagacucaugagaaaacaaaaacgagacgauuccgacuuaaaaagauuaagagaucuaaaccaagcaguaaacaauuuaguagaauuaaaaucaacacaacaaaaaucaaucuugagaguaggaacucuaaccagugacgaccuacuaacucuagcagcagaccuagaaaaacuuaaaucaaaaguaauaagaacagaacgaccacuuucuagcgguguauacauggguaacuuaagugcacaacaacuagaacaaagacgagcauuacuaaacaugauaggaaugguagguggagcacaagguacacaaccaggaagagacgguguaguacgaguaugggauguuaaaaauccagacuuauuaaauaaccaauuuggcacaaugccuagcuugacacuggcaugucucacaaaacaaggacaaguagacuuaaaugaugcuguacuggcauuaacugauuuaggcuuaauuuacaccgcaaaauauccaaauucaucagaccuagauagauuaucacaaagucauccaauacuaaauaugguagauacaaagaaaucgucacuuaauauaaguggauucaauuuuucauuaggagcagcagucaaagcaggagcauguaugcuagacggaggaaauauguuagaaacaauaaaaguaacaccccaaacaauggauggcauacuaaaaucuauacuuaaaguaaaaagaucguuaggaauguucgucucagacacuccgggagaacgaaauccauacgaaaauauauuauauaaaauauguuuaucaggagaugguuggcccuauaucgcaagcagaacaucaauaguaggacgugcgugggaaaacacaaccguggaucuagaaucagauggaaaaccgcaaaaagucggaacagcaggcucaaacaaaagucuacaaucagcaggcuuuccaacaggauuaacguauagccaacucaugacacuaaaagacucaaugaugcaauuagauccgucagcaaaaacauggauagacaucgaaggcagaccugaagacccagucgaaauugcauuauaucaaccaaugagcggauguuacauacacuuuuucagagaacccacagacuuaaaacaauuuaaacaagacgcaaaauacagccacggaauugauguugcugauuuauuuccagcacaaccaggauuaacaucagcuguaauagaagcacuaccaagaaacaugguacuaaccugucaaggaagugaugauauaaaaagauuauuagacucacaagguagacgagauauaaaacuaauagauauagcacuuucaaaagccgacucaaggcguuucgagaacgcaguaugggaucaauguaaagacuuaugccauaugcauacaggaguagucguagaaaagaagaaaagaggagguaaagaagaaauaacaccacacugugcauuaauggauuguauaauguacgacgccgcaguaagugguggacucaauauaccaguauuaagagcaguauuaccaagagacaugguauucagaacuucaagcccaaaaguaguacuauaa

SEQ ID NO: 2929 - RNA, 1710 nt, Artificial Sequence
  derived and/or modified CDS sequence (opt6) from Lassa virus__AIT17525__NP
augagcgcuaguaaagaaguaaaaucauuuuuguggacacaaaguuuaagaagagaacuaucaggauacugcucaucaauuaaacuacaaguuguaaaagaugcacaagcacuuuuacauggccucgacuuuucagaaguaucaaauguacaaagauuaaugagaaaacaaagaagagacgauagcgauuuaaaaagacuuagagacuuaaaccaagcaguaaauaacuuaguagaacuaaaaagcacacaacagaaaaguauauuaagaguuggaacacuaacuucagaugaccuucucacauuagcagcagauuuagaaaaauuaaaaucuaaagucauaagaacagaaagaccauuaucuucaggaguauacaugggaaauuuaagcacucaacaacuagaacaaagacgagcacuccuaaauaugauaggaaugguaggaggagcacaaggaacucaaccuggaagagacggaguaguaagaguaugggacguuaaaaacccagacuuacuaaauaaucaauuugguacaaugccuucacuaacacuugcaugccuaacaaaacaaggacaaguagaccuaaaugaugcaguacuagcuuugacagacuuaggacuuauauacacagcaaaauauccaaauucaagcgaccuagacagauuaucacaaucacauccaauauuaaacaugguagauacaaagaaaucaagucuaaacauaaguggcuacaauuuuagucuaggagcagcaguaaaagcuggugcauguauguuagaugguggaaauaugcuagaaacuauaaaagucacaccacaaacaguugacggaauacuuaaaaguauacuaaaaguaaaaagaagccuaggaauguucguaucagauacacccggcgaaagaaauccauaugaaaauauacuuuacaaaauaugucucuccggugauggauggccuuauauagcaagcagaacaucaauaguugggagagcaugggaaaauaccacaguggaccuagaaucagauggaaaaccacaaaaaguuggaaccgcaggaaguaauaaaucacuccaaagcgccggauucccaacaggauuaacauacucacaauuaaugacacuuaaagauuccaugaugcaacuagauccaagugcaaaaacauggauagauauagaaggaaggccagaagauccaguagaaaucgcguuauaucaaccuaugucaggauguuauauacacuucuuuagagaacccacagaucuaaaacaauuuaaacaagacgcaaaauauagccauggaauagacguagccgaucuauuuccuacacaaccgggguuaacaagcgccgucauagaagcauuaccucgaaauaugguccuaacuugucaaggaucagacgacauuaagagacuuuuagacucucaaggaagaagagacauaaaauugaucgacauagcgcuaaguaaagcagauaguagaaaauuugaaaaugcaguaugggaccaaugcaaagaccucugucacaugcauacaggagugguaguagaaaagaagaaacgaggagguaaagaagaaauuaccccucauugcgcauuaauggauugcauaauguaugacgcugcaguuucugggggacucaacauaccaguacuaagagcugucuuaccaagagacaugguuuuuagaacaagcagcccaaaaguuguguuauaa

SEQ ID NO: 2930 - RNA, 1710 nt, Artificial Sequence
  derived and/or modified CDS sequence (opt6) from Lassa virus__AIT17533__NP
augagcgcaagcaaagaaguaaaauccuuccuauggacacagucacuaagaagagaacuuucaggauauugcaguaacauaaaacuucaaguaguaaaagacgcucaagcacuuuuacacggacuagauuuuucagaaguaaauaauguacaacgucuaaugagaaaacaaaaaagagacgauucagauuuaaaaagauuacgagauuuaaaucaagcaguaaauaacuuaguagaauuaaagucaacucaacaaaaaaguauacuaagaguaggcaccuuaacuagcgaugaccucuuaacacuagcagcagaccuagaaaaacugaaauccaaaguaauaagaacagaaagaccacuaucaaguggaguauacaugggaaaccuuucaacacaacaacuagaacaacgacgagcuuuacuaaauaugaucggcauggcuggaggaacucaaggaacccaaccaggcagagauggagucguaagaguaugggacguaaaaaauccugauuuacucaauaaccaauuugguacaaugccuucacuaacucuagcuugcuugacuaagcaaggacaaguugacuuaaaugaugcaguccuagcguuaacagaccuaggacuuaucuauacugcaaaauauccaaacagcucagacuuggauagguuaucacagagucacccaauauuaaauaugguagauacaaaaaaaaguucauuaaacauaaguggauauaauuucucgcuaggagcagcaguaaaagcaggcgcauguaugcuagauggaggcaauaugcuagaaacuauuaaaguuacaccacaaacaauggauggaauauuaaaaucaaucuuaaaaguaaaaaggagucuaggaauguuuguaagugauacaccaggagaaagaaacccauaugaaaauaucuuauacaaaauauguuuaucaggagauggauggccauauauagcaucaagaacaagcauaguaggaagagcaugggaaaauacgacaguagaucuagaauccgauggaaaaccacaaaaaguaggaacagcagguucuaauaaauccuugcaaagugcaggauuuccaacaggacucacuuauagccaacuaaugacuuuaaaagauagcaugaugcaauuagauccaagugcaaaaacguggauagauaucgaaggaagaccagaagauccaguagaaauagcacuauaccaaccaaugucaggauguuauauucauuuuuucagagaaccaaccgauuuaaaacaauuuaaacaagacgcaaaauauucacacggcaucgacguagccgauuuauuuccagcccaaccuggacuuacaucagcaguaauagaagcacuacccagaaauaugguccuaacuugccaggguagugacgacauaaaaaaacuauuagacucacaaggaagaagagacauaaaacuaauagauauaucauuaucaaaaauagacucaagaaaauucgaaaacgcagucugggaucaaugcaaagauuuaugucauaugcauacuggagucguaguugaaaaaaaaaaaagaggaggaaaagaagaaauuacaccacauugcgcauuaauggacuguauaauguuugaugcugcaguaaguggaggauuaaacauacccguacuacgagcaguacuaccucgagauaugguauuuagaacaucuaguccaaagguaguacuauaa

SEQ ID NO: 2931 - RNA, 1710 nt, Artificial Sequence
  derived and/or modified CDS sequence (opt6) from Lassa virus__AIT17539__NP
augucagcaucaaaagaaguaaaaucauuccuauggacacaaucauuaagaagagaacuaucaggcuacugcucuaauauaaaauuacaaguaguaaaagaugcacaagcucuauuacacggacuagacuucuccgaaguauccaauguacaacgacuaaugagaaaacaaaaaagagacgauggcgaccuuaaaagacuaagagauuuaaaucaagcagucaauaacuuaguagaauuaaaaaguacacaacaaaaaaguguauuaagaguaggaacguuaacaagcgaugaccuacucauacuagcagcagauuuagagaaauuaaaaucaaaaguuauaagaacagaacgaccacucaguucuggcguauauaugggaaaccucucaacacaacaacuagaacaacgaaaagcacuuuuaucuaugauaggaaugguugggggagcacaaggaacccaaccaggaagagacggaguaguaagaguaugggacgucaagaacccugaccuauuaaauaaccaauucggaacaaugccaucauuaacacuugcaugcuuaacaaaacaaggacaaguagauuuaaacgacgcaguucuagcauuaacagacuuaggucuaauuuauacagcaaaauacccuaauuccucagaccuagacagauuaucacaaucacacccaauacuaaacaugguugauacuaaaaaaucaagucuuaacauaucaggcuacaauuuuucgcuaggagccgcuguaaaagcaggagcauguaugcuagauggagguaauauguuagaaacaauaaaagucaccccacaaacaauggauggaauacuaaaaucaaucuuaaaaguaaaaagaagcuuaggaauguuuguaucagacacaccaggagaaagaaacccauaugaaaacauucucuacaaaaucugucuaagcggagauggauggccauacauugcaagcagaacaucaaucguaggaagagcaugggaaaauacaacuguagaucuagaaucugacgggaaaccacaaaaaguaggaagcgcaggaucaaauaaaucauuacaaucagcaggcuuuccaacaggauuaacauauagucaguuaaugacauuaaaagauaguaugaugcaacuagauccaucagcuaaaacauggauugacauagaaggcaggcccgaagacccaguagaaaucgcuuuauaucaaccaaugucaggauguuauauucacuuuuucagagaaccaacagauuuaaaacaauuuaaacaagaugcaaaauacagccauggaauagacguaacugacuuauucucagcucaaccaggauuaacaagcgcgguuauagaagcacuaccaagaaauaugguauuaacaugucaaggaagugacgacauuaaaaaacuauuagacagucagggaagaagagacauaaaauuaauagauauaaguuuaggaaaggcagacucuagaagauuugaaaaugccgucugggaucaauguaaagauuugugccacaugcauacagguguaguaguagaaaaaaaaaaacguggagguaaagaagaaauaacaccgcacugugcacuaauggacugcauaauguuugacgcagcaguaucaggaggauuaaacaucccaauuuuaagagcaguacuuccaagagauaugguuuuuagaacaaguaguccuaaaguaguauuauaa

SEQ ID NO: 2932 - RNA, 1710 nt, Artificial Sequence
  derived and/or modified CDS sequence (opt6) from Lassa virus__AIT17541__NP
augucagcaagcaaagaaguaaaaaguuuccucuggacacaaucuuuaagaagagaauuaucaggcuacuguucaaauauuaaauuacaaguaguaaaggacgcucaagcacuauuacacggacuagacuucucagaaguaucaaauguacaaagacuaaugagaaaacaaaaacgagaugacggagaucuaaaaagauuaagagaccuaaaucaagccguaaauaacuuaguagaacucaaaaguacccaacaaaaaucaguauuaagaguaggaacauuaaguucagaugaucuauuaacacuagcagcagaucuagaaaaacuaaaaucgaaaguaauaagaacagaacgaccacuaucaaguggaguauacauggguaaucuaucaagccagcaacucgaccagagaagagcauuauuaaacaugauaggaaugacaagcgaccgacaaggugcaaguacaggaagagauggaaucguaagaguaugggacguaaaaaaugccgaauuacuaaauaaccaauucgguaccguuccaucccuaacucuagcaugcuuaaccaaacaaggccaaguagacuuaaaugaugcaguacaagcccuaacagacuuaggauuaauauauaccgcaaaauauccaaauaguuccgauuuagacagacuaucacaaagucacccaauauuaaauaugaucgauacaaaaaaaaguagccuaaauauuagcggcuacaacuucucauuaggagcagcaguaaaagccggagccuguaugcuagauggaggaaacauguuagaaacaauaaaaguaagcccccaaacaauggauggaauuuuaaaaucaauacuaaaaguaaaaagaucuuuaggaauguucguaucagauauacccggcgaaagaaaccccuaugaaaauauacuauauaaaauaugucuuuccggagauggauggccguacaucgccucaagaacaucaauaacuggaagagcaugggaaaacaccauaguagauuuagaauccgauucaaaaccccaaaaaccaggaaauucaggaagcaaucgcaguuuacaaucugcaggcuuuccagccggacuaacuuauucacaacuuaugacacuaaaagacuccaugcuacaacuggauccaaaugcaaagacauggauggacaucgaaggacgaccagacgauccaguagaaaucgcacuauaccaaccaucaucaggauguuauauacacuucuuuagagaacccacagaucuaaaacaauuuaaacaagacgccaaauauagccauggaauagacguuggagaucuauuugccgcacaaccaggauuaacaagugccguaauagaagcccuaccacgaaauaugguuauuacaugccaagggucagaagauauuaaaaaacucuuagaaagucaagggagaaaagauauaaaauuaguagauauaucaaugucaaaaccagacucaagaaaauuugaaaaugcuguaugggaucaauacaaagauuuaugucauaugcacacaggaauaguaguagaaaaaaaaaaaagggggggaaaagaagaaauaacaccacauugugcauuaauggauuguaucauguuugaugcagcaguaguagguggacuagacgcuagaauauuaagagccguacuccccagagauaugguauucagaaccucaacaccaaaaguaguauuauaa

SEQ ID NO: 2933 - RNA, 1710 nt, Artificial Sequence
  derived and/or modified CDS sequence (opt6) from Lassa virus__AIT17545__NP
augagugcauccaaagagguaaaauccuucuuauggacccaaucauuaagaagagaacucucagguuauuguucuaacaucaaauuacaaguaguuaaagacgcacaagcacuacuacacggauuagauuucucagaaguaaguaauguacaaagguuaaugagaaaacaaaaaagagacgauucagaccuaaaaagauuaagagaucuuaaucaagcaguaaacaaccuaguagaauugaaaucaacucaacaaaaaaguguacuaagaguuggaacacuaacuucagacgaccuacuaacauuagcugcagacuuagagaaauuaaaaucuaaaguaauaagaacugaaagaccauuaucaaguggaguauauaugggaaauuuaucaacacaacagcuagaacaaagaagagcauuacuaaauaugauaggaaugguaggaggagcacaaggcacacaaccaggaagagacggcguuguaagaguaugggaugucaaaaacccagaucugcucaauaaucaauucggaacuaugccaucucuaacacuagccuguuuaacaaaacaaggacagguagaccuaaacgacgccguacuugcacuuacagaucucggacucauuuauacagcaaaauacccaaauagcagugacuuagauagacuaagucaaucacacccaauucuuaacaugguugacacaaaaaaaucaagucuaaacauaucaggcuauaacuuuucacuaggcgcagcgguaaaggcaggagcauguaugcuagauggaggaaauaugcuagaaacuauaaaagugaccccacaaacaauggauggcauauuaaaaagcauauuaaaaguaaaaaaaagccuaggaauguuuguaagugauacaccgggagaacgaaacccauaugaaaauauauuauauaagauauguuuaucaggcgaugguuggccguauauagcaucaagaacauccauuguuggcagagcaugggaaaacacaacagucgauuuagaaucugauggaaaaccacaaaaaguagguauagcaggaagcaauaaaaguuuacaauccgcuggauuuccaacaggguugacuuauucacaacuaaugacauugaaagauucuaugaugcaacucgacccaagcgcaaaaacuuggauagacauagaaggaagaccagaagauccaguagaaauagccuuauaucagccgaugaguggaugcuacauccacuucuuuagagaaccaacagaucuaaaacaauuuaaacaagaugccaaauauucacauggaauagacguagcagaucuauucagugcacaaccaggcuuaacaagugcaguaaucgaagcuuuacccagaaauaugguguuaaccugucaaggaucagaugauauaaaaagacuauuagacucacaaggaaggagagauauaaaauuaauagacauugcuuuaaguaaagcagacagcagaaaauuugaaaacgcaguaugggaccaaugcaaagaccuaugucacaugcacacgggagucguuguugaaaaaaaaaaaagaggaggaaaagaagaaauaacaccacacugugcauuaauggauugcauaauguacgacgcggcaguaucaggaggacuugacauaccaguacuaagagcuguuuuaccaagagacaugguauucaggacaucaucaccuaaaguaguacuuuaa

SEQ ID NO: 2934 - RNA, 1710 nt, Artificial Sequence
  derived and/or modified CDS sequence (opt6) from Lassa virus__AIT17549__NP
augagcgcaaguaaagaaguaaagagcuucuuauggacucaaucacucaggagagaacuaagcggguauuguaguaacauaaaauuacaaguuguaaaagacgcucaagcauuauuacauggacuagauuucagugaaguaaguaauguacaacgacuuaugagaaaacagaaaagagacgacucagacuuaaaaagacuaagagacuuaaaucaagcgguaaauaauuuagucgaauuaaaaucaacucagcagaaaaguauacuaagaguaggaacauuaacaucagacgacuuauuaacauuagcagcagaucuagaaaaauuaaaaucaaaaguuauuagaacagaacguccacucucauccgguguuuauaugggaaauuuaucaacucaacaacuugaacaaagacgagcucuauuaaauaugauaggaaugguugguggagcacaaggaacacaaccuggaagagacgguguuguaagaguaugggacgucaaaaacccagaucuacugaacaaucaauuuggaacaaugccaagucuaacacuagcaugucuaacgaagcaaggacaaguugaccucaaugauguaguauuagcauuaacagacuuaggauuaauauauacagcuaaauacccuaauaguagugaucuagauagacuaucacaaucucacccaauauuaaacauggucgacaccaagaaaagcaguuuaaauauaagcggauauaacuuuucuuuaggagcagcuguaaaagcaggagcaugcaugcuagauggaggaaauaugcuagaaacaauaaaaguaacaccucaaacaauggaugguauacuaaaaucaauacuaaaagucaagaaaagucucggaauguucguaagugauacaccaggagaacgaaauccauaugaaaauauauuauacaaaaucugcuuaaguggagauggauggccauacauagcaaguagaacaucaauuguagguagggcgugggaaaauacaacaguagaccuagaaagugauggaaaaccacaaaaaguuggaacaguaggauccaauaaaucacuacaaucagcagguuuuccaacgggccuaacauauucacaauuaaugacacuaaaagauucaaugaugcaacuagacccaucggcuaaaacguggauagauauagaaggaagaccagaagauccgguagaaauugcacuauaccaacccaugagcggcuguuacauccacuucuucagagaacccacugaccuaaaacaauucaaacaagaugcaaaauauucacauggaauugauguagcggaucuauuuccagcacaaccaggucuaacuucagcagucauagaagcacugccaagaaauaugguauuaacuugccaaggcucugaugacauaaagaaacuauuagauucucaaggaagacgagacauaaaacuaauugacauagcauuaaguaaagcagauagccgaaaauucgaaaacgcuguaugggaccagugcaaagaccuaugucauaugcacacaggaguaguaguagaaaagaagaaaagaggagguaaagaagaaauaacaccacacugugcucuaauggacugcauaauguaugaugcagcaguaaguggagguuuaaauauuccaguacucagagcaguacucccaagagauaugguauucagaacaaguucaccaaaaguuguauuauga

SEQ ID NO: 2935 - RNA, 1710 nt, Artificial Sequence
  derived and/or modified CDS sequence (opt6) from Lassa virus__AIT17553__NP
augucggcaagcaaagaaguaaaaucauuuuuauggacacaaaguuuaagaagagaauuaucagguuauuguaguucaauaaaacuacaaguaguaaaagaugcucaagcauuauuacauggacuagacuuuucagaaguuucaaacguacaaagauuaaugcgaaaacaaaaaagagacgauagcgaccuaaaaagguuaagggaucuaaaccaagcagucaauaaccuaguagaacucaaauccacacaacagaaaucuauacuuagagucggaacauuaacuagugaugauuuauugacacuagccgcagauuuagaaaaguuaaaaaguaaaguaauaagaacagaaagaccacuaucaucagguguauacauggguaauuuaagcacccaacaacuugaacaaagacgagcucuauuaaauaugauaggaaugguuggaggagcacaaggaacacaaccagguagagauggcguaguuagaguaugggauguaaaaaaccccgacuuauuaaauaaccaauuuggaaccaugccaucacuuacacuagcaugccuuacaaaacaaggccaaguagaucugaacgacgcaguacuagcuuuaacagaccuaggacuuauauauacagcaaaauauccaaacagcagugaccuugaucgcuuaagucaaagccacccaauauuaaacauggucgauacaaaaaaaagcaguuuaaauauaucaggauacaauuucagcuuaggagcagcaguaaaagccggagcguguauguuagauggaggaaauauguuagaaacaauaaaaguaacuccucaaacaauggacggaauacuaaaaagcauauuaaaaguaaaacgcagccuaggaauguuuguaagcgauacaccaggagaaagaaauccauaugaaaauauacuauacaaaauaugucuaagcggagauggcuggccauauaucgcauccagaacaucaauaguaggaagagccugggaaaauacaacaguagaucucgaaagugacggaaaaccacaaaaaaugggaacagcaggaucaaacaaaaguuuacaaucagcaggcuuuccuaccggacucacuuauucucaauuaaugacucuaaaagacaguaugaugcaacuagauccaagugcaaaaacauggauagauaucgaaggaagaccagaagauccaguagagaucgcuuuauaucaaccaaugucaggaugcuacauacauuuuuuuagagaaccuacagaucuaaaacaauuuaaacaagacgcaaaauacagucacggcauagauguagcagaucuauuucccgcccaacccgguuuaaccagcgcaguaauagaagcauuaccacgaaacaugguacuaacuugccaagguucagaugauauaaaaaaacuauuagacagucaaggaagaagagauauaaaauuaaucgauauagcacuuucaaaagcagauucacgucgauucgaaaaugcagucugggaucaaugcaaagacuuaugucauaugcauacagguguaguuguagaaaaaaaaaaaagaggaggaaaagaagaaauaacaccacauugugcucuaauggauugcauaauguacgacgcagcaguuucagguggucucaauauaccaguucuaagagcaguacuaccaagagacauggucuucagaacaucaucaccaaaaguaguauuauaa

SEQ ID NO: 2936 - RNA, 1710 nt, Artificial Sequence
  derived and/or modified CDS sequence (opt6) from Lassa virus__AIT17561__NP
augagugccagcaaagaaguuaaaucauucuuauggacccaaucacuaagaagagaacucucuggauauugcucaaacauaaaacuacaaguagucaaagacgcacaggcauuauuacauggucuagacuucagcgaaguaaguaauguccaaagacuaaugcgaaaacaaaaacgagacgauucagauuuaaaaagacuaagagaccuuaaucaagcuguuaauaaucuaguagaacuaaaaucaacucagcaaaaaucaauccuccgaguuggaacauuaacaucagaugaucuucuaacauuagcagcagaccuagaaaaacuaaaaucuaaaguaauaagaacagaaagaccucucagcucaggaguauauauggguaaccuaaguacacaacaacuagaacaaagacgcgcucucuuaaacaugauaggcaugguugguggagcacaaggaacacaacccggccgggacggugucguuagagucugggauguuaaaaauccagaucuguuaaacaaucaauucggaacaaugccaucauuaacauuagcaugccuuacaaaacaaggccaaguagauuuaaacgaugcaguuuuagcacuaacagaucuaggauuaauuuauacagcaaaauauccaaauucaagcgaccuagacagauuaucacaaagucacccaauauuaaacaugguagacacaaagaaaucaagccuaaacauaucaggauauaauuucagucucggugcagcaguaaaagcaggagcauguauguuagauggaggcaauaugcuagaaacuauuaaaguaacaccacaaacaauagauggaauuuuaaaaaguauauuaaaaguaaagaaaucacuaggaauguucgugagugauacaccaggagaaagaaacccauaugaaaauauauuauacaaaauaugcuuaucaggagauggauggccuuacauagcaagcagaacaucaauaguaggcagagcaugggaaaauaccacaguagaucuagaaucagacggaaaaccacaaaaaguaggaacaguaggaaguaauaaaaguuuacaaucagcaggauucccuacaggacucacuuacucacaacucaugacauuaaaagacucaaugaugcaauuagacccuucagcaaaaacauggauagauauagaaggacgaccagaagacccaguagaaauagcauuauaccaaccaaugucaggauguuauauacacuucuuuagagaaccaacagauuuaaaacaauucaaacaagaugcuaaauauucccacgguauagauguagccgaucuauuuccagcacaaccgggcuuaacaagugcaguaauagaagcacugcccaggaacaugguauuaacaugucaaggaucagaugacauaaaaagacuucuagacagccaaggaagaagagauauuaaacuuauagauauagcgcuaaguaaagccgacaguagaagauuugaaaaugcaguaugggaccaauguaaagacuuaugucacaugcauacaggaguaguaguagaaaagaaacgaagaggaggaaaagaagaaauaacaccccacugugcacuuauggauuguauaauguacgacgccgcaguuucaggaggguuaaacauaccaguauuaagagccguacuaccacgggacaugguauucagaaccucaucaccaaaaguuguacuauaa

SEQ ID NO: 2937 - RNA, 1710 nt, Artificial Sequence
  derived and/or modified CDS sequence (opt6) from Lassa virus__AIT17565__NP
augagugcuucaaaagaaaucaaaucauuccuauggacacaaagucugagaagagaacuuucaggauauugcagcucaauuaaauuacaagucguaaaagacgcccaagcacuacuacacggauuagacuuuagugaggucaguaauguacaacgcuugaugcguaaacaaaaaagagacgacucagauuuaaaaagacuacgagacuuaaaucaagcaguaaauaaucuaguagaacucaaaucaacacaacaaaaaucaauacucagaguaggaacacuaacaagugacgaucuacuaacucuagcugcagaucuagaaaaauuaaaaucaaaaguaauaagaacagaaagaccucugaguucaggaguauauaugggaaacuuauccacacaacaacuagaacaaagaagagccuuacuaaacaugauagggaugguaggaggagcccaaggcacccaaccaggacgagauggagucguaagaguaugggacgucaaaaauccagauuuacuaaauaaccaauucggaacaaugccuaguuuaacuuuggccugcuuaacaaaacaaggacaaguagaccucaacgaugcaguacuugcauuaacagaucuaggacucauuuauacggccaaauacccuaacucuagugauuuagaccgauuaagucaaucucaucccauccuuaauaugguagacacaaaaaaaucaagccucaauauaucaggcuacaauuuuucuuuaggagcagcuguaaaagcuggagcaugcauguuagacggaggaaacauguuagaaacaaucaaaguaacaccacaaacuauggacggaauauuaaaaucaaucuuaaaaguaaaaagaagcuuaggaauguucguaagcgacgcaccuggcgaaagaaaccccuacgaaaauauucuauacaaaauauguuuaucaggagauggauggcccuauauagccucaagaacaaguauaguaggaagagcaugggaaaauacaacaguagaucuagaauccgauggaaaaccacaaaaaguaggcacagcaggaucaaacaaaucacuacaaucagcuggauucccaaccggauugacauauucccaauuaaugacauugaaagacagcaugaugcaacucgauccauccgcuaaaaccuggaucgauauagaaggacgacccgaagacccaguagaaauagcauuauaucaaccuaugucuggauguuauauacacuucuucagagaaccuacagaucuaaaacaauuuaaacaagaugccaaauacagccauggcauagauguugcagaucuauucccagcucaaccagggcuuacaucagcaguaauagaagcauuaccuagaaacauggucuuaaccugucaaggaucugacgauaucaaacgacuacuagacagccaaggucgaagagacauuaaauuaauagauauagcucuaucaaaagcagauucucgcaaauucgaaaaugcaguaugggaccaaugcaaagacuuaugccauaugcauacaggaguaguaguagaaaaaaagaaaagagguggaaaagaagaaauaacaccacauugugcacuuauggacugcauuauguaugaugcggcaguaucaggaggauuaaacauaccaguacuaagagcuguauuaccaagagauaugguuuucagaacuucauccccaaaaguagucuuauaa

SEQ ID NO: 2938 - RNA, 1710 nt, Artificial Sequence
  derived and/or modified CDS sequence (opt6) from Lassa virus__AIT17569__NP
augucagcaucaaaagaagucaaaaguuuccuauggacacaaucauuacgacgagaauuaucaggauauuguaguaauauaaaauuacaaguagucaaagacgcacaagcacuacuacacggauuagauuuuucagaaguaucaaacguacaaagacucaugagaaaacaaaaacgcgacgacucagaucuaaaaagacuaagagauuuaaaccaagcaguaaauaaucuaguagaauuaaaaucuacacaacaaaaaucaauacuaagaguaggaacucuaacaagcgaugauuuacuaacauuagccgcagaccucgaaaaauuaaaaucaaaaguaauaagaacugaaagaccacuuucaagcggaguauauaugggaaaccuaagcacacaacaacuagaacaaagaagagcacuccuaaacaugauaggaaugguuggaggugcacaaggaacucaaccaggaagagauggaguaguaagaguuugggauguaaaaaacccggaccuuuuaaauaaccaauuuggaacaaugccaagcuuaacacuagcaugccugaccaaacaaggacaaguagauuuaaacgaugcaguccuagcauuaacugauuuaggacuaauauacacagcuaaauuuccaaacucaucagacuuagacaggcuaagucaaucacauccaauucuaaacaugguagacaccaaaaaaucaucauuaaacauuagugguuacaauuuuaguuuaggagcagcaguuaaagcuggagccugcauguuagacggaggaaauauguuagaaacuauaaaaguaacaccacaaacaauggacggaauacuaaaaucaauauuaaagguaaaaaaaucuuuaggaauguucguaucagauacaccaggagaaagaaauccauaugaaaacauacuauacaagauauguuuaucaggagauggauggccuuacaucgcaucaagaacuucaaucgucggaagagccugggaaaacacaacaguagaucuagaaagcgauggaaaaccacaaaaaguaggaacaacgggaaguaauaaaucacuacagagugcaggcuucccaacaggucuaacauacucacaacugaugacauuaaaagauucuaugaugcaacuugauccuucagcaaaaaccuggauagauauagaaggaagaccagaagauccaguagaaauagcccuauaucaaccuaugagcggauguuacauccauuuuuuuagggaaccuacugaucuaaaacaauuuaaacaggacgcuaaauacucacacggaauugacguagccgacuuauuuccagcgcagccgggcuuaaccagugcaguuauagaagcauuaccaagaaacauggucuuaacaugccaaggaucagaugauauaaaaagauuguuagacucacaaggaagaagggauauaaaauuaauagauauagcccuauccaaagcagacaguagaagguucgaaaaugcaguuugggaucaaugcaaagacuuaugccauaugcacacaggcgucguaguagaaaaaaaaaaaagaggaggaaaagaagaaauaacaccucauugugcauuaauggacugcauuauguaugacgccgcagucucaggaggucuuaauuuaccagucuuaagagcaguauuaccaagagauaugguuuuuagaacgaguaguccuaaaguuguuuuauaa

SEQ ID NO: 2939 - RNA, 1710 nt, Artificial Sequence
  derived and/or modified CDS sequence (opt6) from Lassa virus__AIT17573__NP
augucagcuagcaaagaagugaaaucauuccuuuggacucaaucacuuagaagagaauuaaguggauauuguucaaacaucaaacuacaaguagucaaagaugcacaagcauuacuccacgguuuagauuucucagaaguaaguaacguacaaagacucaugcguaaacagaaaagggacgacagugaucucaaaagauuaagagauuuaaaucaagcaguaaauaauuuaguagaacuuaaaucaacacaacaaaaaucaauauuacguguaggaacauuaacauccgacgauuuauuaacacucgcagcagaucuugaaaaacucaaaaguaaaguaaucagaaccgaaagaccacuaucaaguggaguauacauggguaauuuaucaacacaacaauuagagcaaagaagggccuuauuaaacaugaucgguaugguaggaggugcacaaggaacucaaccaggacgagacggaguaguaagagucugggaugucaaaaauccagaucuauuaaauaaccaauucggcacaaugccaucauuaacacuagccugccugacaaaacaaggacaaguagacuuaaacgaugcaguuuuagcacuaacagaucuuggacuaaucuauacagcuaaauaucccaauaguagugaccuagacagacucagucaaagucauccuauccucaauaugguagauacaaagaaaucaucauuaaauauaaguggcuauaauuucucauugggagcagcaguaaaagcaggagcaugcauguuagacgggggaaacaugcuugaaacaauaaaaguaacuccacaaacaauggacggaauccuaaaauccauauuaaaaguuaaaaagagcuuaggaauguucguaagugauacacccggagaaaggaacccauacgaaaauauacuauacaaaauaugucucucaggagauggcuggccauauauagcaucaaggacaucaauaguuggcagagcaugggaaaauacaacaguagaccuagaaucagacggaaaaccacaaaaaguaggaacagcaggaagcaauaaaucauuacaaucagcuggauuuccaacaggacuaaccuacucucaauuaaugacgcuaaaagauucaaugaugcaauuagauccaucagcaaaaacauggauagauauagaaggacgaccagaggauccaguagaaauagcacuuuaucaaccaaugaguggauguuacauacauuucuuucgagaaccaacagaucuuaaacaguuuaaacaagaugcaaaauauucucauggaauagacauagcagacuuauuuccugcacaaccaggauuaacaagugcaguaauagaagcccuuccacgaaauaugguauuaacaugccaaggaucagaugacauaaaaagacuacuagauagucaaggaagaagagacauuaaauuaauagauauugcucuaaguaaagcugacucacgaagguuugagaacgcuguaugggaccaaugcaaagauuuaugucauaugcauacaggaguaguaguagaaaagaagaaaagaggaggaaaagaagaaauaacaccgcacugcgcauuaauggacugcaucauguaugacgccgcagucagcggaggauuaaauaucccuguacuaagagcaguacuaccaagagauaugguuuuccgaaccaguucuccuaaaguaguauuauaa

SEQ ID NO: 2940 - RNA, 1710 nt, Artificial Sequence
  derived and/or modified CDS sequence (opt6) from Lassa virus__AIT17577__NP
augucagcaaguaaagaaguuaaaaguuuucuauggacucaaaguuuaagacgugaacuuagcggauacugcaguucaauuaaacuacaaguaguaaaagacgcacaagcacuucuacauggauuagacuuuucagaagucagcaauguacaaagguuaaugcgcaaacagaaacgagaugauucagauuuaaaaagauuaagagacuuaaaccaagcaguaaauaaccuuguagaacuaaaaucgacucaacaaaaaucaauacuaagaguaggaacauuaacaucagacgaccuacucacauuagccgcagaucucgaaaaauuaaaaucuaaaguaauacgcacagaaagaccacuaaguagcggaguauacauggguaacuuaagcacccaacaacucgaacaacgaagagcauuauuaaauaugauaggaaugguaggaggugcacaaggaacacaacccggcagagacgguguaguaagagugugggauguaaaaaauccagauuuacuaaacaaucaauuuggaacaaugccaagucuaacccuagcuuguuuaacaaaacaaggucaaguugauuuaaacgaugcaguauuagcccuaacagaccuaggacuaaucuauacagccaaauauccaaauaguucugauuuagauagacuaagucaaucacacccaaucuuaaacaugguugauacaaaaaaaucuuccuuaaacauuucaggauauaauuucucuuuaggcgcugcagucaaagcaggagcauguaugcuagacggaggaaauaugcuagaaacaaucaaaguaaccccacagacaauggacggaauuuuaaaauccauacuaaaaguaaaacgaucccuaggaauguuuguaagcgauacaccaggagaacgaaauccauacgaaaauauauuauacaaaaucuguuuaaguggagauggauggcccuacauagcuucuagaacauccauagcggguagagcuugggaaaacacaacaguagauuuagaaagugacgguaaaccacaaaaaguuggcgcagcaggaaguaauaaaucucuacaaagcgcaggauucccaacaggauuaacauauucacaauuaaugacacuuaaagacucuaugaugcaacuagacccaucagcaaaaacauggauagacauagaaggaagaccagaagauccaguagaaauugcauuauaucaaccaaugucuggauguuacauacacuucuuccgagaacccacagauuuaaaacaauuuaaacaagaugcuaaauacucacauggcauagaugucgcugauuuauuucccgcucaaccagguuuaacuucugcaguaauagaagcuuuaccacgaaauaugguuuuaacaugucaaggaucagacgacauaaaacgacuacucgauagucaaggaaggagagauauaaagcuaauugauauagcacuaagcaaagcagauucaagaagauucgaaaaugcaguaugggaucaauguagagacuuaugucauaugcacacaggaguaguaguagagaaaaaaaaaagggguggaaaagaagaaauaacaccacacugugcauuaauggauuguauuauguacgaugcagcaguaucagguggcuuaaacauaccaguucuaagagcaguacuuccaagagauaugguguucagaacaucaucaccuaaaguaguacuauaa

SEQ ID NO: 2941 - RNA, 1710 nt, Artificial Sequence
  derived and/or modified CDS sequence (opt6) from Lassa virus__AIT17581__NP
augagugcaucaaaagaaguaaaauccuuccuauggacacaaagccuuagacgugaauuaaguggauauuguuccaguauuaaauuacaaguaguaaaagacgcacaagcacuauuacacggccuagauuucuccgaagucucaaauguacaacgucuaaugagaaaacaaaaaagggaugauucggaucuuaaaagauuaagagaccucaaucaagcuguaaauaaucuaguagaauuaaaaucaacacaacaaaaaaguguccuaagagucggaacacuaacaagugaugauuuacuaacacucgcagcagaucuagaaaaacuaaaaucaaaaguaauaagaacugaacgaccauuaagcuccggaguauauaugggaaaccuaagcgcacaacaauuagaacaaagaagaacacuauuaaauaugauaggaaugguagggggugcacaagguacucaaccuggaagagauggaguaguacguguaugggacguuaaaaauccagacuuauuaaauaaccaauuugguacaaugccuuccuuaacauuagcaugcuuaacuaaacaaggacaaguagacuuaaaugacguaguacuagcauuaaccgauuuaggguuaauauacacugcaaaauauccaaacagcucagaucuagacagacuaucacaaagucacccuauacuaagcauggucgauacaaaaaaaagcucucuuaacauaucaggauacaauuuuagcuuaggagcugcaguaaaagcuggagcauguauguuagacggaggaaauauguuagaaacaauaaagguaacaccccaaacaauggacggaauuuuaaaaucaaucuuaaaaguaaaaaaaucauuaggaauguucguaucagauacaccaggugaaagaaacccauaugaaaacaucuuauacaaaauauguuuaagcggagauggcuggccauauauagcuagcagaacaagcauaguaggaagagccugggaaaauaccacaguagaccuagaaucagacggaaaaccacaaaaaguaggaacagcagguucuaauaaaucacuucaaucugcgggauuuccuacaggucuaacauauagucaauuaaugacauuaaaagacaguaugaugcaacuggauccaucggcaaaaacauggauagauauagaaggaagaccagaagacccaguugaaauagcacuauaucaaccuaugucaggcuguuauauacacuucuucagagaaccaacagaccuaaaacaauuuaaacaagacgcaaaauacucccacggcauagacguaacagaucuauucccagcacaaccaggccuaacaagcgcaguaaucgaagcacuaccaaggaacaugguacuaacuugucaaggaucagacgauauaaaaagacuacuagacucacaaggcagaagagauauaaaauuaauagauauagcacucucaaaagcagacaguaggagauucgaaaacgcaguaugggaccaaugcaaagaccuaugucauaugcacaccggcguaguuguagaaaaaaaaaaaagaggaggaaaagaagaaauaaccccucacugugcacuaauggacugcauaauguacgaugcagcaguaaguggaggacuuaacauaccuguacuaagagcaguccuaccaagagacaugguuuucagaacaaguagcccaaaagucguacuauaa

SEQ ID NO: 2942 - RNA, 1710 nt, Artificial Sequence
  derived and/or modified CDS sequence (opt6) from Lassa virus__AIT17589__NP
augucagcaagcaaagaaguaaaaucauucuuauggacacaaucccuaaggagggaauuauccgguuauuguaguaguauaaaauuacaaguaguaaaagaugcacaagcacucuuacacggauuagauuuuucagaaguaagcaauguccaacgacucaugcguaaacaaaaaagagaugacucagaucuaaaaagauuaagagauuuaaaucaagcaguuaauaacuuaguagaacugaaaucaacucaacaaaaaagcauacuucgaguugguacccuaacaagcgacgauuuacuuacauuagcagcagaucuagaaaaguuaaaaucaaaaguaauacgaacagaaagaccauuaucaucagggguauauaugggaaauuuaagcgcacaacaauuagagcaaagaagagcacuacuaaauaugauuggaaugguagggggagcacaagguacucaacccggaagggacggaguaguucgaguaugggacguaaaaaacccagacuuacuaaauaaucaauucggaacaaugccaagucucacccuagccugccuuacaaaacaaggacaaguagauuuaaacgaugcaguacucgcacucacagaucuaggacuaauauacacagcaaaauauccuaauaguucagauuuagauagacuaucacaaucacacccaauauuaaauaugguagacacaaaaaaaucuuccuuaaauauuaguggcuauaauuucucgcuuggugcagcaguaaaagcaggagccuguauguuagauggagguaacaugcuagaaacaauaaaaguaacaccccaaacaauggacgguauauuaaaauccauacuaaaaguaaaaagaucacugggaauguuugugucagacacaccaggcgaaagaaauccauaugaaaauauauuauauaaaauauguuuaucaggagacggauggccauauauagccagccguacauccauaguuggaagagcaugggaaaauacaacaguagaccuagaaagugaugguaaaccacagaaaguaggaacuacaggaucaaacaaaucacuacaaucagcaggauucccuaccggacuaaccuauucacaacuaaugacucugaaagauagcaugaugcaacucgauccaagugcaaaaacauggauagacaucgaaggaagaccugaggauccuguagagauagcacuauaccaacccaugagcggauguuacauucauuuuuuuagggaaccgacagauuuaaaacaauuuaaacaagacgcaaaauacagucacggaauagacgucgcagaccuuuuuccagcacaaccaggcuuaacaagugcaguaauagaagcacuaccaagaaacaugguacuaaccugucaaggaucggaugacauaaaaaaacuauuagauucacaaggaagacgagauauaaaauuaauugauauagcauuaucaaaagcagauagucgaaaauuugaaaacgcaguaugggaccaauguaaagaucuaugccacaugcacacaggaguaguuguggaaaaaaaaaaaagagguggaaaagaagaaauaacuccacacugugcauuaauggauugcauaauguaugacgcugcaguauccggcggcuuaaacauaccuguacuuagagcaguauuaccaagggauaugguuuucagaacgucaagcccaaaaguaguauuauaa

SEQ ID NO: 2943 - RNA, 1710 nt, Artificial Sequence
  derived and/or modified CDS sequence (opt6) from Lassa virus__AIT17593__NP
augucagcuucaaaagaaguaaaaagcuucuuauggacacaaucccuaagaagagaauuaaguggauauuguaguucuauaaaacuacaaguaguaaaagaugcucaagcauuauuacauggacuagauuuuucagaaguaaguaacguucaaagauuaaugagaaaacaaaaaagagacgauggagaucuaaaacgacuucgagacuuaaaucaagcaguaaauaaucuaguagaauuaaaaaguacacagcaaaaaucaauauuacgaguaggaacacugacuagcgaugaccuccuuacuuuagcagcagacuuagaaaaacuuaaaucaaaaguaauaagaacagaaagaccccuaaguagcggagucuacaugggcaacuuaucuucacaacaacuagaacaacgaagggcacuauuaaauaugauagggauggucggcggcgcacaaggaacacaaccgggaagagacggagucguaagaguaugggaugucaaaaauccugaccuccuaaacaaucaauucggaacaaugccaagccuaacucuagcaugccuaaccaaacaaggacaaguagacuuaaaugaugcaguauuagcauuaacagaucuuggacuaauuuauacagcaaaauauccaaauuccagcgauuuagacagauuaucacaaucacacccaauauuaaacaugguagauacaaaaaaaagcucauuaaacauaaguggauacaauuucucguuaggagcagcuguaaaagccggagcaugcauguuagauggaggaaauauguuagaaacuauaaaaguaacuccacaaacaauggaugguauacuaaaaucaauauuaaaaguaaaaagaucuuugggaauguuuguaagcgauacaccgggagaaagaaaucccuacgaaaauauauuauacaaaauauguuugucaggagaugguuggcccuauauagccagccgaacaucuauuguagguagagccugggaaaacacaacaguagaucuggaaagcgauggaaaaccgcaaaaagucggagcagcaggcuccacaaaaucacuacaaucagcuggauuuccaacaggccuaacauauagccaacuaaugacauuaaaagauaguaugaugcaauuagauccaagcgcaaaaacuuggauagauauagagggaagaccugaagauccaguagaaauagcauuauaccaaccaaugucagguuguuauauacacuucuuucgagaaccaacagaucuaaaacaauucaaacaggacgcaaaauauagucacggaauagacgucgcagacuuauuuccugcucaaccaggcuuaacuagcgcuguaauagaagcacuaccaagaaauaugguguuaacaugccaagguagugaugauauaaaaagacuacuagacagucaagguagacgagauauaaaauuaauagauauagcauuauccaaagucgacucaagacgauuugaaaaugcaguaugggaucaaugcaaagaccucugucauaugcauacaggaguaguaguagaaaaaaaaaaaagaggagggaaagaagaaauaacaccacacugugcauuaauggauuguauuauguaugacgccgcagucagcgguggauuaaacauaccaguauugagagcaguacuaccaagagauaugguuuucaggacaucaaguccgaaaguuguucuauaa

SEQ ID NO: 2944 - RNA, 1710 nt, Artificial Sequence
  derived and/or modified CDS sequence (opt6) from Lassa virus__AIT17605__NP
augucugcaaguaaagaaguaaaaucauuuuuauggacacaaucacugagaagggaacuaagugguuauuguucaucaauaaaauuacaagucgucaaagaugcgcaagcucuauuacauggauuagauuucucagaaguaaguaauguacaaagacuaaugagaaaacagaaaagagacgauucagauuuaaaaagacuaagggaucuaaaucaagcagucaauaauuuaguagaauugaaaucaacucaacagaaaagcauccuaagagucggaacauuaacaagugaugaccucuuaacucuagcagcagaucuagaaaaauuaaaaaguaaaguuauaagaacagaaagaccauuaagcucuggaguauauaugggaaauuuaaguacacaacaauuagaacaaagacgagcuuuacuaaauaugauuggaauggcaggaggugcucaaggaacacaaccaggaagagauggaguaguaagagugugggauguuaaaaauccagaccuucuuaauaaucaauuugguacaaugcccucauugacucuagcaugcuuaacaaaacaaggacaaguagauuuaaacgacgccguacuagcacuaaccgaucuaggauuaauauauaccgcuaaauaucccaauaguagugauuuagacaggcuaagucaaucacauccaauacuaaauaugguagauacaaagaaaucuagucuaaacaucuccggauauaauuucucacuaggugccgccguaaaagcaggagcauguaugcucgacgggggaaacaugcuugaaacaauaaaaguaacaccacaaacaauggaugguauacuaaaaaguauacuaaaaguaaagaaaaguuuaggaauguucguaucagauacaccaggagaaagaaacccauaugaaaacauauuauauaaaauaugucuaucaggugacggcuggccauacauagcaagcaggacaagcauaguaggacgugcaugggaaaauacaacaguagauuuagaaucagacggaaaaccacaaaaaguaggaaccgcuggcucaaacaaaucacugcaaucagcaggauuuccaacaggauuaacauacucccagcucaugaccuuaaaagacagcaugaugcaauuagauccaucagccaaaacauggauagauauagaaggaagaccagaggacccaguagaaauagcauuauaccaaccgaugucaggaugcuauauacacuucuuucgagaaccaacagaucuuaaacaauuuaaacaagacgcaaaauauucacauggaauagacguagcagaccuauuuucagcgcaaccaggauugacaucagcaguaauagaagcucugcccagaaauaugguacucacaugucaaggaucagaugauauaaaaagauuacuagauucacaaggaagaagagacauaaaauuaauagauauagcgcuaucaaaggcagacucaaggcgauuugaaaacgcaguaugggaucaaugcaaagauuuaugucauaugcauacaggaguagucguagagaaaaagaaaagaggaggaaaagaagaaauaacaccacauugugcauuaauggacuguauaauguaugacgcugcaguaaguggaggauuaaacauaccaguuuuaagagccguacuaccacgagauaugguauucagaacaucuaguccaaaaguaguuuuauaa

SEQ ID NO: 2945 - RNA, 1710 nt, Artificial Sequence
  derived and/or modified CDS sequence (opt6) from Lassa virus__AIT17609__NP
augucagccucaaaagaaguuaaaucuuucuuauggacgcaauccuuacguagagaacuaagugguuauugcaguaguauaaaauuacaagucgucaaagaugcacaagcacuacuucacggacuagauuucucagaaguaucaaauguacaacgauuaaugcgaaaacaaaaaagggacgacagugacuuaaaaagauuacgagauuuaaaucaagcaguaaauaauuuagucgaauuaaaaaguacccaacaaaaaucaauauuacgaguaggcaccuuaaccagugaugaucuucuaacacucgcugcagauuuagaaaaacuaaaaagcaaaguuauacgaacagagagaccacuaucaucaggaguauacaugggaaaccuaagcacgcaacaacuagaacaaagaagagcauuauuaaauaugaucggaauggcuggaggugcacaagguacacaaccaggaagagauggaguaguaagaguaugggaugugaaaaacccugaccuucuaaacaaccaauucggcaccaugccaucauuaacacuggcaugcuuaacaaaacaaggacaaguugauuugaaugaugcaguucuagcauuaacagaucuaggccuaauauauacagcaaaauaucccaacaguucugaccuagacagacucucacaaucacacccaauccuaaacaugguagauacaaaaaaaucaaguuugaacauaagcggauauaauuucucacuaggcgcagcaguaaaagcaggugcauguauguuagacggaggaaauauguuagaaacaauuaaaguuacaccacaaacuauggacggcauacuuaaaucuauacuaaaagugaaaagaagccuuggaauguuugucucagauacaccaggcgaaagaaacccauaugaaaauauauuauacaaaauuugucuauccggagauggauggccauacauagcuucaaggacaucaauagucggaagagcaugggaaaacacuacugucgaccuugaaucggacggaaaaccacaaaaaguaggagcagcaggaucaaauaagucucuacaauccgcgggauuuccaacaggcuuaaccuauucucaacuaaugacccuaaaagauaguaugaugcaacuagauccuucagccaaaacauggauugauauagaaggacgaccugaagacccuguagaaaucgcacuauaccaaccuaugucaggaugcuauauacauuucuuuagagaaccaacagaccuaaaacaauuuaaacaagacgcuaaauauagucacggcauagauguagcggaucuauucccagcacaaccaggacuaacaucagccguaauagaagcauuaccaagaaacaugguuuugacaugucaaggaagugacgauaucaaaagauuauuagauucacaaggaagaagagacauaaaauuaauagacauagcauuaaguaaagcagauaguagaagauucgaaaacgccguaugggaucaaugcaaagaucuaugccauaugcacacaggaguaguuguugaaaaaaaaaaaagaggagguaaagaagaaauaacaccacacugugcacuaauggacugcauaauguaugacgccgcaguaaguggcggauuaaacauaccaguauuacgagcaguauuacccagggacaugguauucagaacaaguagcccaaaaguaguauuauaa

SEQ ID NO: 2946 - RNA, 1710 nt, Artificial Sequence
  derived and/or modified CDS sequence (opt6) from Lassa virus__AIT17613__NP
augagcgcaucaaaagaaguaaaaaguuuuuuauggacacaaucacuaagaagagaacuaagcggauauugcucaaauauaaaauuacaaguaguaaaggacgcucaagcauuacuacacggauuagauuucucagaaguuaguaauguacaaagauuaaugagaaaacaaaaaagagacgauucagacuuaaaaagacucagagauuuaaaucaagcuguaaauaacuuaguugaacucaaaagcacacaacaaaaaucaauauuaagaguuggaacauuaacaagcgaugacuuauuaacacuugcagcugauuuagaaaaauuaaaaucaaaaguuauacgaacagaaaggccacuaaguuccgguguauauaugggaaacuuauccacacaacaacuagaacaaagacgagcacuacuaaauaugauagguaugguuggaggugcacaaggaacacaaccaggacgcgacggcguuguaagaguaugggauguaaaaaacccggaccuacuaaauaaucaauuuggaaccaugccaucauuaacacuagcaugucuaacgaaacaaggacaaguagaucuaaaugaugcuguauuagcauuaacagaccucggauuaauauauacagcaaaauauccaaauagcucagauuuagaucgauuaucacaaagccauccaauacugaacaugguugauacaaaaaaauccucauuaaauauaagcgguuacaauuucagcuuaggggcugcuguuaaagcaggugcaugcauguuagauggaggaaauaugcuugaaacuaucaaaguuacaccacaaacgauggauggaauacuaaaaucaauacuaaaaguaaaaagaucacuaggaauguucguuagugauacaccuggugaaagaaauccauacgaaaauauucuauauaaaauauguuuaaguggcgacggauggccauacauagcaucaagaacaucaauaguagguagagcaugggaaaauacaacaguagaucuugaaagugacggaaaaccacaaaaaguagguacugcaggcucaaacaaaucacuccaaagcgcagguuuuccuaccggauuaacauauagccaacuaaugacauuaaaagauucaaugaugcaacuagauccaucagcaaaaacauggaucgauaucgaaggacgaccagaagacccaguagaaauagcacuauaucaaccuauguccggaugcuacauacacuucuucagagaaccaacagaccuaaaacaguuuaaacaagacgcuaaauauagucauggaauugacguagcagauuuauucccagcacaaccaggauuaaccucugcaguaauugaagcacuuccacgaaacauggucuuaaccugucaaggcagcgaugacauaaaaagauuacuagacucacaaggaagaagagacauaaaacuaauagauauagcacuaucuaagacugauagucgccgauucgaaaacgcuguaugggaucaauguaaagaccuaugucauaugcauaccgguguaguaguagaaaaaaaaaaaagaggaggaaaagaagaaauuaccccacacugugcauuaauggauugcauaauguaugacgcagcaguaucaggagguuuaaacauaccaguucucagagccguuuuaccaagagacaugguauucagaacaucaagcccaaaagucguacucuaa

SEQ ID NO: 2947 - RNA, 1710 nt, Artificial Sequence
  derived and/or modified CDS sequence (opt6) from Lassa virus__AIT17617__NP
augagcgcuuccaaagaaguuaagaguuucuuauggacccaaucauuaagaagagaauuaaguggauauugcaguaguauaaaacuucaaguuguuaaagacgcacaagcacuacuacacggacuagacuucagugaaguauccaacguacaaagguuaaugagaaaacaaaaaagggacgauuccgauuuaaaacgauuaagagaccuaaaucaagcaguaaacaaccucguagagcuaaaaucaacacaacaaaaaagcauauuaagaguaggcacuuuaacaucugaugacuuacuaacauuagcagcagaccuagaaaaacuaaaauccaaaguaauaagaacagaaagaccucuaucaucaggcguauauaugggaaaccuaucagcccaacaacuugaacaaagaagagcacuucugaauaugauaggaaugguaggcggagcacaaggaacucaaccuggaagagauggagucguaagaguaugggauguuaaaaacccagauuuauuaaauaaucaauucggaacaaugccaucuuuaacccuagcaugccuaacaaaacaaggucaaguugaucuaaacgacgcaguauuagcacuaacugacuuaggauuaauauauacagcaaaauauccuaacucaagugaccuagacagacuaagucaaucacacccaauacucaacaugguagauacaaaaaaaaguucauugaacauaagcggauuuaauuuuucacuaggugccgcaguaaaagcaggagcauguauguuagacggaggcaauaugcuagaaacaauaaaaguaacuccacaaacgauggacggaauauuaaaaagcauauuaaaaguaaaaagaagcuuaggaauguuugucagcgacacaccaggagaaagaaacccauaugaaaacauauuauauaaaaucugucuaucgggcgauggauggccauauauagcuucaagaacgagcauaguuggacgagcaugggaaaacacaacuguagaucuggaaagugauggaaaaccacaaaaaguaggcacagcaggaaguaauaaaucacuacaaagugcaggauuuccaacaggacuaaccuacagucaauuaaugacacuuaaagauagcaugaugcaacuagauccaucagcaaaaacauggauagacauagaagggagaccagaagacccaguagaaauagcacuauaucaaccaaugucaggauguuacauacacuuuuuuagagaaccaacugaucugaaacaauucaaacaagaugcuaaauauucacauggaauugacguggcagaucuauuucccgcccaaccaggauuaacaucugccgugauagaagcacuaccuagaaacaugguacuaacgugucaaggaagcgaugauauaaaaagauuauuagauucacaaggaagaagagacauaaaacuaauagacauagcuuuaagcaaagcagauucaagaagauuugaaaaugcaguaugggaccaauguaaagauuuaugucauaugcauacaggaguaguaguagaaaaaaaaaaacgaggaggaaaagaagaaauaacaccccauugugcauuaauggauuguaucauguaugacgcagcaguuucagguggacugaacauacccguccuaagagcaguacuacccagagauaugguguucaggacuuccucacccaaaguaguucuauaa

SEQ ID NO: 2948 - RNA, 1710 nt, Artificial Sequence
  derived and/or modified CDS sequence (opt6) from Lassa virus__AIT17621__NP
augagugcaaguaaagaaguaaaaucauuuuuauggacgcaaagccucagaagagaacuaaguggauacuguagcagcauaaaauuacaaguaguaaaagaugcacaagcacuauuacacggacuagauuuuucugagguuacuaauguccaacgauuaaugcgaaaacaaaaacgagacgauagcgauuuaaaacgauuaagagaccuaaaucaagcaguaaacaacuuaguagaauuaaaaaguacccaacaaaaaucaauauuaagggucggaacacuaacuagcgaugaucuauuaacauuagccgcagaccuagaaaaauuaaaaagcaaaguaauaagaacagaaagacccuugagcucaggaguauacaugggaaaccucucaacacaacaacuagaacaaagacgagcacuacucaauaugauuggaaugguaggaggagcacaaggaacacaaccaggaagagauggaguagucagagucugggacguuaaaaauccagaucuuuuaaauaaucaauucggaacaaugccaagucuaacauuagcauguuuaacuaaacaaggacaaguugaucucaaugaugcaguucucgcauuaacugaucuuggauuaauauauacagcaaaauauccgaacucuucagacuuagauagauuaagccaaucucacccaauacucaauaugguagacaccaagaaaaguucacuaaauauaucaggauauaauuucagucuuggugcagcuguaaaagcaggagcaugcaugcuagacggcggaaacaugcuugaaacuauaaaaguaacaccacaaacaauggauggaauauuaaaaucaauuuuaaagguaaaaagaucacuaggaauguuuguaucagauacaccaggagaaagaaauccuuacgaaaauauauuauacaaaauauguuuaaguggcgauggauggccauauauagcaaguagaacaucaauaguagguagagcaugggaaaauacaacaguagaucuagaaucagacggaaaaccccaaaaaguuggaauagcaggaucaaacaaaaguuuacaaagcgcaggguuuccaacaggauuaacauacucacaacuuaugacauuaaaagacagcaugaugcaacucgauccaucagcgaaaacauggauagacauagaaggcagacccgaagacccuguggaaauagccuuguaccaaccuaugaguggauguuauauucauuucuuuagagaaccaacagaccugaaacaauuuaaacaagaugcaaaauauagccacgguauagauguugcagaccuauuuccagcacagccaggcuuaacaagugcaguaauagaagcucuaccaagaaacauggucuuaacaugccaaggaucagacgacauaaaacgauuacuugacucacaaggaagaagagacauaaaacuaaucgauauagcauuaaguaaggcagacucccgaaaauucgaaaaugcaguaugggaccaauguaaggaccuaugucacaugcauacaggaguaguuguagaaaagaagaaaagaggaggaaaagaagagauuaccccacauugugcacuaauggauugcauaauguacgaugcagcaguaucaggaggauuaaauauaccaguacuaagagcaguauuaccacgagauaugguauuuagaaccagcagcccaaaaguaguauuauaa

SEQ ID NO: 2949 - RNA, 1710 nt, Artificial Sequence
  derived and/or modified CDS sequence (opt6) from Lassa virus__AIT17625__NP
augagugcuucaaaagaaguaaaaucauucuuauggacucaaucacuaagacgagaauuaucaggcuauugcucaagcauaaaacuacaaguuguaaaagacgcucaagcucuacuacacggauuagacuucucagaaguaucgaauguacaaagacuaaugagaaaacaacgaagggacgacucagauuuaaaaagauuacgagaccuaaaucaagccguaaauaaccuuguagaacuaaaguccacgcaacaaaaaucuauauuaagaguagggacucuaacaucagaugaccuauuaacacuagcagcagaucuagaaaaauuaaaaucaaaaguaaucagaacagaaagaccucuaagcagcggaguauacaugggaaaccuaucuacacagcagcuagaacaaagaagggcccuauuaaacaugaucggaaugguaggaggugcacaaggcacgcaaccagguagagauggaguaguaagaguaugggacguaaaaaauccagacuuacuaaauaaucaauuuggaaccaugccauccuuaacacucgcaugccuaaccaaacaaggacaaguagaucuaaaugaugccguacuugcauuaacagauuuaggauuaauauacaccgcaaaauacccaaacucuucagacuuagacaggcuaagccaaucacauccaauacuaaauaugguagauacaaaaaaaaguucacuaaacauaucaggauacaauuucucacuaggagcagcuguaaaagcaggagcauguaugcucgauggcggaaauauguuagaaacuauaaaaguaacaccacaaacaguagauggaauacuuaaaucaauacuaaaaguaaaacgaaguuuggguauguucguaagcgauacgccaggagaaagaaauccauaugaaaauauauuauacaaaaucugucuaucaggagauggcuggccauauauagcaaguagaacaucaaucguaggacgggcuugggaaaauacaacaguagaucuagaaagugacggaaaaccacaaaaaguaggaaccgcagguucaaauaaaagucuacaaagcgcuggauuucccacaggccuaacauauucacaauuaaugacauugaaagauucaaugaugcaacucgacccaagugcuaaaacauggauugauaucgaaggacgaccugaagauccaguugaaaucgcacuauaccaaccaaugucaggaugcuacauacauuuuuuuagagaaccaacagauuuaaaacaauuuaaacaagacgcuaaauauagccauggaauagacguugcagauuuauuuccagcacaaccuggauuaacaucagcaguaauagaagcacuaccaagaaacaugguacuuacaugucaaggauccgacgacauuaaaagacuacuagacucgcaaggaagaagagauauaaaauuaaucgacaucgcacuaucaaaagcagacaguagaaaauucgaaaacgcaguaugggaccaaugcaaagauuuaugccacaugcauacuggaguugucguagaaaaaaaaaaaagaggaggaaaagaagaaauuacaccacacugcgccuuaauggauuguauaauguacgaugccgcaguaaguggaggacuaaacauaccaguacuaagagcuguuuuaccaagagauaugguauuuagaacaucaucacccaaaguaguauuauaa

SEQ ID NO: 2950 - RNA, 1710 nt, Artificial Sequence
  derived and/or modified CDS sequence (opt6) from Lassa virus__AIT17627__NP
augagcgcaaguaaagaagucaaaucauuccuauggacacaaagccugagacgcgaacuaucaggauauugcaguucaauaaaauuacaaguagucaaagacgcacaagcacuacuacacggacuagauuuuucagaaguaaguaauguacaaagauuaaugagaaaacaaaagagagacgacagcgaucuaaaaagauuaagagaucuaaaccaagcaguaaauaacuuagucgaauuaaaaagcacacaacagaaaagcauauuaagagucggaacauuaacuucagaugauuuacuaacccucgcagcagacuuagaaaaauuaaaaucaaaaguaauaagaacagaacgaccauuaucaucaggaguauauauggguaaucuaaguucucaacaacuagaacaaagacgagcauuauuaaauaugauaggaaugguaggaggagcacaagguacacaaccgggaagagacggaguaguuagaguaugggacguuaaaaauccagaucuauuaaacaaccaauucggaacaaugccaagccuuacuuuagcaugucuaacgaaacaaggccaaguagaucuuaaugaugcuguacuagcauuaacagaucuuggacuaauauauacagcuaaauauccaaauucaucagacuuagacagacuuagucaaucacacccaauauuaaacaugguagauacaaagaaaucaucccuaaacauaagugguuacaauuuuagucuaggagcagcuguaaaagcuggagcaugcaugcuagacggaggaaauauguuagaaacaauaaaaguuacaccacaaacgauggauggaauacuaaaauccauacuaaaaguuaaaagaucacuaggaauguucgucucagauacaccaggagaaagaaauccauaugaaaauauauuauacaaaauaugucuaucaggagauggauggccauauauagcuaguagaaccaguauaguugguagagcaugggaaaauacaacaguagaucuagaaagcgacggaaaaccacaaaaaguaggaucagcaggaucaaauaaaucauuacaaagugcaggauuuccaacuggacuuacguauagccaacucaugacacuuaaagauucaaugaugcaacuagacccaucugccaaaacauggauagacauagaaggacgaccugaagauccaguagaaauagcuuuauaucaacccaugucaggauguuacauacacuuuuucagagaaccuacagaucuaaaacaauuuaaacaagacgcaaaauacucacauggaauagacguagcagacuuguucccugcucaaccaggacuaacaucagcaguuauagaagcauuaccaagaaacaugguguuaacaugucaaggauccgaugauauaaaacgucuacucgacagucaaggacgaagagacauaaaauuaaucgauaucgcacuaagcaaagcagacucaagacgauucgaaaaugcaguaugggaccaaugcaaagaccugugccacaugcacacaggaguaguagucgagaaaaagaaaagaggaggaaaagaagaaauaaccccacacugcgcauuaauggacugcaucauguaugacgcagcaguauccggaggauuaaacauaccaguucuacgagcagucuugccuagagauaugguauucagaacaucaagcccuaaaguaguauuauaa

SEQ ID NO: 2951 - RNA, 1710 nt, Artificial Sequence
  derived and/or modified CDS sequence (opt6) from Lassa virus__AIT17631__NP
augagcgcuagcaaagaaauuaaaucauucuuauggacacaaucacuuagaagagaacucaguggauauuguagcaguauuaaacuucaaguaguaaaagacgcacaagcccuucuacacgguuuagauuuuucagaaguuagcaacguacaaagauuaaugagaaaacaaaaacgagacgauagugauuuaaaaagauugagagaccuaaaucaagcgguaaauaaccuaguagaacuaaaaucaacccaacaaaaaucaauuuuaagaguagguacauuaacaucagaugacuuacuaacgcuagcagcagaucuagaaaaauuaaaaucaaaaguaauaagaacagaaagaccucuaucaaguggaguauauaugggaaaccuaaguacacaacaauuagaacaacguagagcauuauuaaauaugauaggaaugguugggggcgcacaaggaacacaaccaggaagagauggaguaguaagaguaugggauguuaaaaauccugacuuauuaaacaaccaauucggaacaaugccaucgcuaacauuagcuugcuuaacaaaacaaggccaaguagaucuaaaugacgcaguacuggcauuaacagacuuaggauuaaucuacaccgccaaauacccaaauucaucagauuuagacagacuaucacaaucacaccccauauuaaacaugguagauacaaagaaaucaucauuaaacauaaguggguauaacuuuucacuaggagccgcaguaaaagcaggagcauguaugcuagacggcggaaacauguuagaaacuauaaaaguuacaccacaaacaauggacggaaucuugaaaucaauauuaaaagucaaaaggucauugggaauguucguaucagaugcuccaggagaaagaaauccauaugaaaauauacuguauaaaaucugucuaucaggugacggauggccauauauagcaucacgaacgucaauaguaggcagagcaugggaaaacacuacugucgauuuggaaagugauggaaagccccaaaaggucggaacugcaggaucaaacaaaagccuacaaagcgccggauuccccacuggacuuacauauagucaacugaugacacuaaaagauaguaugaugcaauuagauccaucagcaaaaaccuggauagauauagaaggcagaccagaagauccaguagaaauagcacuauaccaaccuaugucaggaugcuacauccacuucuuuagagaaccuacagauuuaaaacaauuuaaacaagacgcaaaauauagucauggaauagacguagcggauuuauuuccagcucaacccggauuaaccucagcagucauagaagcacuaccaaggaauauggucuuaacaugucaagguucagacgacauuaaaagauuacucgacucacaaggaagacgagacauaaaacuaaucgauauagcauuaucaaaagcagacucaaggagauuugaaaacgcaguaugggaccaaugcaaagacuuaugccacaugcauacaggaguaguaguugaaaagaagaaaaggggaggaaaagaagaaauaacaccccauugcgcauuaauggauugcauuauguaugacgcagccguaagcggcggacucaauauaccuguauuaagagcaguauuaccacgagacaugguauucagaacaucaucacccaaaguaguauuauga

SEQ ID NO: 2952 - RNA, 1710 nt, Artificial Sequence
  derived and/or modified CDS sequence (opt6) from Lassa virus__AIT17635__NP
augucagcaucaaaagaaguaaaaaguuucuuauggacacaaucacucagaagagaacuuagcggauauugcucaaacauaaaacuacaaguuguaaaagaugcacaagcacuacuucacggacuagacuuuucagaaguuaguaacguucaaagauuaaugcgaaaacagaaaagagaugacaaugaucuaaaaagauuaagagaucuaaaucaagcaguaaacaacuuaguagaacuaaaaaguacccaacaaaaaagcauacuuagaguuggaacuuuaacauccgacgaccuauuaacacuugcugcagauuuagaaaaacuuaaaucaaaaguaauaagaacagaacgaccauuaagcagcggaguauauauggguaacuuaaauacucaacaacucgaacaaagaagagcacuacugaacaugaucggaaugguugggggagcacaaggcacucaaccaggaagagacggaguuguuagagucugggauguaaaaaauccggaucuauuaaacaaccaauuuggaacuaugccaucacucacucuagcuugcuuaacaaaacaaggacaagucgauuuaaaugaugcuguuuuagcacuaacugaucuaggauuaauauacaccgcuaaauauccaaauucaucagacuuagauagauuaucacaaucacauccuaucuuaaauaugguagacacuaaaaaaucaucacuaaacauaaguggauauaacuucagucugggagccgcagucaaagcgggcgccuguauguuagacggaggaaauauguuagaaacaauaaaaguaacaccgcaaaccauggauggaauauuaaaaaguauacucaaaguaaaaaaaucauuaggcauguuuguaagugacacacccggagaaagaaacccuuacgagaauauacuuuauaaaauauguuuaucaggagacggauggccuuauauagcaucacgaacaagcauugucggaagagcaugggaaaauacaacaguugaucuagaaagcgauggaaaaccacaaaaaguaggcacagccggaaguaacaaaagucuucaaucagcaggcuucccaacggguuuaaccuauucgcaauugaugacauuaaaagacagcaugaugcaacuagacccuagugccaaaacauggauagauauagaaggaagaccagaagacccaguagaaaucgcacuauaucaaccaaugucaggauguuauauacauuuuuuuagagaaccaacagacuuaaaacaauucaaacaagaugcaaaauauucacauggaauagaugucgcagauuuauucccugcacaaccaggauuaacuucagcaguuauagaagcccuuccaagaaauaugguucuaacaugccaaggcucagaugacauaaaaagacuacuagacucacaaggucgaagagauauaaaacugaucgauauugcucuaucaaaagcagacaguagaagauuugaaaacgcgguaugggaccaaugcaaagaucuuugccacaugcauacuggagucguaguagaaaaaaaaaaaagagguggaaaagaagagauuacaccacauugugcacuaauggauugcaucauguacgaugcagcuguaucaggaggauuaaacauaccaguacuuagggcaguucuaccaagagacaugguauuccgaacuucaaguccaaaagucguauuauaa

SEQ ID NO: 2953 - RNA, 1710 nt, Artificial Sequence
  derived and/or modified CDS sequence (opt6) from Lassa virus__AIT17639__NP
auguccgcauccaaagaaguuaaaagcuuccucuggacucaaagccuuagaagagaacuaucaggauacuguucaaacaucaaauuacaaguaguaaaagaugcgcaagcauuauuacauggccucgauuucuccgaaguaaguaauguacaaagacuaaugagaaaacaaaaaagagacgacucagaccuaaaaagacuaagagaccuaaaucaagccguaaacaacuuaguagaauuaaaaaguacacaacaaaaaucaauccucagaguaggaacacuaacuucagaugauuuauuaacauuggcagcagaucuagaaaaauuaaaaucaaaaguaauccgaacagaaaggccuuuauccucgggaguauauaugggaaauuuaucaacacaacaacuugaacaaagaagagcacugcuaaacaugauaggaaugguaggaggagcacaaggaacacaaccaggaagagacggaguaguaagaguaugggauguuaaaaacccagauuuacuuaauaaucaauucggcacgaugccaucauuaacucuagcuugcuugacaaaacaaggacaaguagacuuaaacgacgcaguauuagccuuaacagaucuaggacuaauauauacagccaaauacccaaauucaucagaccucgacagauuaucacaaucgcauccaauacuaaauaugguagauauaaaaaaaucaucacuaaacauaucaggauauaacuucagcuuaggugcagcaguaaaagccggagcaugcaugcuagaugguggcaauaugcuagaaacaauaaaaguaacaccacaaacaauggacggcaucuuaaaaagcauacucaaaguaaaaagaucccuaggaauguucguaagugauaccccaggugaaagaaacccuuaugaaaacauacuauauaaaaucugucuauccggugacgguuggccauacauugcaucccguacaaguauaguaggaagagcaugggaaaacacaaccguggacuuagaaagcgacggaaaaccacaaaaaguaggaucugcuggaucaaauaaaucuuuacaaucagcaggcuuccccacaggccuuaccuauagucaacucaugacacuaaaagauagcaugaugcaacuagauccauccgcaaaaacauggaucgacauagaaggaagaccugaagacccaguagaaauagcuuuauaccaaccaaugucuggauguuacauacauuuuuucagagagccaaccgacuuaaaacaauuuaaacaagacgcaaaauauucacacggaauagauguagcagaccuauuuccagcacaacccggacuaaccagugcaguaauagaagcauuaccuagaaacaugguauuaacaugucaaggaagugaugauauaaaaagacuacuagacucacaaggacgaagagacauaaaacucauagacauagcacuauccaaagcagacucaagacgauucgaaaacgcaguaugggaucaauguaaagaccuaugucauaugcauacaggcguagucguagaaaaaaaaaaaagaggcggaaaagaagaaauaacgccacacugugcauuaauggacuguauaauguaugacgcagcaguaucagguggauuaaauauaccaguacuaagagcaguuuuaccuagagauaugguauucaggacaaguucaccaaaagugguauuauaa

SEQ ID NO: 2954 - RNA, 1710 nt, Artificial Sequence
  derived and/or modified CDS sequence (opt6) from Lassa virus__AIT17643__NP
augagcgcaucaaaagaaguuaaaaguuucuuauggacacaaucacuacggagagaacuauccgguuauugcucaaauauaaaauuacaaguaguaaaagacgcacaagcacuauuacacggucuagacuucagugaaguaagcaauguccaaagacuaaugagaaaacagaaaagagacgauagugauuuaaaaagauuaagagauuuaaaucaagcaguaaacaaccuagucgaauuaaaaagcacccaacagaaaagcauauuacgaguaggaacuuuaacaucagacgacuuauuaacauuagcagcagauuuagaaaaauuaaaaucaaaaguaauaagaacagaaagaccauuauccucuggaguuuauauggguaaucuaucagcacaacaacuagaacaaaggagagcauuacuuaauaugauaggaauggugggaggagcacaaggcacucaaccagggagagauggugucguaagaguaugggauguuaaaaacccagacuuacugaauaaccaauuuggaacaaugccaucacucacuuuagcgugcuuaacaaaacaaggacaaguagauuuaaacgaugccguacuugcauuaacagaucuaggccuuauuuacacagcuaaauacccaaacucaucagauuuagacagauuaagccaaagucacccaauauuaaacaugguagauacaaagaaaucaucauuaaauauaucaggauacaauuucucacuaggagcagcagugaaagcuggugcauguauguuagauggcggaaacauguuagaaacaaucaaaguaacuccacaaacaauggacggaauacuuaaaagcauauuaaaaguaaagaaaucacuaggaauguucguauccgauacaccaggagaaagaaauccauaugaaaauauauuauacaaaauaugcuuaagcggagauggauggccauauauagcaaguagaacaucaauaguuggacgagcaugggaaaacacaacaguagaucuagaaucagauggaaaaccacaaaaaguaggaacagcaggcaguaauaaaagucuacaaagcgcaggauuccccacagguuuaacauauucacaauuaaugacauuaaaagauucaaugaugcaacucgauccgagcgcgaaaacauggauagacaucgaaggaagaccagaagauccaguagaaauagcuuuauaucaaccaaugaguggauguuacauacacuucuucagagaaccaacagauuuaaaacaauucaaacaagaugcaaaauacucucauggaauagacguagcagacuuauuucccgcacaaccaggacuaaccagcgccguaauagaagcacucccuagaaauaugguacuaacaugccaagguucagaugauauaaaaagauuauuagauucacaaggaaggagggacauuaaacuaauugauauagcucuaucaaaagcggauucaagacgauucgaaaacgcaguaugggaccaauguaaagaccucugccauaugcacacaggaguuguaguagagaaaaagaaaagaggaggaaaagaagaaauaacaccacauugugcuuuaauggauuguauuauguaugacgcugcaguuaguggaggacuuaauauuccaguauuaagagcuguacuaccaagagacauggucuucagaacaucuucaccuaaaguagucuuauaa

SEQ ID NO: 2955 - RNA, 1710 nt, Artificial Sequence
  derived and/or modified CDS sequence (opt6) from Lassa virus__AIT17651__NP
augagcgccucaaaagaagugaaaucauuuuuauggacgcaaucauuaagaagagaacuaaguggauacuguaguagcauaaaauugcaaguaguaaaagaugcacaagcacucuuacauggacucgauuucucagaaguaucaaacguacaaagauuaaugaggaaacaaaaacgggaugauagugauuugaaaagacuaagagaccuaaaucaggcaguaaauaacuuaguagaacucaaaucuacacaacaaaaaucaguuuuaaggguagguacacuaacaagcgaugaucuacuaacauuagccgcagauuuagaaaaauuaaaaaguaaaguaauacgaacagaaagaccgcuaagcucaggaguauauauggguaauuuaucagcacaacaacuugaacaaagaagagcacuauuaaacaugaucgggaugguaggaggugcacaaggaacacaaccuggacgagauggagucguaagaguaugggauguaaaaaacccagaucuacuaaacaaccaauuugguacaaugcccucucuaacccucgcgugucuaacaaaacaaggacaagucgaccuaaacgauguaguauuagcacuaacugaccuagguuuaauauauacugccaaauauccaaauagcucagacuuagauagacuaucacagagucacccaauacuaaauaugguugacacaaaaaaaucaucauuaaauauaaguggauacaauuuuucacuaggagcagccguaaaagcgggagccugcaugcuagacggagguaauaugcuagaaacaauaaaagucacaccacaaaccauggacgguauucuuaaaagcauccuaaaaguaaaaaaaaguuuaggaauguuuguaagugauacaccuggagaaagaaauccauaugaaaacauauuauacaaaauaugucuaaguggagauggauggcccuacauugcauccagaacuucgauaguaggaagagcuugggaaaacacaacaguagaucuagagagcgauggaaaaccacaaaaaguaggaacagcaggaucaaacaaaucuuuacaaucagcuggauuuccgacaggauuaacuuauucacaauuaaugacacuaaaagauucaaugaugcaacuagaucccucagcaaaaacauggauagauauagaaggacgaccagaagauccaguagaaauagcacucuaucaaccaaugucuggauguuacauacacuucuucagagaaccaacagacuuaaaacaauuuaaacaagacgcaaaauauagccacggaauagauguaacagauuuauuuagcgcacaaccaggauuaacaagugcagucauugaagcacuaccacgaaauaugguacuaacaugucaaggaucagacgauauaaaaagacuacuugacucacaaggaagaagggacauaaaacuaauugauaucgcauuaucaaaagcugauucaagaagauucgaaaacgcaguaugggaucaauguaaagaucuaugccauaugcauacaggagugguuguugaaaaaaaaaaaagaggaggcaaagaagaaauaaccccacauugugcauuaauggauuguaucauguacgaugcagcuguuagcggagguuuaaacauaccgguacuacgagcaguucuaccuagagacaugguauucagaacaucaucaccaaaagugguauuauaa

SEQ ID NO: 2956 - RNA, 1710 nt, Artificial Sequence
  derived and/or modified CDS sequence (opt6) from Lassa virus__AIT17655__NP
augagugcauccaaagaaguuaaaucauuccuauggacacaaucuuuaagaagagaauuaucaggauauugcaguaacauuaaacuacaaguagucaaagaugcacaagcauuauuacauggacuagauuucucagaaguauccaauguacaaagacuaaugcgaaaacaaaaaagagaugacuccgauuuaaaaagacuaagagaucucaaccaagcaguaaauaacuuaguagaacuaaaaagcacacaacaaaaaagcauauugagaguaggaacacuaacgucugacgaccuacucacacucgcagcugauuuagaaaaauuaaaaucaaaaguaauaagaaccgaaaaaccuuuaaguucagggguauacaugggaaauuuaucaacacaacaacuagagcaaagacgagcauuauuaaacaugauagguaugguaggaggagcacaaggaacgcaaccaggcagagacggaguaguaagaguaugggauguaaaaaauccugacuuauuaaauaaucaauucgggacaaugccaucacuaaccuuagcaugucuaaccaaacaaggacaagucgaccuaaacgaugcaguccuagcacuuacagaucuaggccuuauauauacagcuaaauuucccaauucaucugaccuagacagacucucacaaucacacccaauauuaaacaugguugacacgaaaaaaucaaguuuaaacauaucaggauauaauuucucacuaggcgcagcuguuaaagccggagcauguauguuagacggagguaauaugcuagaaacaauaaaaguaaccccucaaacuauggauggaauacuaaaaagcauccuaaaaguaaaaaaaaguuuaggaauguucgucagcgauacuccaggagaacgaaacccauaugaaaauauauuauacaaaauaugucuaucuggagauggcuggcccuacaucgcuucaagaacaucaauaguaggacgagcaugggaaaacacaacagucgauuuagaaagcgauggaaaaccacaaaaaguuggaacaacaggaucaaauaaaucacuacaaucagcaggauucccuacuggcuuaacauauagccaguuaaugacauuaaaggauagcaugaugcaauuagauccauccgcaaaaacauggauagauaucgaaggaagaccagaagauccaguugaaauagcucuauaucaaccaaugagcggaugcuacauacacuuuuuccgagaaccaacugaccuaaaacaauucaaacaagacgcuaaauauucacaugguauagauguagcagaccuauuuccagcucaaccaggauuaacguccgcaguaauagaagcacuaccaagaaauaugguacuaaccugccaaggaucagaugacauuaaaagauuauuagacucgcaaggaagaagagauauaaaauuaauagauauagcacuaucaaaagcagacucaagaagauucgaaaacgcaguuugggaccaaugcaaagaccuaugccauaugcauaccgguguaguaguagaaaaaaagaaaagaggaggaaaagaagaaaucacaccacauugugcacuaauggauuguauaauguacgaugcugccgucuccggcggcuuaaacauaccaguuuuaagagcaguauuaccaagagacaugguauuccgaaccuccagcccaaaaguaguauuauaa

SEQ ID NO: 2957 - RNA, 1710 nt, Artificial Sequence
  derived and/or modified CDS sequence (opt6) from Lassa virus__AIT17659__NP
augucagcaucaaaagaaguaaaauccuuuuuauggacacaaagucuaagacgugaauuaaguggauauuguucaagcauaaaacuacaaguaguaaaagaugcacaagcccuauugcauggauuagacuucucagaagucagcaauguucaaaggcuaaugcgaaaacagaaaagagaugacagcgauuuaaaaagacuaagagacuuaaaccaagcaguaaacaauuuaguagaauuaaaaucaacacaacaaaaaucaguauuaagaguaggaacauuaacgagugaugauuuacuaacacuagcagcagaccuagaaaaacucaaaucaaaaguaaucaggacagaaagaccauuaucaagcgguguauauaugggaaacuuaucaacgcaacaauuagaacaaagacgagcacuccugucaaugauaggaaugguaggaggagcacaaggaacacaaccagggcgugacgguguaguacgaguaugggacguuaaaaaucccgaucuacuaaauaaccaauucggaacaaugccaucgcuaacacuagcauguuuaacuaaacaaggccaaguagaccuaaaugaugccguacucgcauuaacugacuuaggauuaauauacacagcaaaauaccccaauagcucagauuuagauagacuaucacaaucacauccaauauuaaacaugguagauacaaagaaaucaaguuuaaauauaaguggauacaauuuuagucuaggagcagcagucaaagcaggggccuguauguuagacggagggaauauguuagaaacaaucaaaguaacaccacaaacaauggauggaauccuaaaaucuauacuaaaaguaaaaaggucacuaggaauguucguaagcgauacaccuggugaaagaaauccauacgaaaauauauuauauaaaauauguuuaagcggggacggauggccauauauugcuagcagaacaucuauuguagggagagcaugggaaaacaccacaguagauuuagaaucugacggaaaaccccaaaaaguaggaacagcaggaucaaacaaaucauuacaaucagcaggauuucccacaggauuaacauauagccaauugaugacauuaaaagauucuaugaugcagcucgauccaagugccaaaacauggauagauauagaaggccgacccgaagacccaguagaaauagcacuauaucaaccuaugucaggauguuacauacacuucuuuagagaaccaacagauuugaaacaauuuaaacaagacgcgaaauauagucauggaauagauguagcagaucuauuuccagcacaaccagguuuaacgucagcaguaauagaagccuuaccaagaaacaugguacucacaugccaagguuccgaugauauaaaacguuuauuagacucccaaggaagaagagauauaaaacuaauagauauagcucuaaauaaagcugacucaagaagauuugaaaacgcaguaugggaccaaugcaaagaccuaugccacaugcauacaggaguaguaguugaaaagaagaaaagaggaggaaaagaagaaauaaccccacacugcgcucugauggacuguauaauguaugaugccgcaguaucaggaggacuuaacauaccaguccuaagagcaguucuacccagagauaugguauucagaacuucgucaccaaaaguaguauuauaa

SEQ ID NO: 2958 - RNA, 1710 nt, Artificial Sequence
  derived and/or modified CDS sequence (opt6) from Lassa virus__AIT17663__NP
augucagcaucaaaagaaguuaaaagcuucuuauggacacaaucauuacgaagagaauugucaggauacugcucuaguauaaaauuacaaguaguaaaagaugcacaagcauuacuucauggacucgacuucagugaaguaucaaacguucaaagauuaaugcguaaacaaaaaagagacgauagugauuuaaaaagauuaagagacuuaaaucaagcaguuaauaacuuaguagaacuaaaguccacacaacaaaaaucuauauuaaggguaggaacauuaaccucggaugaccuacuaacacuagcugccgaucucgaaaaauuaaaaucaaaaguaauaagaacugaaagaccacucucaaguggaguauauaugggaaaucuaaguacacaacaauuagaacaaagaagagcacuauuaaauaugauaggaaugguugguggugcacaaggcacccaaccaggaagagacggagucguuagaguaugggauguaaaaaacccagauuuacuaaacaaucaauuuggaacaaugccaucauuaaccuuagccugccuuacuaaacaaggacagguagauuuaaacgacgcuguacuagcuuuaacugaccuugguuuaauauacacagcaaaauacccaaacucaucagauuuagauagacuaucacaaagccacccaauacuaaacaugguagauaccaaaaaauccagccuaaacauaucagguuauaauuucucacuuggcgcugcuguaaaggcaggagccuguauguuagacggaggaaauauguuagaaacaauaaaaguaacaccacaaacuauggauggcauacuuaaaaguauauuaaaaguaaaaagaucguuaggaauguuuguuagugauacuccaggagaaagaaauccauaugaaaauauacuauauaaaauaugucuuucuggugauggauggcccuauauagcaagcagaacaucuauaguuggaagagcaugggaaaauaccacugucgaucuagaaagugauggaaaaccucaaaaaguaggaacagcaggaucaaauaaaagccuccaaucagcagguuuuccaacaggacuaacauacucacaacuaaugacacuaaaagacaguaugaugcaacuagauccaagcgcuaaaacauggaucgauauagagggcagaccagaagacccaguagaaauugcacuauaccaaccaaugaguggauguuacauucacuuuuuucgagaaccuacagauuuaaaacaauucaaacaagacgccaaauacucacauggaauagauguagccgauuuauuuccagcacaacccggccucacgucagcaguuaucgaagccuugccuagaaacaugguacuaacaugucaaggaagcgacgacauaaaaaaauuauuagacucucaagggcgaagagacaucaaauuaauagacaucgcauuaagcaaagcugacagcagaagguuugaaaacgcaguuugggaccaaugcaaagaccuaugucauaugcauacaggaguaguuguugaaaaaaaaaaacgaggaggaaaagaagaaauuacaccacauugugcauuaauggauuguauuauguaugacgcugccguaucgggaggauuaaacaucccuguacuaagagcuguacuaccaagagauaugguauuuagaacaagcaguccuaaaguagucuuauaa

SEQ ID NO: 2959 - RNA, 1710 nt, Artificial Sequence
  derived and/or modified CDS sequence (opt6) from Lassa virus__AIT17667__NP
augagugccucaaaagaaguaaaaucauuccuauggacccaaucacuaagaagggaacuauccggauauuguucaucaauaaaacuacaagugguaaaagacgcacaagcauuauuacauggauuagauuucucagaagucagcaaugugcaacgacuaaugagaaaacagaaaagagacgauagcgaucuaaaaagauuaagagauuuaaaucaagcaguaaauaacuuaguugaauuaaaaucuacacaacaaaaauccauauuaagaguaggaacucuuacaagugaugauuuauuaacauuagcagcugauuuagagaaauugaaaaguaaaguaauaagaacagaaagaccauuaucgagcggagucuauaugggaaacuuaaguacccaacaacuggaacaaaggagagcacuucuaaauaugauaggaaugguaggaggcgcacaaggaacacaaccaggaagagacggaguaguuagaguuugggaugugaaaaacccagauuuacucaacaaucaauucggaacaaugccaagucuaacacucgcuuguuuaacuaaacaaggacaaguugaucuuaaugacgcaguccucgcuuuaacagauuuaggauugauauacacagccaaauacccaaacucaucagacuuagacagacuaagucaaagucacccaauauuaaacaugguagauacaaagaaaucaucacugaacauaucaggauacaauuucucgcuaggagcagccguaaaagcuggagcauguaugcuagacggaggaaauaugcuagaaacaauaaaaguaacuccacaaacaauagacggaauauuaaaaucaauauuaaaaguuaaaaagagcuuaggaauguuuguaucagauacacccggagaacgaaauccauacgaaaauauacuauacaaaauaugucuaucaggcgacggauggccauauauagcaucaaggacaaguaucguaggaagggccugggaaaauacaacaguagaucuagagagcgauggaaaaccacaaaaaguaggaaccacaggcagcaauaaaagccuccaaucagcaggauuuccgacaggauugacauauagccaauuaaugacauuaaaagauagcaugaugcaauuagaucccagcgccaaaacauggauagacaucgaaggacgaccagaagaccccguugaaauagcccuauaccaaccaaugaguggauguuauauacacuuuuucagagaaccaacagaucuaaaacaauuuaaacaagacgcaaaauauucacauggcauagacguaacagacuuauuuccagcgcaaccgggauuaacgagugcuguaauagaagcauuaccacgaaauaugguacucaccugucaaggaucagaagauauaaaaagacuacuagauagucaaggacgaagagacaucaaauuaauagauaucgcacuaagcaaagcagacucaagaagguuugaaaacgcaguaugggaucaauguaaagauuuaugccauaugcauaccggagucguaguagaaaagaagaaaagaggagguaaagaagaaaucaccccucauugcgcccuuauggauuguauaauguacgacgcagcaguaucaggaggauuaaauauaccaguacugagagccguacuaccuagagacaugguauuccguacaucaucaccaaaaguagucuuauaa

SEQ ID NO: 2960 - RNA, 1710 nt, Artificial Sequence
  derived and/or modified CDS sequence (opt6) from Lassa virus__AIT17671__NP
augucggcuuccaaagaaguaaaaucauuucuuuggacucaaucgcuacguagagaguuaucaggcuauugcucaucaauuaaacuacaaguagucaaagaugcccaagcuuuguuacacggacucgauuuuagugaaguauccaauguccaaagacucaugcgaaaacaaaaaagagacgauucagaucuaaaaagacuccgagaucuaaaccaagcuguaaauaaucuuguagaacuuaaaaguacacaacaaaagucuguacuaagaguaggaacacuaacaucagaugaccuauuaacauuagcagcagaucuagaaaaauuaaaaaguaaaguaauacgaacagaaagaccacuauccagcggaguuuacaugggcaauuuaucaacucaacaacuagaacaaaggagggcucuacuaaauaugauagguaugguaggaggcgcacaaggaacacaaccaggacgagauggagucguucgaguaugggacguaaaaaacccagaucuucugaauaaucaauuugguacaaugccuucucugacauuagcaugucuaaccaaacaaggacaaguggacuuaaacgauguuguacuagcucuaacugaccuaggauuaauauacacagcaaaauauccuaacucaucagacuuagacagacucagucaaucacauccaauauuaaacaugguagauaccaaaaaaucuagcuuaaauauaagcggauacaacuuuagucucggggcggccguaaaagcaggagcauguaugcuugacggaggaaacauguuagaaacaauaaaaguaacaccucagacaauggaugguauauuaaaaucaauauuaaaaguaaaaaaaagcuuaggaauguuuguaagcgacacgccaggagaacgaaauccauaugaaaauauauuauacaaaauauguuuaucuggagauggauggccuuacaucgcaucacgcacaucaauaguaggcagagcaugggaaaauacaacaguagauuuagaaucagaugguaaaccacaaaaaguagguacagcaggaucaaauaaaaguuuacaauccgcaggcuuuccaacaggauuaacauauucacaauuaaugacacuaaaagauucaaugaugcaacuagauccauccgcaaaaacuuggauagauaucgaaggaagaccagaagauccaguagaaauagcauuauaucaaccaaugucaggauguuauauacacuucuucagagaaccaacugacuuaaaacaauucaaacaagaugcaaaauauagccacgguaucgauguaacagaucuauuuccagcacagccaggauuaaccagugcaguuauagaagcauuacccagaaauaugguauuaaccugucaaggaucagaugauauaaaaagacuauuagauagucaagguagaagagacauaaaauuaauagauauagcccuaucaaaagcagacucgagacgauuugaaaacgcagucugggaucaauguaaagaucuaugucauaugcacacaggcguaguugucgaaaaaaaaaaaagaggaggaaaagaggaaauaacaccacacugcgccuuaauggauugcauaauguaugacgcagcaguaaguggaggacuaaauauaccaguacuacgagcagucuuaccaagagauaugguauuuagaacaucaaguccaaaaguaguauuauaa

SEQ ID NO: 2961 - RNA, 1710 nt, Artificial Sequence
  derived and/or modified CDS sequence (opt6) from Lassa virus__AIT17675__NP
augucagcaucaaaagaaguaaaaucauuuuuauggacacaaaguuuacgaagagaauuaaguggauacuguucaucaauaaaauuacagguaguaaaagacgcacaagcauuauuacacggacuugacuuuucugaaguaucaaauguacaaagacucaugagaaaacaaaaaagagacgauagcgacuuaaaaagauuaagagacuuaaaccaagcaguaaacaaucuaguagaauuaaaaucaacacaacaaaaaucagucuuaagaguaggaacacuaaccucagaugacuuacuaacacucgccgcagacuuagaaaaacuaaaaucaaaaguaauaagaacagaacgaccauuaucaagcggcguuuacauggguaaccuaagcacacaacaacuggaacagcgaagagcacuccuaaauaugaucggaaugguaggaggagcucaaggaacacaaccuggcagagacggcguaguaagaguaugggacguuaaaaacccagauuuauuaaauaaucaauucggcacaaugccuagccuaacauuagccuguuuaacgaaacaagggcaaguagauuuaaaugacgcaguacucgcacuaacagaucuaggacuaauauauacugccaaauacccaaacucuagcgaccuagacagacuaagucaaagccacccaauacuaaauaugguagauacgaaaaaaucaucauuaaauauuucuggauacaacuuuucccuaggagcagcagucaaagcaggagcauguauguuagauggcggaaacauguuagaaacaauaaaaguaacaccacaaacaauggacggaauauuaaaaagcauuuuaaaaguaaaaaaaagucuagguauguucguaucagacacacccggagaacguaacccguacgaaaauauucuuuacaaaauaugccuaucaggagacggauggccauacauugcaucccgaacuuccauaguaggaagagcaugggaaaauacaaucgucgacuuagaaucagacggaaaaccacaaaaagucggaacagcaggcucaaauaaaucacuacaaagcgcaggauucccaacagguuuaacauacagucaacuaaugacacuaaaagacucaaugaugcaauuagacccuagugcaaaaacauggauagauauagaaggacgaccagaagacccaguagaaauagcuuuauaucaaccaaugucaggauguuauauacauuuuuuuagagaaccaacagaucugaaacaauuuaaacaagaugcaaaauauucucaugguauagacguggcagaucuauucccagcacaaccagguuuaacaucagccgucauagaagcacuacccagaaacaugguacuaacaugucaaggauccgaugauauaaaaagauuacuagacucacaagguagacgagauauaaaauuaauagacauagccuuaucaaaagcagacagccgucgauucgaaaaugcagucugggaccaaugcaaagauuuaugccacaugcacaccgguguaguaguagaaaaaaaaaaacgaggaggaaaagaagaaauaaccccucauugugccuuaauggacuguauaauguacgaugcagcaguaucagggggacuaaacauaccaguacuaagagcugucuuaccgagagauaugguauucagaacaucaucuccaaaaguaguuuuauaa

SEQ ID NO: 2962 - RNA, 1710 nt, Artificial Sequence
  derived and/or modified CDS sequence (opt6) from Lassa virus__AIT17679__NP
augucagcuucaaaagaaguaaaaucauucuuauggacacaaaguuuaagaagagaacugucaggauauugcucaucaauuaaacuacaaguaguaaaagaugcacaagcauuauugcauggucuagacuucucagaaguaucgaaugugcaaagacuaaugagaaaacaaaaacgagaugauucagauuugaaacgguuaagagauuugaaccaagcaguaaauaaucuaguagaacuuaaaucaacacaacaaaaaucuauauuaaggguaggaacauuaacuucagaugaccuauuaacauuagccgcagauuuagaaaaauuaaaaagcaaaguaauuagaacagaacgaccuuuaagcucagguguauacaugggaaaucuuagcacacaacaauuagaacaaagacgagcuuuauuaaauaugauagggaugguaggaggagcacaaucaacacaaccagggagagauggugucguaagaguaugggacguuaaaaacccagacuuacuuaauaaucaauucggaacaaugccaaguuuaacauuagcgugccuaaccaaacaaggccaaguagauuuaaaugaugcaguacucgcucuaacagacuuaggacuaauauauacagcaaaauacccaaacucaucagaucuagacagauuaagucagucucacccaauauuaaauaugguagauacaaagaaaaguucauuaaacauaaguggauacaauuuuucacuaggagcugcaguaaaagcaggagcauguaugcuagacggaggaaacauguuagaaacaauaaaaguaacaccucaaacaauggacggaauauuaaaauccauauuaaaagucaaacgaucauuagguauguucguaagugacacaccaggagaaaggaauccauaugaaaacauuuuauacaaaauauguuuaagcggagauggauggccauacauagcaucccgaacuucaauuguagguagagcuugggaaaauacaacaguagacuuagaaucugacggaaaaccacaaaaaguaggaacagcaggaucgaacaaaaguuuacaaagcgcaggauucccaacagguuuaaccuauagucaauugaugacccuuaaagauucaaugaugcaauuagacccaagugcaaaaacauggauagacauagaaggaagaccggaagauccaguugaaauagcauuauaucaaccaaugaguggauguuacauacacuuuuucagagaaccaacagacuuaaaacaauuuaaacaagacgccaaauauucucauggaauagauguagcagaucuauuuccugcacaaccaggucuuacaagcgcaguaauagaagcgcuaccaagaaacaugguauuaacaugucaaggaucagaugauauaaaaagacucuuagauucacaaggaagaagagauauaaaacuaauagauaucgcacuaagcaaagcggauucaagaagauuugaaaaugccgucugggaucaauguaaagauuuaugucauaugcacacaggaguaguuguugagaaaaagaaaagaggaggaaaagaagaaauaaccccacauugcgcacuaauggacuguaucauguacgacgcagcaguaucagggggauuaaacauaccaguauuacgagcaguucucccaagagauaugguguuucgaaccaguucaccaaaaguuguuuuauaa

SEQ ID NO: 2963 - RNA, 1710 nt, Artificial Sequence
  derived and/or modified CDS sequence (opt6) from Lassa virus__AIT17683__NP
auguccgcuucaaaagaaguaaaaagcuuccuauggacacaaucacuacgaagagaauuaaguggcuauugcaguaacauaaaauuacaaguaguaaaagacgcacaagcccuauuacacgguuuagacuucucagaaguaucaaauguucaacgacuaaugagaaaacaaaaaagagaugauucugaucuaaaaagacuacgggauuuaaaccaagcuguaaacaauuuagucgaauuaaaaaguacucaacaaaaaaguauauuaagaguuggaacacuaacaucggaugauuuacuaacuuuagcagcagaccuagaaaaacuaaaaaguaaaguuauacggacagaaagaccauuaucuucaggaguauauaugggaaaucuaucaacacaacaauuagaacaaagaagagcacuauuaaacaugauagguaugguagguggagcacaaggaacacaaccaggaagagacggcguaguccgagucugggacguaaaaaacccagacuuacuuaauaaccaauuuggaacaaugccaucguuaaccuuagcaugcuuaacaaaacaaggacaaguagaucuaaacgaugcagugcuagcacuaacugaucuaggccuaaucuauaccgcaaaguacccaaauaguucagacuuagacagguuaucacaaucucauccaauacuuaauaugguagacacaaagaaaagcagcuuaaacaucucaggauucaauuucaguuuaggagcagcaguaaaagcaggagcauguauguuagauggaggaaauaugcuagaaacaauaaagguaacaccacaaacaauggaugguauacuaaaaucaauauuaaaaguaaaaaaaucacucgguauguuuguuuccgauacaccaggagaaagaaaucccuacgaaaauauacuuuacaaaauaugucuaucaggagauggauggccguauaucgcauccagaacuuccauaguugguagggcaugggaaaauacaacaguagaucuagaaagcgacggaaaaccacaaaaaguaggaacagcagguuccaauaaaucacuacaaagcgccggauuuccaaccggauuaacauauucacaauuaaugacacucaaagacucaaugaugcaauuagacccaucugcaaaaacauggauagauauagaagguagaccagaagacccaguugaaauagcacuauaucaaccaaugucgggaugcuacauacauuucuuuagagaaccuacagauuuaaaacaauucaaacaagaugcaaaauacucacacgguauagacguagcagaucuauuuccagcacaaccggguuuaacaucagccguaauugaagcauuaccaagaaacaugguacucaccugccaaggaagugaugauauuaaaagacucuuagacucccaaggaagaagagacaucaaauuaauagauaucgcacuaaguaaagcagacucacggagauuugaaaacgcaguaugggaccaauguaaagaccuaugccauaugcacaccgguguaguaguagaaaaaaaaaaaagggguggaaaagaagaaauaacaccucacugcgcauuaauggauugcauuauguaugaugcugcaguauccggaggauuaaauaucccaguauuaagagccguacucccaagagacaugguauuccgaacaucaagucccaaaguaguacuauaa

SEQ ID NO: 2964 - RNA, 1710 nt, Artificial Sequence
  derived and/or modified CDS sequence (opt6) from Lassa virus__AIT17687__NP
augucagcgucaaaagaaguaaaauccuuccuauggacacaaucacuaagaagagaauuaagcgguuauugcaguucaauaaaauuacagguaguaaaagacgcacaagcacuacuacacggacuagauuucucagaaguaaguaacguacaacgacugaugagaaaacaaaaaagagacgauuccgaucuaaaaagauuaagggaccuaaaucaagcaguaaacaauuuaguagaacuaaaaucaacccaacaaaaaucaauacuaagagucggaacacuaacaucagacgaccuuuuaacacuagcagcugaucuagaaaaauuaaaauccaaaguaauacgaaccgaaagaccacuuucaagugguguuuauauggguaauuuauccgcccaacaacuagaacaacgucgagcucuauuaaacaugauagguaugguaggaggagcacaaggcacacaaccgggaagagacggaguaguaagaguaugggaugugaaaaauccugaccuuuuaaacaaucaauuuggaacuaugccuucacuaacauuagcaugccucacaaaacaaggacaaguggauuuaaacgaugcaguauuagcacuaacugaucuaggucuaaucuacacugcaaaauauccuaauucaucagaucuagauagacuaagccaaucacauccaauacuaaacaugguagacacaaaaaaaucaucccuaaauauaucuggauauaauuucucauuaggugcugcuguuaaagccggagcauguaugcuagauggaggaaauaugcucgaaacuauaaaaguaacaccgcaaacaauggauggaauauuaaaaucaauauuaaaaguaaaaagaucuuuagguauguuugugucagauacuccuggagaacgaaacccauaugaaaacauauuauacaaaauaugucuaucaggagauggauggccauauauagcaucaagaacaaguauuguaggaagagcaugggaaaauacaacgguugaucuagaaucagauggaaaaccacaaaaaguaggaacugcaggaagcaauaaaucauuacaauccgcaggauuuccaacaggcuuaacauauagucaauuaaugacauuaaaagauagcaugaugcaacuagauccaucagcaaaaacauggauagauaucgaaggaagaccugaagaccccguugaaaucgcacuauaucaacccaugagcggauguuacauacacuuuuuuagagaaccaacagaucucaaacaauucaaacaagacgcaaaauacucacacggaauugacguagcagacuuauuuccagcucaaccuggacuaaccucagcaguaauagaagccuugccacgaaauaugguacuuacaugucaaggaucagacgacauaaaacgacuauuagacucccaaggaagaagagauaucaaauuaauagauauagcauuaagcaaagccgacucacguagauucgaaaaugcaguaugggaucaaugcaaagacuuaugccauaugcauacagguguaguaguugaaaaaaaaaaacgaggaggaaaagaagaaauuacaccacacugugcacuaauggacuguaucauguaugaugcagccguaaguggcggucuaaacauuccaguauuaagagcaguucuuccaagggauaugguuuucagaacaaguucaccuaagguuguucuuuga

SEQ ID NO: 2965 - RNA, 1710 nt, Artificial Sequence
  derived and/or modified CDS sequence (opt6) from Lassa virus__AIT17695__NP
augucagcaucaaaagaaguaaaaucauucuuauggacacaaucacuaagaagagaauuaucuggauauugcaguaacauaaaacuacaaguaguaaaagacgcucaagcucuucuacauggacuagauuucucagaaguauccaauguacaaagacuaaugagaaaacaaaaaagagaugauucugaccuaaaaagauuaagagauuuaaaucaagccguaaauaaucuuguagaacuaaaaucaacucaacaaaaaaguauauuacgaguaggaacacuaacuagugaugacuuacuuacacuagcagcagauuuagaaaaauuaaaaucaaaaguuauacguacagaaagaccucuaucaucagggguauauauggguaaccuaucaacacaacaacuagaacaaagaagagcacuacuuaauuuaauaggcaugguugguggagcacaagguacacaacccgguagagacgguguaguaagaguaugggacguaaaaaacccagacuuauuaaauaaccaauuuggaaccaugccaucacuaacacuagcaugcuuaacaaaacaaggccaaguagauuuaaaugacguaguccuggcucuaacagaucugggauuaaucuauacagccaaauauccaaauuccucagacuuagacagacuaucucaaucucauccuauccuaaauauggucgauacaaaaaaaucaucauuaaauauuucaggauucaauuuuucacuuggagcugcaguaaaggcaggagcaugcaugcuugacgguggcaauauguuagaaacaauaaaaguuacuccacauacaauggacggaauucuuaaaucaauauuaaaaguuaaaaaaucauuaggcauguucgugucagacacaccaggagaacgaaacccauaugaaaauauuuuauacaaaauauguuuaucuggagacggauggccauacauagcuucaagaacaucaauagugggaagggcuugggaaaauacaacaguagauuuagaaucagacgguaaaccacauaaaguuggaacagcaggaaguaauaaaucacuacaaucagccggauuuccaacaggacuaacauauucccaacuaaugacucucaaagacaguaugaugcaauuagauccaucagcuaaaacauggauagauaucgaaggcagaccagaagacccuguagagauugcacucuaucaaccaaugagcggcugcuauauccauuucuucagagaaccaacugauuuaaaacaauucaaacaagacgcuaaauacucacacggaauagauguagcagauuuauuuccagcucagccuggccuaacaucugcaguaauagaagcacuaccaagaaacaugguauuaacaugucaaggaagugaugacauaaaaaggcuacuagacagucaaggacgacgagacauaaaacuaauagacauagcacucuccaaagcagacagucgaagauuugaaaacgcagucugggaccaauguaaggaucuuugccauaugcauacaggaguaguagucgaaaaaaaaaaacgaggaggaaaagaagaaauuaccccucauugcgccuuaauggauugcauuauguaugacgcugcaguaucaggaggacuaaacauucccguacuucgugcaguauugccacgcgauaugguauucagaaccucaucaccgaaagucguauuauaa

SEQ ID NO: 2966 - RNA, 1710 nt, Artificial Sequence
  derived and/or modified CDS sequence (opt6) from Lassa virus__AIT17705__NP
augucagcuucaaaagaaguaaaaucauucuuauggacacaaucacuaagaagagaacuaucaggauacugcucaaauauuaaauuacaagugguaaaagacgcacaagcauuauuacacggauuagacuucucagaaguauccaauguacaaagacuaaugagaaaacaaaaaagagacgacagugauuuaaaaagauuaagagaucucaaccaagccguaaauaacuuaguagaauuaaaaucaacacaacaaaaaucaauauuaagaguaggcacauuaacuagcgaugauuuacuaacacuagccgcagauuuagaaaaauugaaauccaaaguuauaagaacagaaagaccacuaucaagcggaguauacaugggaaaucuuucaacucaacaacucgaacaaagaagagcacuacuaaacuuaauaggaaugguagggggagcacaaggaacacaaccaggaagagacggcguaguccgaguaugggacgucaaaaauccagaccucuugaauaaucaauucgggacaaugccaucacuaacacuugcaugcuuaaccaaacaaggacaaguagaccuaaaugaugcgguauuggcauuaacugaucuaggacuaauauacacagccaaauaucccaacuccuccgaccuugauagacuaucacaaucacauccaauacuaaauaugguugauaccaaaaaaagcucauuaaacauuucaggauucaacuucucauuaggagcagcaguaaaagcaggagcauguauguuagauggaggaaauaugcuagaaacgauaaaaguaaccccacaaacuauggauggaauacuaaaaaguauccuaaaaguaaagaaaucacuaggcauguucguaucagauacaccaggagaaagaaacccauaugaaaacauacuauacaaaauauguuuaaguggcgacggauggccauauauagcaucccguacaucaauaguuggaagagcaugggaaaauacaacaguagauuuagaaucagauggaaaaccacacaaagucggaacagcaggaucaaaucgaucacuacaaucagcaggauucccaacaggauuaaccuauucucaacuuaugacacuaaaagauaguaugaugcaacuagauccaucagcaaaaacauggauagauauagaaggacguccugaagacccagucgaaauagcauuauaucaaccuaugucugguuguuauauacacuuuuucagagaaccaacagaccuaaaacaguuuaaacaagacgcaaaauacagccacggaauagauguagcugauuuguuccccgcacaaccuggacuaaccuccgcaguaauagaagcauuaccaagaaauaugguauuaacuugccaaggaucugaugauauaaaacgccuauuagacagccaaggcagaagagauauaaaacuaaucgauauagcauuaucaaaagcagauucaagaagauucgaaaacgcagucugggaccaauguaaagacuuaugccacaugcauacugguguaguuguagaaaaaaaaaaaagaggagguaaagaagaaauaacaccucauugugcauuaauggacuguauaauguacgaugcggcaguaucagguggauuaaauauaccaguacuaagagcaguacuaccacgggacaugguauuuagaacaucaaguccuaaagucgucuuauaa

SEQ ID NO: 2967 - RNA, 1710 nt, Artificial Sequence
  derived and/or modified CDS sequence (opt6) from Lassa virus__AIT17711__NP
augagcgcauccaaagaaguaaaaagcuuucuauggacacaaucccugaggagagaauuaaguggauacuguucuaacauaaaacuucaaguaguaaaagacgcgcaagcacuacuacauggauuagacuuuagcgaaguaucaaauguucaaagacuuaugagaaaacaaaaaagagacgacagugacuuaaaaagacuaagagacuuaaaucaagcgguaaacaauuuaguagaacuaaaaucaacucagcaaaaaucuauacucagaguaggaacgcucacaucagaugaucugcuaacacuagcagcagaucuagaaaaauugaaaucaaaaguaauaagaacagaacgaccucuaucaucagguguauauaugggaaaucuaucaacacaacaacuagaacaaagaagagcauuauuaaaccuaaucgguaugguuggcggagcucaagggacacaaccaggacgagacggaguaguaagaguaugggacguaaaaaauccagauuuauuaaauaaucaauucggaaccaugcccagcuuaaccuuagcaugcuuaacaaaacaaggacaaguagauuuaaaugaugcagugcuagcauuaacagauuuaggacuuauauauacagcaaaauacccaaacagcagugaucuagacagauuaucccaaagccauccaauauuaaauaugguagauacaaaaaaaucaagcuuaaauauaucaggauucaacuuuaguuuaggagcagcuguaaaagcaggagcaugcaugcuagacggaggcaacaugcuugaaacaauaaaaguaacaccacaaaccauggacggaauauuaaaaaguauucuaaaaguaaaaaaaagucuaggaauguuuguaagugacacaccaggggaaagaaauccuuaugaaaauauacuauacaaaauuugucuaagcggugacgguuggccauauauagcuucacguacaaguauagucggaagagcaugggaaaauacaaccguagauuuagaaagcgauggaaaaccccauaaaguagggacagcagguaguaguaaaagcuuacaaucagcaggauucccgacaggauuaacauauagucaauuaaugacacucaaagauuccaugaugcaauuagauccuagcgcaaaaacauggauagauauagaaggaagaccagaagauccuguagaaauagcauuauaccaaccaaugucuggaugcuacauucacuucuuuagagaaccaaccgaccuaaaacaguucaaacaagaugcuaaauauucacacggaauagauguagcagaucuauucccagcacaaccaggacuaacaagugcaguaauugaagcauuaccaagaaacauggucuuaacaugccaaggaucagacgacaucaaaagauuauuagacucacaagggagaagagacauaaaauuaauagauauagcauugucaaaagcagacucaagacgcuucgaaaacgcaguaugggaccaaugcaaagacuuaugccauaugcauacaggcguaguagucgaaaaaaaaaaaagagguggaaaagaagaaaucacaccucacugugcacuaauggacuguauaauguaugacgcagcaguaucaggcggucuaaacauaccaguccuaagagcaguacuaccuagagauaugguuuucagaaccucuagcccuaaagugguuuuauaa

SEQ ID NO: 2968 - RNA, 1710 nt, Artificial Sequence
  derived and/or modified CDS sequence (opt6) from Lassa virus__AIT17713__NP
auguccgcuucaaaagaaguaaaaaguuucuuauggacacaaucauuacgaagagaauuaagugguuauugcagcaacauaaaauuacaaguaguaaaagaugcacaagcacuauuacacggucuagauuucucagaagucucaaacguacagagauuaaugcgaaaacaaaaaagagacgauucugacuuaaaaagguuaagagaucuaaaccaagcuguaaauaacuuaguagaacuaaaaucgacacaacaaaaaaguauccuccguguaggaacacuaacaucagaugauuuacuaacauuagccgccgaccuagaaaaacuaaaaaguaaaguaauacgaacagaacgaccccuaucaagcggaguauauauggguaauuuaaguacacaacaacuugaacaacgaagagcauuauuaaacaugauaggaauggucggaggagcacaaggaacacaaccgggccgugauggaguaguucgcgucugggaugucaaaaacccagaucuauuaaauaaucaauucggaacaaugccaucacuaacauuagcgugccucacaaaacaaggacaaguagaucuaaacgaugcaguauuagcauuaacagaccucggcuuaauauacacagcaaaauaucccaauaguucagacuuagaccgacuaucacaaucacauccaauauuaaauaugguagauaucaaaaaaaguagucuaaauauaucaggauacaauuucucauuaggugcagcuguaaaagcaggagcauguauguuagacggagguaacauguuagaaacaauaaaaguuacaccgcaaacaauggacggaauccuaaaaucaauacuuaaagucaaaaaaaguuuaggaauguuuguuucagauacaccaggagaaagaaaccccuaugaaaauauauuauauaaaauauguuuaaguggugauggauggcccuacauagcgagcagaaccucaauaguaggaagagcaugggaaaacacaaccguagaccuagaaucagauggcaaaccacagaaaguuggaacagcggguucaaacaagucauuacaaagugcagguuuuccaacaggauuaaccuauucacaauuaaugaccuuaaaagacuccaugaugcaauuagauccaucugcaaaaacauggauagauauagaaggaagaccugaagacccagucgaaauagcauuauaccaaccaaugaguggaugcuacauacacuuuuuccgagaaccgacugaucuaaaacaauucaaacaagacgcaaaauauagucauggcauagacguagcagauuuauuucccgcacaaccaggauuaacaucugcaguaauagaagcacuuccaaggaacaugguacuaacaugccaaggaucagacgacaucaaaagacuacuugauagccaagggagaagagauauaaaauuaauagauauagcacuaaauaaagcugacucaaggagauucgaaaacgcaguaugggaucaaugcaaagacuuaugucauaugcacacaggcguaguaguagaaaaaaaaaaaagaggaggaaaagaagaaauuacaccacacugugcacuaauggacugcauaauguacgacgcagcaguauccgguggauuaaauaucccaguauuaagggcuguauuaccaagagauaugguauucagaacaucaucaccaaaaguaguauuauaa

SEQ ID NO: 2969 - RNA, 1710 nt, Artificial Sequence
  derived and/or modified CDS sequence (opt6) from Lassa virus__AIT17719__NP
augagugcaaguaaagaaguuaaaaguuucuuauggacacaaucucuaagaagagaacuaucugguuauugcaguucaauaaaauuacaaguugucaaagacgcucaagcauuacuucacggauuagauuucucagaaguaucuaauguacaacgauuaaugagaaaacaaaaaagagacgacucagauuuaaaaagauuaagggauuugaaccaagcuguaaauaacuuaguagaacuaaaaucuacacaacaaaaaaguauuuuaagaguaggaacauuaacaucagacgauuuacucacccuagcugcagauuuagaaaaauuaaaaucaaaaguaauaagaacagaaagaccuuuaucaaguggaguuuauaugggaaaccuaucaacucaacaacucgaacaaagaagggcucuacugaacaugauagggaugguaagcggagcacaaggaacacaaccaggaagggacggaguaguacggguaugggaugucaaaaacccugaauuacuaaacaaucaauucggaacaaugccaagcuuaacauuagcgugccuaacaaaacaaggccaaguagauuuaaaugacgcaguacuagcauuaaccgacuuaggcuuaauuuauacagcaaaauaucccaauagcucagacuuggacagauuaucacagucacacccaauauuaaacaugguagauaccaaaaaaagcagucuaaauauaucaggguacaacuuuucuuuaggagcagcaguaaaagcaggcgcauguauguuagacggagguaauauguuagaaacaauaaaaguaacaccccaaacaauggacgguauauuaaaaucuauacuaaaaguaaaaaaaagccuaggaauguucguaagcgauacaccaggagaaagaaauccauaugaaaauaucuuauacaaaauauguuuauccggagauggcuggccauacauagcaagucgaacaaguauaguaggaagggcaugggaaaauacaacaguagaccuagaaagcgauggaaaaccacaaaagguaggaacagcaggaucaaauaaaucuuuacaaagcgcaggcuuucccacagguuuaacauauagccaacuaaugacauuaaaagauagcaugaugcaacuagauccaucagcaaaaacauggauugauauagaagguagaccagaagauccaguagaaauagccuuauaccagccuaugucaggaugcuauauacauuuuuuuagagaaccaacagaccuaaagcaauuuaaacaagaugcuaaauauagucauggaauagacguagcagaucucuuuccagcucaaccaggauuaacaucagcagucauugaagcauuacccagaaauaugguacuaacaugucaaggaagcgaugacauaaaacgauuacuagacucucagggacgcagagacauaaaauuaauagauauaucacuaucaaaagcagauuccagaagauuugaaaaugcuguaugggaccaauguaaagaccuaugucauaugcauacaggaguaguaguagaaaaaaaaaaacgaggcggaaaagaagaaauuacaccacacugugccuuaauggacugcauaauguaugaugcugcaguaagcgggggacugaacauaccgguauuaagagcaguacuacccagagacaugguauuuagaacaucaaguccaaagguaguauuauaa

SEQ ID NO: 2970 - RNA, 1710 nt, Artificial Sequence
  derived and/or modified CDS sequence (opt6) from Lassa virus__AIT17725__NP
augagugcaucaaaagaaguaaaaucauuccuuuggacacaaagucuaagaagagaacuaagcggauauuguaguaacauaaaacuacaaguagucaaagacgcacaagcacugcuacacggacuagacuucucagaaguaagcaauguacaaagauuaaugagaaaacaaaagagagaugauucagaucuaaaaagauuacgggauuuaaaccaagcagucaacaaucuaguggaacuaaaaucaacacaacaaaaauccaucuuacgaguaggaaccuuaacaagugacgauuugcuaacacuagcagcagaccucgaaaaauuaaaaucuaaaguaauuagaacagaaagaccacuaaguucagguguauauauggguaauuuaagcgcacaacaauuggaacaaagacgagcucuauuaaacaugauaggaaugguaggaggagcacaaggcacacaauuaggaagagauggaguaguacgaguuugggacguuaaaaacccagauuuacuaaauaaucaauucggaaccaugccuaguuuaacauuagcaugccuaacaaaacaaggacaaguagaucuuaacgacgccguauuagcacuaacagauuuaggacugauauauaccgcaaaauauccaaacucaucagaccuagacagauuaucacaaagccacccaauacuaaauaugguagacacuaagaaaucaagucugaauauaucaggauauaacuucaguuuaggagcagcuguuaaagcaggagcauguauguuagacgguggaaauaugcuagaaacaauaaaaguaacaccacaaacaauggacgggauacuaaaaucaaucuuaaaaguaaagaaaagucuuggaauguucguaagugauacaccaggagagagaaacccauacgaaaauauauuauacaaaauaugucuaaguggagauggauggccauacauagcauccagaacaucaauaguagguagagcgugggaaaacacaacaguagaccuugaaagugacggaaaaccacaaaaaguuggcacagcaggaucaaacaaaucauuacaaagcgcaggauucccaacuggauuaacauacucacaacuuaugacauuaaaagauucaaugaugcaauuagacccaucagcaaaaacauggaucgacauugaaggaagaccagaagauccugucgaaauagcauuauaccaaccaauguccggaugcuacauacacuuuuucagagaaccuacagauuuaaaacaauucaaacaagacgcaaaauauagucaugggauagacguagcagaccuuuucccagcccaaccaggacuaacuucagcgguaauagaagcacuuccaagaaauaugguauuaacaugccaaggaagcgaagauauaaaacgacuacuagacucccaaggaagaagggacauaaaacuuauagauauagcucuaaguaaagcugacaguagaagauucgaaaacgcaguaugggaucaauguaaagaucuuugucauaugcauaccggaguaguaguagaaaagaagaaaagaggaggaaaagaagaaauaacaccacacugugcauuaauggauugcauuauguaugaugcggcaguaucaggagguuuaaacauaccaguacuaagagcaguuuugcccagagauaugguauuuagaacaucaagucccaaaguaguauuauaa

SEQ ID NO: 2971 - RNA, 1710 nt, Artificial Sequence
  derived and/or modified CDS sequence (opt6) from Lassa virus__AIT17729__NP
augucagcgucaaaagaaguaaaaucauuuuuauggacacaaucacuaagaagagaacuaaguggauacugcagcuccauaaaacuacaaguaguaaaagaugcacaagcucuccuacauggauuagauuucagcgaaguaucaaauguacaaagauuaaugagaaaacaaagaagagacgacucagaccuaaaacgcuuacgagaccuaaaccaagcaguaaacaaccuaguagagcuaaaaagcacacaacaaaagucaauauuacgaguaggaacuuuaacaagugaugacuuauuaacauuagcugcagacuuagaaaaauuaaaaucaaaaguaauaagaacagaaagaccacuaucauccggaguauauaugggaaaucuaaguacacaacaauuagaacaaaggagagcccucuuaaauaugauagguaugguuggcggaacacaaggaacacaaccaggaagagauggagugguaagaguuugggaugucaaaaacccugacuuacuaaauaaccaauucgguacaaugccuaguuuaacauuagcauguuuaaccaaacaaggacaagucgacuuaaacgaugccguuuuagcacuaacagaucuaggacugauauacacagcaaaauacccaaauaguucagacuuagauagacuuucacaaucacacccgauuuuaaauaugguagacacuaagaaaaguucauuaaacauaaguggauacaacuuuucacuaggugcagcuguaaaagcuggagcaugcauguuagacggaggaaauauguuagaaacaauuaaaguaacaccccaaacaauggauggaauacuaaaaucaauacuaaaaguaaagagaaguuuaggaauguuuguaagcgauacaccaggcgaacguaaucccuaugaaaauauucuauacaaaauaugccuauccggagauggauggccuuacauugcuucacgaacaaguauaguuggcagagccugggagaacacaacuguagauuuagaaucagauggaaaaccacaaaaaguaggaacagcaggaucaaauaaaucauuacaaucugcaggauucccaacuggacuuacauauucacaauuaaugacccuaaaagauuccaugaugcaauuagauccuucagccaaaacauggaucgauauagaaggcagaccagaagauccaguagaaauagcauuauaucaacccaugucaggauguuacauacacuucuuuagagaaccaacagaccugaaacaauuuaaacaagaugcaaaauauucacacgguauagauguagcagacuuauucccagcacaaccuggauuaacaucagcagugauagaagcguugccaagaaacauggucuuaacaugccaaggaucagacgauauaaaaagauuauuagacucgcaagguagaagagacauuaaauuaauagacauagcacuaucuaaagcagauucuagaaaauucgaaaacgcaguaugggaccaaugcaaggauuuaugccauaugcacacagguguuguaguggaaaagaagaaaagaggcgguaaagaagaaaucacaccacauugugcauuaauggauugcauaauguaugacgcagcgguguccggaggauuaaacauaccaguccuacgugcaguauuaccaagagauaugguauucagaacaaguucaccaaaaguuguauuauaa

SEQ ID NO: 2972 - RNA, 1710 nt, Artificial Sequence
  derived and/or modified CDS sequence (opt6) from Lassa virus__AIT17733__NP
augucagcaucaaaagaaguaaaaaguuucuuguggacacagaguuuaagaagagaacuaaguggauacuguaguaacauaaaauuacagguagucaaagacgcacaagcguuacuacacggucucgauuucagugaaguaucuaauguacaaagacuaaugagaaagcaaaaaagagaugauucugaucuaaaaagauuaagagaccuaaaccaagcaguuaauaaccucguagaacuaaaaagcacacaacaaaaaagcauacucagaguaggaacacuaacaucagaugauuuauuaauacucgcagcugaucuagaaaaauuaaaaagcaaaguaauaagaacagaaagaccauuaaguucaggagucuauaugggcaaccucucaacacaacaauuagaacaacguagagcacucuuaaacaugauagguaugguaggaggagcacaaggaacacaaccaggucgagacggagucguaagaguaugggauguaaaaaauccagaucuuuuaaacaaccaauuugguacaaugccaaguuuaacauuggccugcuuaaccaaacaaggacaaguagacuuaaacgaugcaguauuagcucuaacagaccuaggauuaauauauacagcaaaauacccaaauaguagugacuuagacagacucagccaaucacauccuauacuaaauaugguagauacuaaaaaaucaucacucaauauaucuggauauaauuuuucauuaggagcugcaguaaaagcaggugcaugcauguuagacggaggaaacaugcuagaaacaauaaaaguuacaccacaaacuauggauggaaucuuaaaaagcauauuaaaaguaaaaaaaucauuaggaauguucguaucagacacaccuggagaaagaaauccauaugaaaacauacuauauaaaauauguuuaaguggagauggauggccuuacauugcaucuagaacaucaauaguaggaagagcaugggaaaauacaaccguagaccuugaaagcgauggaaaaccacaaaaaguaggaacugcaggcaguaauaaaagucuacagucagcaggauuuccuacagguuuaacauauagucaauuaaugacauuaaaagauucaaugaugcaacuagaucccagugccaaaaccuggaucgauauagaaggaaggccugaagacccagucgaaauagcucuauaucaaccuaugagcggauguuacauacacuuuuucagagaaccaacagaccuaaaacaauuuaaacaagaugcaaaauauagucauggaauagacguagcugaucuauucccagcccaaccaggucuaacgucggcagucauagaagcuuuaccgcgaaacaugguauuaacaugccaaggcucagaugauauaaaaagauuauuagauucacaagguagaagagacauaaaauuaauagauauagcacuaucaaaagcagauagcagaagauucgaaaacgcuguaugggaucaaugcaaagauuuaugucauaugcauacaggaguaguaguagaaaaaaaaaaaagaggagggaaagaagaaauaacaccacacugugcccuaauggauuguauuauguaugaugcugcaguuagugguggacuaaacauucccguauuacgagcaguacuaccaagagauaugguauuucgaacaaguucgccaaaagucguauuauaa

SEQ ID NO: 2973 - RNA, 1710 nt, Artificial Sequence
  derived and/or modified CDS sequence (opt6) from Lassa virus__AIT17745__NP
augucagcaucaaaagaaauuaaaucguuccuuuggacgcaaagccuaagaagagaacuaucaggauauugcagcucaauaaaacuacaaguagucaaagaugcacaggcccuauuacacggacuagauuuuucagaaguuucgaacguacaaagauugaugaggaaacagaaaagagacgauucagaccugaaaagacuacgagacuuaaaucaagccguaaacaaccuaguagaauuaaaaucaacucaacaaaaaucaauccuacgaguaggaacauuaacaagcgaugacuuacuuacucuagcagcagauuuagaaaaauuaaaaucaaaaguuauuaggacagaaagaccacucaguucaggcguauauaugggaaaccuaucaacacaacaacuagaacaaaggagagcauuacuaaacaugauagguauggucggaggagcacaaggaacacaaccaggaagagacggcguaguaagaguaugggauguuaaaaacccagauuuacucaacaaccaauuuggaacaaugcccagcuuaacacuagcaugcuuaacaaaacaaggucaaguagaucuuaaugaugcaguauuagcauuaacagaucuaggauuaauauauacagcaaaauauccaaacucauccgaccuagacagacuaagccaaucacacccaauacuaaauaugguagacacaaagaaaucaucauuaaacauauccggauacaauuucucucuaggagccgcaguaaaagcaggagcauguaugcuagacggaggaaauaugcuagaaacaauaaaaguaacaccacaaacaauggaugggauauuaaaaagcauauuaaaaguaaaaagaucuuuagggauguuuguaucagaugcaccaggagaaagaaacccauaugaaaacauauuauacaaaauaugucuaucaggagacgguuggccauacauagcuagcagaaccaguauaguagguagagcaugggaaaacacuacaguagacuuagaaucagauggaaaaccacaaaaaguaggaacagcagguagcaauaaaagccuacaaagcgcaggauuuccaacaggacuaacuuauagccaacuaaugacauuaaaagauuccaugaugcaauuagacccaucagcaaaaacauggauagauauagaaggaagaccagaagacccaguagaaaucgcacuauaccaaccaaugaguggcuguuauauacauuucuucagagaaccaacagaucuaaaacaauucaaacaagaugcaaaauacucucauggcauugauguagcagaccuauuuccagcccaacccggacuaacaucagcagucauagaggcuuuaccacguaauaugguacuaacaugccaagggucagacgauauaaaaagacuauuggacucacaaggucgaagggacauaaaauuaauagauauagcacuaaguaaaguagauagccgaagauuugaaaaugcaguaugggaccaauguaaagaccuuugccacaugcauacaggcguaguaguagagaaaaagaaaagaggaggcaaagaagaaauuacaccccauugugcccuaauggacuguauaauguacgaugcugcaguaucagguggccuuaacauuccaguccuaagagcaguccuacccagagauaugguauucagaacaucaagcccuaaaguuguauuauaa

SEQ ID NO: 2974 - RNA, 1710 nt, Artificial Sequence
  derived and/or modified CDS sequence (opt6) from Lassa virus__AIT17753__NP
augagugccucaaaagaagucaaaucauuucuuuggacacaaucccuuagaagagaauuaagugguuacuguucaucaauaaaacuacagguaguaaaagaugcacaagcacuacuacauggcuuagauuucucugaaguaucuaacguacaaagauuaaugagaaaacaaaaaagggacgacucagaucuaaaaagacuaagagaucuaaaccaagcuguaaauaaccuaguugaacuaaaauccacccaacaaaaaucaauauuaagaguaggaacacuaacaucggaugaccuuuuaacacuagcagcagauuuagaaaaacuaaaaucuaagguaauaagaacagaaagaccucuuucaagcggcguauauauggguaauuuaagcacacaacaacuagaacaaagacgcgccuuacuaaauaugaucgguaugguaggaggagcacaaggaacacaaccaggaagagacgguguaguaagaguaugggaugucaaaaauccagaucucuuaaacaaucaauucggcacaaugccaucacuaacccuagccugcuuaacaaaacaaggacaaguugacuuaaacgaugcaguauuagcauuaacugauuuaggcuuaauauauacagcaaaauauccaaauucaucagauuuagacagacuuagucaaucacacccuauacucaacaugguagauacaaaaaaaucuucacuaaacaucucaggauacaauuucucccugggagcagcagucaaagcaggugcauguauguuagacgguggaaauauguuagaaacuauaaaaguaaccccacaaacaauggacggaauuuuaaaaucaauauuaaaaguaaaaagaaguuuagguauguuuguuagcgacaccccaggagaaagaaauccauaugaaaacauacuuuacaaaaucugccuaucaggagauggauggccauauaucgcuaguagaacaagcauuguuggccgugcaugggaaaacaccacugucgaucuagaaagugacgggaaaccacaaaaaguaggaacaacagguucuaauaaaagcuuacaaagcgcuggauuuccaacaggauuaacauauagccaauuaaugacacuaaaagauucaaugaugcaauuagacccaucagcuaaaacauggauagacaucgaaggcagaccagaagacccaguagaaaucgcacuauaucaaccaaugaguggcuguuacauccacuuuuucagagaaccaaccgaccuaaaacaauuuaaacaagacgccaaauacucacauggaauagacguagcugaucuauuucccgcacaaccaggauuaacaagugcaguaauagaagcauuaccacgaaacaugguauuaaccugucaaggaucagaugacaucaaaagauuacuagauucucaaggaagaagagauauaaaacuaauagacauagcacuaagcaaagcagacucacgacguuucgaaaacgccgucugggaccaauguaaagaucuuugccauaugcauacaggugucguaguagaaaaaaaaaaacguggcggaaaagaagaaauaaccccacacugugcacuaauggauugcauaauguaugaugcagcaguaaguggaggacuaaauauaccuguauuacgagccguauuaccaagggacaugguuuucagaacaucaucaccaaaaguuguacuauga

SEQ ID NO: 2975 - RNA, 1710 nt, Artificial Sequence
  derived and/or modified CDS sequence (opt6) from Lassa virus__AIT17763__NP
augagugccucaaaagaaguaaaaucauucuuauggacacaaagccuuaggagagaauuaucaggauacugcaguagcauaaaauuacaaguaguaaaagacgcacaagcauuacuacacggccucgacuucagcgaaguguccaauguccaaagacuaaugagaaaacagaaaagagacgauucagaucuaaaaagauuaagagaccuaaaccaagcugucaauaaucuagucgaauuaaaaucgacacaacaaaaaucaauacuuaggguaggaacacugaccagcgaugaccucuuaacacuagcagcagaucuagaaaaauuaaaaucaaaaguuauaagaaccgaaagaccccuaucaagcggaguauauaugggaaaccuaucaacacaacaauuagaacaaagacgagcauuauuaaacaugauagguaugguaggaggggcccaaggaacacaacccggaagagauggaguaguaagagugugggaugucaaaaacccagauuuauuaaacaaccaauucggaacaaugccuucacuuacccuagcaugccuaacaaaacaaggccaaguagauuuaaacgacgccguacuagcgcuaacagauuuaggccuaauauacacagcaaaauauccaaauagcagcgaccuagacagauuaucacaaagccacccuauauuaaacaugguagauacaaagaaaucaagccuaaacauuucaggauacaauuucucacuaggagcagcaguaaaagccggugcaugcauguuagacggaggaaacaugcuagaaacaauuaaaguaacuccccaaacaguagacgggauucuaaaaucaauacuaaaaguaaaaagaaguuuaggaauguucguaucagauacgccaggagaacgaaaucccuaugaaaacaucuuguacaaaauauguuuaucaggagauggauggccauauauagcaucuagaacaucaauaguagguagggccugggaaaauacuacaguagaucuagaaagcgaugaaaaaccacaaaaaguaggagcagccggaucaaauaaaucacuacaaagugcaggauuuccaacaggucuaacauacucacaauuaaugacauuaaaagauuccaugaugcaacuagauccaucagcaaaaacauggauagauauagaaggaagaccagaagauccuguugaaauagcuuuauaucaaccaaugucuggauguuacauacacuucuucagagaaccaaccgauuuaaaacaauuuaaacaagacgcaaaauauagccacggaauugacguaacagauuuauuuccagcacaaccaggacuaacaucagcaguaauagaagcauuaccaagaaacaugguauuaacaugucaagggucagaugauauaaaaagauuauuagacucacaagguagacgagauauaaaauuaauagauauagcccuaucaaaagcagacucucgcagauuugaaaacgcagucugggaccaauguaaagacuuaugccauaugcauacaggaguaguuguugagaaaaagaaaagaggaggaaaagaagaaauaaccccacacugugcauuaauggacugcauaauguaugacgcagcaguuagcggaggacugaacauaccaguccucagggcaguauuaccucgagacaugguauucagaacgucaucacccaaaguaguucuauaa

SEQ ID NO: 2976 - RNA, 1710 nt, Artificial Sequence
  derived and/or modified CDS sequence (opt6) from Lassa virus__AIT17771__NP
auguccgcuucaaaagaaguuaaaucauuccuauggacacaaucacuacgaagggaauuaucaggauauuguagcagcauaaaacuucaagucguuaaagacgcucaagcucuauuacacggccuagauuucagugaagucucaaacguacaaagacuaaugagaaaacaaaaaagagacgauucagaucuaaaaagacuuagagaucuaaaucaagcaguaaacaauuuaguagaauuaaaaaguacacaacaaaaaaguauauuaagaguagguacacucacaagugaugacuuacuaacacuagcagcagaucuggaaaaauuaaaaucaaaagucauacgaacugaacgaccacuauccagcggugucuauauggguaaucuuucaacacaacaauuagaacaaagaagagcauuauuaaauaugauaggaaugguaggaggcgcacaaggaacucaaccaggaagggacggagucguaagagucugggacgucaaaaacccugaucuauuaaauaaccaguucggaacaaugccaagucucacccuugccugccucacaaaacaaggccaaguagaccuaaaugacgcuguauuagcuuuaaccgaccuaggauuaauauacacagcgaaauacccaaauuccucggauuuagaccgacucagucaaucacauccuauauuaaacaugguugacacaaaaaaaucaaguuuaaauauaucaggauacaacuuuucacucggagcagcagucaaagcaggugcuugcauguuagauggaggaaauauguuagaaacaauaaaaguaacaccacaaacaauggacgguauauuaaaaucaauacucaaaguaaaaagaucauuaggcauguucguaagugauacaccaggagaaagaaauccauaugaaaacaucuuauacaaaauuuguuuaucaggcgacggauggccauauauagccagccgaacaagcauagucggaagagcaugggaaaacacaacaguagauuuagaaucagacggaaaaacacaaaaagugucaacugcaggaagcaauaaaucacuucagucagcaggauuuccaacuggucuaacuuauucacaacuaaugacauuaaaagauucuaugaugcaauuagauccaagcgcaaaaaccuggauagacauugaaggaagaccagaagauccaguagaaauagcucucuaucaaccaaugucaggauguuacauacacuuuuucagagaaccaacagaccuuaaacaauucaaacaagaugcaaaauauucccacgggauagacguaacagaucucuuuccagcccaaccaggcuuaaccagcgccguuauagaagcguuaccaagaaacaugguauuaaccugucaaggcagugacgacauaaaaagacuauuagacucccaaggaagaagagacauaaaauuaauagauaucgcauuaucaaaagccgauagcagacgauucgaaaaugcaguaugggaccaaugcaaagauuuaugccauaugcacacaggagucguaguagaaaaaaaaaagaggggaggcaaagaagaaauaacaccacauugcgcauuaauggauugcauaauguacgacgcagccgucucaggaggacugaauauuccaguacuaagggcagucuuaccuagagacaugguauuccgaacuaguucaccaaaaguagucuuauaa

SEQ ID NO: 2977 - RNA, 1710 nt, Artificial Sequence
  derived and/or modified CDS sequence (opt6) from Lassa virus__AIT17779__NP
augagcgcaucgaaagaaguaaaaaguuuucuauggacacaaucuuuaagaagagaauuaagugguuauugcuccaacaucaaauuacaaguaguaaaagaugcacaagcauuauuacauggauuagauuuuagcgaaguaaguaacguacaaagacuaaugagaaaacaaaaaagagaugauggagaucuaaaaagauuacgugaucuaaaucaagcaguaaauaaucuaguagaacuaaaaucaacucaacaaaaaucaauuuuaagagucggaacuuuaacuucagacgaccuacuaacacucgcagcagaucuagaaaaacuaaaaucuaaaguuauaagaacagaacguccccuaaguucaggagucuacaugggaaacuuaucaacacaacaauuagaacaaagacgagcacuauuaaauaugauaggaaugguuggaggcgcacaaggaacucaaccagguagagacgguguaguuagaguaugggauguuaaaaaucccgacuuacuaaacaaucaauucgguaccaugcccucccuaacauuagcaugucuaacaaaacaaggccaaguagacuuaaacgacgcaguauuagcuuuaacagauuuaggauuaauauacacagcaaaauauccaaacucaucggauuuagauagauuaagucaaucacacccgauauugaauaugguagacacaaaaaaaagcuccuuaaacauaucggguuacaacuucaguuuaggugcagcuguaaaagcaggugcauguauguuagauggaggaaauaugcuagaaacaauaaaaguuaccccccaaacaauggacgggauacuaaaaagcauauuaaaaguaaaaaaaagucuuggaauguuuguuagugacacaccuggagaaagaaaucccuaugaaaauauauuauacaaaauaugucuauccggagacggauggccauauauagcaucaagaacuagcauaguagggcgagccugggaaaauacuaccguagaucuagaaucagauggcaaaccacaaaaaguaggaacagcagguucaaauaaaucacuacaaagugcaggauucccaacuggacuaaccuauucacaauuaaugacacuaaaagacaguaugaugcaacuagauccaucagcaaaaacauggauugauauagaaggaagaccagaagacccaguagaaaucgcacuuuaucaaccaaugagcggauguuacauacauuucuuccgagaaccuacugacuuaaaacaauuuaaacaagacgcaaaauauucacacggaauagauguuacagaucuguuuucagcacaaccugguuuaacaucugccguaaucgaagcccuuccccguaacaugguacugacaugucaagguagcgaugacauuaaaagacuuuuagacagccaaggaagacgagauauaaaauuaauagauauagcucuaucuaaaacugacucaagaagauucgaaaacgcuguaugggaucaaugcaaagaccuaugccauaugcacacaggagucguaguugaaaaaaaaaaaagaggagguaaagaagaaauaacaccacacugugcacuaauggauugcauaauguacgacgccgcaguuucaggaggauuaaauauaccaguauuaagagcaguauuacccagagacaugguauuuagaacaucaagcccaaaaguaguuuuauaa

SEQ ID NO: 2978 - RNA, 1710 nt, Artificial Sequence
  derived and/or modified CDS sequence (opt6) from Lassa virus__AIT17783__NP
augucagcuagcaaagaaguaaaaaguuuuuuauggacacaaagcuuaagaagagagcuaucaggcuacuguucaaacauaaaacuacaagucguaaaagacgcacaagcacuucuucacggacucgauuuuagugaaguuagcaacguucaaagacuuaugcgaaaacaaaaaagagacgauucagaucucaaaagauuaagagauuuaaaccaagcaguaaacaauuuaguagaauuaaaaaguacccaacaaaaaaguauucuaagagucggaacacuaacuagugacgauuuacuaacacuagcugcagacuuagaaaaauuaaaaaguaaaguaaucagaacugaaagaccacucucaucaggaguauacaugggaaaucuaucaacucaacaacuagaacaaagacgagcacuuuuaaauaugauagggaugguaggaggagcacaagguacacaaccuggaagagauggcgugguuaggguuugggacgucaaaaauccagacuuacuuaauaaucaauucgguacuaugccuucacuaacucuagcuuguuuaacaaaacaaggacaaguugauuuaaaugauguaguauuagcauuaacagacuuaggauuaaucuauacugcaaaauauccaaauaguucggaucuugacagacuuagccaaagucacccuauauuaaauaugguagacaccaaaaaaaguucauuaaacauaaguggauauaauuuuucauuaggagcagccguaaaagcuggugcaugcaugcuagauggaggaaauauguuagaaacuauaaaagucacaccacaaacuauggauggaauacuaaaaaguauauuaaaagucaaaaaaaguuuaggaauguuuguaucagauaccccaggagaaagaaauccauaugaaaacauacuauacaaaauaugccuaucaggagauggcuggccguacauagcuucaagaacaaguauaguaggaagagccugggaaaacacaacaguagaucucgaaagugauggaaaaccacaaaaaguaggaacagcuggcucaaauaaaagucuacaaagcgcaggauuuccaacuggacuaacauauagccaauuaaugacauugaaagacagcaugaugcaauuagauccaucagcaaaaaccuggauugacauagaaggcagaccugaagaucccguagaaauagcuuuauaucaaccgguaaguggcuguuacauacauuuuuuuagagaaccaacagauuuaaaacaauuuaaacaagaugcaaaauacucccauggaauagauguugcugauuuauuuccagcacaaccaggucuaacuucagcaguaauagaagcauuaccaagaaacaugguauuaacaugucaaggaagcgacgauauaaaaagauuacuagacucacaaggaagaagagacauaaaacugauagauauagcauuaagcaaagcagacaguagaagauucgaaaacgcaguaugggaucaauguaaagaccuaugccauaugcauacagguguaguaguagaaaaaaaaaaaagaggaggaaaagaagaaauaacaccacauugugcgcuaauggacugcaucauguacgacgcagcaguuagcgguggacuaaauauaccaguacucagggcaguacugccacgagauaugguauuuagaacauccucaccuaaaguaguacuuuaa

SEQ ID NO: 2979 - RNA, 1710 nt, Artificial Sequence
  derived and/or modified CDS sequence (opt6) from Lassa virus__AIT17787__NP
augucagcuucaaaagaaguaaaaucuuuccuuuggacccaaagucuaagaagagaacuaucaggauauugcaguaacauuaaacuccaaguuguaaaagaugcacaggcuuuauuacauggauuagauuucucagaaguuucgaauguccaaagauuaaugagaaaacaaaaacgugacgacggugaucuaaaaagauuacgagacuuaaaccaggcuguaaacaacuuaguagaacucaaauccacacaacaaaaaucaauccuaagaguuggaacacuaacaagcgaugaucuacuaacauuagcagcagaucuagaaaaauuaaaaucuaaaguaauaagaacagaaagaccacugucaucaggaguauauauggguaauuuauccacacaacaacuagaacaacggagagcauuauuaaauaugauaggaaugguaggaggugcucaaggaacacaaccaggaagagacgggguuguuagaguaugggaugucaaaaaucccgacuuacuaaauaaccaauuuggaacaaugccaagucuaacauuagcaugcuuaaccaaacaaggucaaguagaucugaaugaugcaguauuagccuuaacagauuuaggacuaauauauacagcaaaauauccaaauagcagugauuuagauagauuaagccaaucacauccaauauuaaacauggucgauacaaagaaaaguucacuaaauauaucaggauacaacuuuucauuaggagcagcaguaaaagcaggagcauguauguuagacggcgguaauauguuagaaacuauaaaaguaacaccccaaaccauggacggaauccuaaaaucgauacuaaaaguuaaaaaguccuuaggaauguuuguaucagauacaccaggagaaaggaauccauaugaaaacauauuauauaaaauaugucuuucaggagauggauggccauauauugccucaagaacaucaaucguuggccgugcaugggaaaauacaacugucgacuuagaaagcgauggaaaaccacagaaaguaggaacagcaggaagcaauaaaucgcuccaaucagcaggauuuccuacgggacuaacauacagucaauuaaugacauuaaaagacuccaugaugcaacuagaucccagugccaaaacauggauugauauagaaggacgaccagaagaccccguagaaauagcauuauaucaaccaaugucagguuguuacauacacuucuucagagaaccaacagauuuaaaacaguuuaaacaagacgcaaaauauagucacggaauagacguuacagauuuauuuucagcacaacccggcuuaacaucugcaguaauagaagcauuaccaagaaacaugguauuaaccugucaaggaagugaugacauaaaaagacuacucgacagucaaggaagaagagacauaaaauuaauagauauagcacuaucaaaaguugauucaagaagauucgaaaacgcgguaugggaccaaugcaaagauuuaugucauaugcauacaggaguaguuguagagaaaaagaaaagaggagggaaagaagaaauuacgccucacugugcauuaauggauugcauaauguaugacgcagcaguaucaggcggucuuaauauuccaguucuaagagccgugcuaccaagagauaugguauucagaaccucauccccaaaagugguauuauaa

SEQ ID NO: 2980 - RNA, 1710 nt, Artificial Sequence
  derived and/or modified CDS sequence (opt6) from Lassa virus__AIT17803__NP
augucugcaucaaaagaaaucaaaucauucuuauggacucaauccuuaagaagggaauuaucaggauauugcucuaacauaaaacuacaaguuguaaaagaugcacaagcacucuugcacggacuagauuucucagaaguauccaacguacaaagacuuaugagaaaagagagaagagacgauaaugaccuaaaaagacuaagagaucuaaaccaagcgguaaauaauuuagucgaauuaaaaucuacacaacaaaaaucaauauuaagaguaggaacauuaacuucagaugauuuacucauccuagccgcagaucuagagaaacugaaaagcaaaguaaucagaacugaacgaccacuaucagcaggagucuauaugggaaaucuaagcucucaacaacuagaccaaagaagagcuuuauuaagcaugauaggaaugaguggaggaagucaagaagcaagagcaggaagagacggaguaguacgaguaugggacgugaaaaacgcagaacuacuaaauaaccaauuugguacaaugccaaguuuaacgcuagcauguuuaacaaaacaaggacaaguagaccuuaaugaugcgguacaagcauuaacagacuuaggcuuaauauacacagcaaaauauccaaacacaagcgauuuagaucguuuaacucaaucacacccaaucuuaaacaugauagacacaaaaaaaucaagucuaaacauauccggauacaacuuuagcuuaggagcagcuguuaaggcaggugcaugcauguuagacggaggaaauaugcuagaaacaauaaaaguaagcccgcagacaguagauggaauauugaaaucaauauuaaaaguaaaaaaagcauuaggaauguucauaagcgauacacccggcgaaagaaauccauaugaaaauauauuauauaaaaucuguuuaaguggagacggauggccauacauagcaucaagaacauccauaacaggacgagcuugggaaaauaccguggucgaucuagaaucagacggaaaaccacaaaaagcaggaucaaauaauucaaauaaaagccuacagagugcaggauuuacugcaggacuaacauauagccagcuaaugacauuaaaagacgcaauguuacaauuagaccccaaugcaaaaacauggauggauauagaaggaagaccagaagacccaguagaaaucgcauuauaucaaccaagcagugguugcuacauacacuucuucagagaacccaccgaucuaaaacaauuuaaacaagaugcaaaauauucacauggcauagauguaacagaucuuuucgccgcacaaccaggauuaaccuccgcgguuauagacgcacuaccaagaaacaugguaauaacuugucaagggagugaugauauaagaaaacuguuagaaucccaagguagaaaagauauaaaguuaauagauauagcucuaaguaaaacagauucaagaaaauaugaaaaugcaguaugggaccaauauaaagaccuuugccauaugcauacaggaguaguaguagaaaaaaaaaaaaaagguggaaaagaagaaauaaccccacacugugcacuaauggacugcauuauguuugacgcagcagucagcggaggauuaaacacuaguguacuuagagcaguacucccaagagauaugguauucaggacaucaacaccacgaguaguacuauaa

SEQ ID NO: 2981 - RNA, 1710 nt, Artificial Sequence
  derived and/or modified CDS sequence (opt6) from Lassa virus__AIT17811__NP
augucagcaucaaaagaaauaaaaucauuucucuggacucaaagcuuacgcagagagcuaucagguuauuguucaaacauaaaauuacaaguaguaaaagaugcacaagcuuuacuccauggauuagacuucagcgagguaagcaauguacaaagacuaaugcgaaaagaaagaagagaugacaacgaccuaaaacgacuaagagacuuaaaccaagccguaaauaaucuaguugaacuaaaaagcacacaacaaaaaucaauccuuagaguaggaacgcuaacaagcgaugacuuauuaauacuagcagcagaccuagaaaaauugaaaagcaaaguuacaagaacagaaagaccccuaucagcagguguauacaugggaaaucuaagcagucaacaauuagaccaaagaagagcacuauuaaacaugauagguaugucaggcaguaaccaaggagcacgagcaggaagagauggcguaguuagaguaugggauguaaaaaacgcagaacuuuuaaauaaccaauuuggaacgaugccaagucuaacacuagcaugcuuaacaaaacaaggacaaguagauuuaaacgacgcagugcaagcauuaacagauuuaggacuuauauauacagcaaaauauccaaauacuagugacuuagauagacuaacacaaagccacccaauauuaaauaugauagauacaaaaaaaucaagucuuaacauuagcggauauaacuucucacuaggcgcagcuguaaaagcaggcgcauguaugcuagacggcggaaauaugcuagaaacaaucaaaguaaguccacaaacaauggauggaauauuaaaaagcauauuaaaaguaaaaaaagcauuaggcauguuuauaucagauacaccaggagaaaggaauccguacgaaaauauauuauauaaaauauguuuaucaggagauggauggccauauauagcaucacgaacaagcauaacaggaagagccugggaaaacacaguagucgaucuugaaucagauggaaaaccucaaaaagcaggaaguaacggaaguaauaaaucacuucaaagugcugguuuuacagcaggcuuaacauauucacaauugaugacacuaaaagaugcaauguuacaauuagauccaaaugcaaaaacauggauggauauagaaggacgaccugaagacccuguagaaauagcuuucuaccaaccaucauccggaugcuauauacauuuuuucagagaaccaacagauuuaaaacaguuuaaacaagaugcuaaauauagucauggaauagacguuacagaucuauuugcugcucaacccggcuuaaccagcgcaguaauagacgcacuaccaagaaacuuagucauaacaugccaaggaucagacgacauaagaaaacuauuugaaagccagggacgcaaagacauuaaacucauagauauagcauuaucaaagaccgacucuagaaaauacgagaaugcaguaugggaccaauacaaagacuuaugccacaugcauacaggaauaguagucgaaaaaaaaaaaagaggaggaaaagaagaaauaacaccacacugugcacucauggacugcauaauguucgaugcagccguaucaggaggacucaacgcaagcguacuaagagcaguacuccccagggauaugguauucagaacuucgacuccaaggguaguccuguaa

SEQ ID NO: 2982 - RNA, 1710 nt, Artificial Sequence
  derived and/or modified CDS sequence (opt6) from Lassa virus__AIT17815__NP
augucagcaucaaaagaaauaaaaucuuuccucuggacacaaucacuccgaagagaauuaucaggauauugcucaaauauaaaauuacaaguugucaaagacgcucaagcauuauuacacggauuagacuucucagaaguaucaaauguccaacgcuuaaugcgaaaagaaagaagagaugauaacgaccuaaaaagguuaagagacuuaaaucaagcaguaaauaaccuagucgaacuaaaaaguacacaacaaaaaaguauccuccgaguaggaacacuuacguccgaugaucuauuaaucuuagcagcagaucuagaaaaacuaaaaucaaaaguuacaagaacggaaagaccauuauccgccggaguauacaugggaaaccuaaguagccaacaacuagaucaaaggagagcacuacuugacaugauaggaaugagcggaaguaaccaaggagcccgagcuggaagagacggagucgucagaguaugggauguaaaaaaugcagaacuacuaaauaaucaauuuggcacaaugccaucauuaaccuuagcauguuuaacaaaacaaggacaaguagaucugaacgaugcaguacaagcucuaacagauuuaggauuaauauauacagcaaaauacccaaauacgucagacuuagaucgacuaacacaaucacaucccauucuuaacaugauagauacaaaaaaaucaagucuaaacauaucgggauacaauuuuucacuaggagcagcagugaaagcgggugccugcauguuagacggaggaaacauguuagaaacuauuaaagucucaccacaaacaauggauggaauauuaaaaaguauccuuaaaguaaaaaaagcauuaggaauguuuauaagugaugccccaggagaaagaaacccuuacgaaaauauauuauacaaaauaugucuaaguggcgauggauggccuuauauagcaucacgcacaagcauaacaggaagagcaugggaaaauacagucguagacuuagaaagcgauggaaaaccacaaaaagccggaaguaacggaucaaacaaaagucuacaaagcgcaggguuuacagcaggauuaacauacucucaacuaaugacauuaaaagaugcaaugcuacaauuagauccaaaugccaaaacauggauggauauagaaggaagaccagaagaccccguagaaaucgcacuauaccaaccaagcaguggguguuacauacauuuuuuuagagaaccaacugaucuaaaacaauuuaaacaagacgcgaaauacagucacggaauugacguaacugauuuauuugcagcucaaccaggauuaacuagcgccguaauagaugcauuaccaagaaauaugguaauaacgugucaaggaucagaugacauaagaaaauuauuugaaucacaaggaagaaaagauauaaaacucauagauauagcccuaucaaaaacagacagcagaaaauacgaaaacgcagugugggaccaguauaaagaccuuugccauaugcacaccggaauaguuguagaaaaaaaaaaaagagguggaaaagaagaaauaacaccacauugugccuuaauggauugcauaauguucgacgcugcaguaucaggcggacuaaacacuucaguccuaagagcaguccucccaagagacaugguuuucagaacaaguacacccagaguagucuuauaa

SEQ ID NO: 2983 - RNA, 1710 nt, Artificial Sequence
  derived and/or modified CDS sequence (opt6) from Lassa virus__AIT17821__NP
auguccgcaaguaaagaaauaaaaucauuuuuauggacacaaucacuacgaagagaacucucaggauauugcagcaacaucaaacuucaagugguaaaagacgcacaagcucuauuacauggucuagacuucucggaaguaaguaauguacaaagacuaaugagaaaagaacgaagagaugacaacgaucuuaagagauuaagagaucuaaaccaagccguaaauaauuuaguagaauuaaaaaguacacaacagaaaucuauacuaagaguuggaacacuaacaagugacgaccuacuaaucuuagccgcagaccuagaaaaacucaaaagcaaaguaauaagaacagaacgaccacuaucagcaggcguauauauggguaaccuaagcagccaacaacuagaucaaagaagagcccuauuaagcaugaucgguaugaguggcggaaaucaaggagcaagagcaggaagagauggagucguacgagugugggaugucaaaaacgcagaauuauuaaacaaucaauuuggaacaaugccaucacuaacacucgcaugucuaacaaaacaaggacaaguagaccuuaacgaugcuguacaagcauuaacagacuuggguuuaauauauaccgcaaaauaucccaacacaagcgauuuagauagacuaacacaaucacacccaauauuaaacaugauagacacaaaaaagucaucacuaaauauuagcggcuauaauuuuucacuuggagcugcuguaaaagcuggagcauguaugcuagaugguggaaauauguuagaaacaauaaaaguaucuccacaaaccguagacgguauacuaaaauccauacuaaaaguuaaaaaagcauuagggauguucauaucagauacaccaggagaaagaaaccccuaugaaaauauacucuacaaaauaugccuaucaggagaugguuggccguauauugcaucaagaaccagcauaacaggaagagcaugggaaaauacaguaguugauuuagaaucagacggaaaaccacaaaaaacuggaucaaacaauucaaauaaaaguuuacaaucagcaggcuuuacagcaggacuuacuuauucacaauuaaugacacuaaaagacgcaaugcuacaacuagauccaaaugcaaaaacuuggauggacaucgaaggaagacccgaagacccuguagaaguagcacuauaccaaccaagcucaggguguuacauacauuuuuuuagagaaccaacugaccuaaaacaauucaaacaagacgcaaaauauucacauggcauugacguaacugaucuauucgcugcccaacccggacuaacuagcgcagugauugaugcacuuccaagaaacaugguaauaacaugccaaggcucugaugauauaagaaaacuacuagaaucgcaaggaaggaaagauauaaaacuaauagauaucgcacuaaguaaaacagacaguagaaaauacgaaaaugcaguaugggaucaauauaaagaccuuugccacaugcacaccgggguaguaguagaaaaaaaaaaaagagggggaaaagaagaaauuacaccacacugcgcauuaauggacuguauuauguuugacgcugccguaagcggaggauuaaauacaucaguucuacgagcaguacuaccaagagauaugguauucagaacaucaacuccacgagucguccuauaa

SEQ ID NO: 2984 - RNA, 1710 nt, Artificial Sequence
  derived and/or modified CDS sequence (opt6) from Lassa virus__AIT17837__NP
augucaaauaguaaagaaauuaaaucauuccuuuggacacaaucauuaagaagagaacuaagcgguuauugcaguaacauuaaauuacaaguaguaaaagacgcacaagcucugcuccacggacucgauuuuucagaaguaucaaauguacagagacuaaugagaaaacaaaaaagagacgaugccgauuuaaaacgguuaagagaucuaaaucaagcaguaaacaaucuaguagaacuuaaaucaacacaacaaaaaaauguauuaagagucggaacauuaagcucggacgaccuaauaacucuugcagcugaucuagaaaaauuaaaaucuaaaguuauucgaacagaaagaccacuuaguucaggcgucuauaugggcaaucuaaguagccaacaauuagaucaaagaagggcccuauuauccaugauagguaugucaggaggcccacaagguaaccgaacaggaggagauggugucguacggguaugggaugucaaaaacgcagaauuacuuaauaaccaauucggaacaaugccaucauuaacacuagcaugcuugacaaaacaaggacaaguagaucuaaaugaugccguacaagcacuaacagaccuaggacuuauauauacagcaaaauauccaaauucaucagaccuugauaugcuaacucaaagucacccuauacuuggaauggucgauacaaaaaaaucaagcuuaaacauuucaggauacaacuuuucacucggagcagcagucaaagcaggcgcaugcauguuagacgguggaaauauguuagaaacaauaaaaguaucaccacaaacaauggacgguauauuaaaaucaauauuaaaaguuaaacgaucauuaggcauguuuauaagcgauacaccaggagagagaaaucccuaugaaaacauauuguacaaaauaugucuaucaggagagggcuggccuuauauagcaucaagaacaucaauaaccggacgagcaugggaaaauacuuuaguagaucuggaaucugauaauaaaccaccuaaauugaacucagcagguucuaauaaaucuuuacaagcagcaggcuuaaacgcaggacuuacauauagccaacuaaugacauuaaaagauugcaugcuacaacucgauccaaguucaaaaacauggauagauauagaaggccgaccagaagacccaguagaaauagcccuauuucaaccaucuucaggauguuacauacauuuuuuccgugaaccaacagauuuaaaacaauuuaaacaagacgcgaaauacagccauggaauagauguuacagaucuauucucaacacaaccaggauuaacaagugccguaauagaagcauuaccaagaaacaugguacuaacaugccagggcucagacgacaucaaaaaacuauuagaaucacaaggaagaagagacauaaaacuaaucgacauaucauuaucaaaagcagacagcagaaaauucgaaaaugcuguaugggaucaauauaaggaucuaugccauaugcauaccggaguaguaguagaaaaaaaaaaaagaggaggaaaagaagaaauaacuccacauugcgcuuuacuagacuguauaauguucgaugcagcaacaacuggaagccuaaauauaacaacacuacgagccguacuuccaagagauaugguauucagaacaucuaccccaaaaguaguuuuguga

SEQ ID NO: 2985 - RNA, 1710 nt, Artificial Sequence
  derived and/or modified CDS sequence (opt6) from Lassa virus__AIT17841__NP
augucagcaaguaaagaaauaaaaucuuuucuuuggacacaaagccuaagaagagaacucucaggauauugcaguaacauaaaauuacaaguaguuaaagacgcacaagcacuacuacauggauuagauuucucagaaguaagcaacguccaacgacuaaugcguaaagaaagaagagaugacaacgaucuaaaaagacuaagagaccucaaccaagcaguaaauaaccuuguugaacuaaaaucaacacaacaaaaaucaauauuacgagucggaacacuaaccagcgaugaccuacuaauauuagcagccgaccuugaaaaacuaaaaucaaaaguaaccaggacagaaagaccacuaucagcaggaguauauaugggaaaccuuagcagucaacaacuagaccaaaggcgagcacuuuuaaauaugauaggaaugucgggaucuaaucagggugcaagaacaggacgagacggaguaguaagaguuugggacgucaaaaacgcggaacucuuaaacaaucaauuugguacaaugcccucacuaacacuagcaugccuaacaaaacaaggucaaguagaccuaaacgaugcaguacaagcacucaccgacuuaggauuaauauauacagcaaaauauccaaacacaucagaucuagacagacuaacucaaagucauccaauauuaaacaugauagauaccaagaaaagcaguuuaaauaucagcggauacaauuucucacuaggagcagcaguaaaagccggugcaugcaugcuagauggagggaauaugcucgaaacaauaaaaguaucaccucaaaccauggacgggauucuaaaaagcaucuuaaaaguaaagaaagcauugggaauguuuauuagcgaugcaccuggagaaagaaaucccuaugaaaauauauuauacaaaauaugccuaucaggagauggcuggccauauauagcuucuagaaccucaauaacaggaagggcuugggaaaauacaguaguagaccuagaauccgauggcaaaccacaaaaagccggaucaaacggaucuaauaaaagucuccaaagugcaggcuuuacugcaggccuuacauauucacaauuaaugacuuuaaaagacgcgauguuacaauuagacccaaacgcaaaaacauggauggacauagaagggcgaccagaagacccuguagaaauagcuuuauaccaaccaucaucaggaugcuacauacauuucuucagagaaccaacugaucuuaaacaauuuaaacaagacgcaaaauauagccacggcauugacgucaccgaccuauuugcagcacaaccgggauuaacaagcgcaguaauagaugcuuuacccagaaacaugguaauaaccugucaaggaagugaugacauucgaaaacuauuugaaagucaaggucgaaaagauauaaaauuaauugauaucgcccuaucaaaaaccgacucacgaaaauaugaaaaugcaguaugggaucaauacaaagauuuaugccauaugcacacagguaucguuguagaaaagaagaaaagaggaggcaaagaagaaauaacuccacacugugcacuuauggauuguauaauguuugacgcagcuguaucagguggacuaaacacaucaguacucagagcaguuuuaccuagagacaugguauucaggacaaguacuccaagaguuguacuauaa

SEQ ID NO: 2986 - RNA, 1710 nt, Artificial Sequence
  derived and/or modified CDS sequence (opt6) from Lassa virus__AIT17845__NP
augagcgcaagcaaagaaaucaaaucauuccuauggacacaaucauuacgaagagaacuaucagguuauugcaguaacauaaaauuacaaguuguaaaagaugcacaagcacuauuacauggacuagauuuuucugaaguaagcaauguacaaagguuaaugagaaaagaacgacgcgacgacaacgaccucaaacgacuaagagaccuaaaucaagcuguuaauaaucuaguagaauuaaaaucaacacaacaaaaaucaauacuaagaguaggaacacuaaccagugaugacuuauuaauacuugcagccgaucucgaaaaacuaaaauccaaaguaacuagaacagaaagaccacuaagugcuggugucuauaugggaaaucuaaguucucaacaauuagaucaaaggagagcacuacuaaacaugauaggaaugucuggaucuaaucaaggagcacaaacuggaagagacggaguaguaagagucugggaugugaaaaaugcagaauuauugaauaaccaauucggaaccaugccaaguuuaacuuuagcaugccuuacaaaacaaggacaaguagaccuaaacgaugcaguacaagcauuaacagacuuaggccuuaucuauaccgcaaaauauccuaacacaagcgacuuagauagacucacacaaucacauccuauacuaaacaugauagauacaaagaaaucaagucuuaauauaagcggauauaauuucucgcuaggagcagcaguaaaagcaggagccugcauguuagacggcggcaauaugcuagaaacaauaaaaguaagcccacaaacaauggacggaauacuaaaaucuauauugaaaguaaagaaagccuuaggcauguucauuagcgaugcgccaggagaaagaaacccauaugaaaacauacuauauaaaauaugucuaagcggagacggauggccauauauagcaagcagaacaucuauaacaggcagagcaugggaaaauacaguaguagaucuagaaucagauggaaaaccucaaaaagcaggaaguaacgggucaaauaaaucacuacaaucagcaggauucacagcaggacuaacauacagucaacuuaugacauuaaaagaugcaaugcuacaacuagauccaaaugccaaaacuuggauggauauagaagguagaccagaagauccaguagaaauagcuuuauaucaaccuaguucaggauguuauauacacuucuuuagagaaccaacagaucuaaaacaauuuaaacaagaugccaaauauagccacggaauagacgugacggaccuauuugccgcacaaccaggcuuaacaagugcaguaauagaugcuuuaccgagaaacaugguaauuacaugucaaggaagugaugacauaagaaaacuauuugaaagucaaggcagaaaagauauaaaacuaauugauaucgcucuaucaaaaacagacucuagaaaauaugaaaaugcggucugggaccaauauaaagacuuaugucauaugcauacaggaauaguuguagaaaagaagaaaagaggaggaaaagaagaaauaacaccacacugcgcacuuauggauugcauaauguuugacgcagcaguaucaggaggucuaaauacaucaguccuaagagcaguacuaccaagagauaugguauucagaacaaguacaccgagaguaguacuauaa

SEQ ID NO: 2987 - RNA, 1710 nt, Artificial Sequence
  derived and/or modified CDS sequence (opt6) from Lassa virus__ANH09723__NP
augucagccucaaaagaaauaaaaucuuucuuauggacacaaucacuaagacgugaacuaucagguuauugcucaaauauaaaauuacaaguagucaaagacgcccaagcauuacuacacggacuagacuucucugaaguaaguaauguacaacgacuaaugcgaaaacaaagaagagaugacaacgauuuaaaaagacuaagagaucuaaaucaagcuguaaauaaccuaguagaauuaaaaaguacacaacaaaaaagugucuuaagaguaggaacuuuaaccucugaugauuuacuaacccuagcugccgacuuagaaaaauuaaaaucaaaaguaacacgaacagaaagaccacuaacugccggaguuuauaugggaaacuuauccucacaacaacuagaucaaagacgagcauuacuaaacaugauaggaauguccgguggaaaccaaggagcuagaacuggaagagacggcgucgugagagucugggacguaaaaaacgcugaauuauuaaauaaucaguucggaacaaugccaucacuaacucuagcaugucuaacaaaacaaggacaaguagaccuaaacgauguaguucaagcauuaacagauuuaggauuaaucuauacagcaaaauauccuaauacaagugacuuagacagauugacacaaucucacccaauacuaaauaugauagacacuaauaaaucaaguuuaaauauaucaggauacaacuuuagccuaggagcagcaguaaaagcgggagcaugcaugcuagacggaggaaacauguuagaaacuauaaaaguaucgccacaaacaauggauggaauuuuaaaaucaauauuaaagguaaaaaaaagcuuaggaauguucauuucagauacaccaggugaaagaaaucccuaugaaaacauauuauauaaaauaugucuaucaggggacggauggccauacauagcuucuagaacaucaauaacaggacgagcaugggaaaacacaguaguggaccucgaaagugguggcaaaccacaaaaagcaggaucaaauaacucaaauaaaaguuuacaaucagcuggcuuugccgcuggacucacuuacucacaacuaaugacacuaaaagaugccaugcuucaacuagacccaaaugcaaaaacauggauggauauugaaggaagaccagaagacccaguugaaauagcacuauaucaaccaauaucaggauguuauauacacuuuuuuagagaaccaacagaccuuaaacaauuuaaacaagacgccaaauacucacacgggauagacguaacagacuuauuugcagcccaaccaggucuaacauccgcuguuauagaagcgcuuccuagaaacaugguaauaacaugucaaggaagcgacgacauacgaaaacucuuugaaucacaaggacgcaaagacauaaaacuaauagauaucgcacuauccaaaaccgacucaagaaaauaugaaaacgcaguaugggaccaauauaaagacuuaugucacaugcauaccggcguaguuguagaaaaaaaaaaaaaaggaggaaaagaagaaauaacaccccacugugcauuaauggacugcauaauguucgacgcugcagucagcggaggacuuaacacacucguucuccgagcuguuuuaccaagagacaugguauuucgaaccagcacaccaaaaguaguauuauaa

SEQ ID NO: 2988 - RNA, 1710 nt, Artificial Sequence
  derived and/or modified CDS sequence (opt6) from Lassa virus__ANH09725__NP
augucagccagcaaagaaauaaaaucauuucuauggacacagucacuaagaagagaacuaucaggauacuguuccaacauaaaauuacaaguagucaaagaugcacaagcccuuuuacacggucuagauuucucugaagucucaaauguacaaagauuaaugcgaaaacaaagacgagacgauaacgaucuaaaaagacuuagggaccuuaaccaagcgguaaacaaccuaguagaacuaaaaucaacacaacaaaaaucagucuuaagagucggaacacuaaccucagaugauuuacuaauauuagcagcagacuuagaaaaacuaaaaucaaaaguaacacgaacagaacgaccauuaagcgcaggaguguauaugggcaaucuaucaucacaacaacuagaccaaagaagagccuuauuaaacaugaucggcaugucaggaggaaaccaaggagcacgagcuggaagagauggaguuguaagaguuugggauguuaaaaacgcagaccuacuaaauaaucaauuugguaccaugccaucacuaacacuagcuuguuuaaccaaacaaggacagguagauuuaaacgauguuguacaagcacuuacagauuuaggacuaauauauacagcaaaauacccuaauacaucugauuuagacagauuaacacagucacauccaauacuaaacaugaucgauacaaacaaauccucacucaauauaagcggcuauaauuuuagccuaggugcagcaguaaaagcaggagcaugcaugcuugaugguggaaauaugcuagaaacaauaaaagugucaccucagacaauggacggaauacuuaaaucaauacuaaaaguaaaaaaaaguuuaggaauguucauaucagauacuccaggagaaaggaacccauaugaaaauauucuauauaaaauauguuugucaggagacgguuggccauauauagcuucacgaacaucuauaacaggacgagcuugggaaaauacaguaguagaucucgaauccggaggaaaaccccaaaaagcaggaaguaacaacucaaauaaaagccuacaaagugcuggauuugcagcaggcuuaacauauucacaacuaaugacauuaaaagacgcaaugcuacaauuagaccccaaugcaaaaacauggauggacauagaaggaagacccgaagacccaguugaaauagcauuguaucagccaaucucaggcugcuacauacacuuuuucagagaaccuacagaccuaaaacaauuuaaacaagaugcaaaauacagccauggaauugacguaacagauuuauuugcagcucaacccggauuaacauccgcaguaauugaagcccuaccacguaacaugguaauaacaugucaaggaucagaugacauaaggaaauuacucgaaucacaaggacgaaaagacauaaaacuaaucgacauagcacuaucaaaaaccgauucaagaaaauacgaaaacgcaguaugggaccaauacaaagacuuaugucauaugcacaccgguguaguagucgaaaaaaaaaaaagaggaggcaaagaagaaauaaccccacacugugcacuaauggauuguauaauguuugaugcagccguaucaggaggccuuaacacacucguacuuagagcaguccuaccuagggauaugguauucaggacaucuaccccaaaaguaguacuauga

SEQ ID NO: 2989 - RNA, 1710 nt, Artificial Sequence
  derived and/or modified CDS sequence (opt6) from Lassa virus__ANH09729__NP
augagugcauccaaagaaauaaaaaguuucuuauggacacaaucauuaaggagagaacuuuccggauacuguagcaauaucaaauuacaaguaguuaaagacgcucaggcucuguuacauggauuagauuucucugaaguaagcaauguacaaagacuaaugagaaaacaaagaagggaugacucagacuuaaaacgacuacgagaucuaaaucaagcaguaaauaacuuaguagaacuaaaaucaacucaacaaaaaucaguauugagagugggcacauuaacaagcgaugaccuccuaacacuagcagcagaucuagaaaaauuaaaaucaaaaguaacgcgaacagaaagaccccuuucugcaggaguauauauggggaacuuaucaucacaacaauuagaucaaagacgagcuuuauuaaacaugaucgguaugucaggagguaaccaaggagcgagaacagguagagacggaguaguaagaguaugggauguaaaaaaugcugaccuacuuaauaaccaauucggaacaaugccaucucucacacuagcauguuuaacaaaacaagggcaagucgaucucaacgacguaguacaagcacuaacagaccuaggauuaauauacacagccaaauauccaaauacaucagauuuagaccgucucacacaaucucacccaauccuuaauaugauagauacaaauaaaaguaguuugaacaucaguggauacaauuuuagccuaggagcagcaguaaaagccggugcauguaugcuagacggcggaaauauguuagaaacuauaaaaguaucaccacaaacaauggacgggauacuaaaaucaaucuuaaaagugaaaaagagcuuaggaauguucauaagugauacaccuggcgaacgaaacccauaugaaaauauauuauacaaaauaugucuaucaggagacggauggccauauauugcaagcaggacaucaauaacaggacgagcaugggaaaauacaguaguagaccuagaaucggguggcaaaccacaacgagcaggaucaaauaauagcaauaaaucacuacaaagcgcgggauuugcagcaggccuaacauauucacaauuaaugacacuuaaagaugcuaugcuacaauuagauccaaaugcaaaaacauggauggauauagaaggacguccugaagacccaguagaaauagccuuauaucaaccaaccucaggauguuacauacacuuuuucagagaaccaacagauuuaaaacaauucaaacaagaugcaaaauauagucaugguauagacguaacagaucuauucgcagcccaacccggauuaacuucugcaguaaucgaagccuuaccccgaaacaugguaauaacuugucaagguagcgacgauauaagaaaacuauuagaaucacaaggaagaaaagauauaaaauuaauagacauagcacuaaguaaaacagacucaagaaaauacgaaaacgcuguaugggaucaauacaaagauuuaugccauaugcauacagguguaguaguagaaaaaaaaaaaaaaggaggaaaagaagaaauaacaccacacugugcccuaauggauugcauaauguuugacgcagcagugucuggaggauuaaacacccuaguuuuaagagcaguacugccaagagauaugguauuuagaacaaguacaccaaaaguaguauuauaa

SEQ ID NO: 2990 - RNA, 1710 nt, Artificial Sequence
  derived and/or modified CDS sequence (opt6) from Lassa virus__ANH09731__NP
augucugccaguaaagaaauaaaaaguuuuuuauggacacaaucccuaagaagagaauuaucaggauauugcucaaacauuaaacuccaaguuguaaaagaugcacaagcacuauuacacgguuuagauuucagcgaaguauccaauguccaaagacuaaugaggaaacaaagaagagacgacaacgauuuaaaaagacuaagagacuuaaaucaagcagucaacaacuuaguggaauuaaaaucaacacagcaaaaaucaguauuaagaguaggcacauuaacaagcgaugaccuauuaacauuagcagccgacuuagaaaaauuaaaaaguaaaguaacacgaacagaaagacccuuaucagcaggaguauacaugggaaacuuaucaucacaacaacuagaucaacgaagagcacuacuaaacaugauaggaaugacaggcgguaaucaaggagcccgaaccggacgagacggaguaguaagaguuugggauguaaaaaacgcugacuuacuaaauaaucaauucgguacaaugccaucacuuacauuagcaugcuuaacgaaacaaggucaaguugacuuaaacgacguaguucaagcauuaacagacuuaggauuaauauacacagcaaaauauccaaacaccagcgacuuagacagguuaacacaaucacacccuauacuaaacaugauugacacuaauaaaaguucucuaaacauaucaggauacaacuuuagccuaggagcagcgguaaaagccggagcauguaugcucgacgguggaaacauguuagaaacaauaaaaguaucaccacaaacaauggacggaauacuaaaaucaaucuuaaaaguuaaaaaaucacuaggaauguuuauaagcgacacaccuggagaaagaaacccauaugaaaacauccuauacaaaaucugcuuauccggcgaugguuggccauauauagcaucaagaacaagcauaaccggaagagcaugggaaaauacaguuguagacuuagaaagcgguggaaaaccucaaagagcaggaucuaacaacaguaauaaaucccuacaaucagcaggacuagcagcugguuuaaccuauucccaacucaugacauuaaaagacgcaaugcuacaauuagaccccaaugcaaaaacauggauggauauagaaggaagaccagaagaccccguugaaauagcuuuauaccaaccaacaagcgguugcuacauacacuuuuucagagaaccaacagacuuaaaacaauuuaaacaagaugcaaaauauucacauggaauagauguaaccgaccuauucgcugcacaaccaggucuaacaucagccguaauagaagcacuaccuagaaacaugguaauaacaugucaagguucagaugacauacgaaaacuauuagaaucacaaggacgaaaagacauaaaauuaauagauaucgcauuaaguaaaacagacucuaggaaauaugaaaacgcgguaugggaccaauauaaagauuuaugccacaugcacacuggaguaguaguagaaaaaaagaaaaaaggcggaaaagaagaaaucacaccacacugcgcacuaauggauugcaucauguucgacgcagcaguaucaggaggucucaacacucuaguacuaagagcaguacucccuagagacaugguauuucgaacaaguacaccaaaaguuguacuuuaa

SEQ ID NO: 2991 - RNA, 1710 nt, Artificial Sequence
  derived and/or modified CDS sequence (opt6) from Lassa virus__ANH09733__NP
augagcgcaucaaaagaaauaaaauccuuccuauggacacaaagucuccgaagagaacucucgggcuauugcucaaauauaaaacuacaaguagucaaagacgcccaagcucuauuacacggccuagauuuuuccgaaguaucaaauguccaaagauuaaugagaaaacaaagaagagacgacaaugaucuaaaaagacuccgugaucuuaaucaagcugucaauaacuuaguagaauuaaaaucaacacaacagaaaagcgucuuaagagucggaacauuaaccucugacgaucuucuaacacucgcugcagaucuagaaaaacuuaaaucuaaagucacaagaacagaacgaccuuuaagugcaggagucuacaugggaaacuuaaguucgcaacaauuagaccaaaggagagccuuacuaaauaugauagguaugucaggaggaaaccaaggagcaagaacuggaagagauggcguagucagaguuugggauguuaaaaaugcugacuuacuaaauaaccaauucggaacaaugccaagucuaacacuagcaugccucacaaaacaaggccaaguagauuuaaacgauguaguacaagcacuaacagauuuaggauuaauauacacagcaaaauauccaaauacgucagaucuugacagacuaacacaaucccauccaauacucaacaugauagauacuaauaaaucuucacuaaacauaagcggauauaauuuuucacucggagcugcaguaaaagcaggagcaugcaugcuggacggaggaaacaugcuagaaacaauaaaaguuagcccacaaacaauggaugguauauuaaaaaguauacuaaaaguaaagaaauccuuaggaauguucauaucugauacaccuggagaaagaaauccauacgaaaauauacuauacaaaauaugucuaucaggagauggauggccauauauagcuagcaggacaucaauaacagguagagcaugggaaaauacaguaguagaccuagaaucaggugggaaaccacaaagagcaggaucaaacaacucaaauaaaucacugcaaucggcaggcuuugcagcgggacuaacauauucacaacuaaugacccucaaagacgcaaugcuacaauuagauccaaacgcaaaaacauggauggauaucgaagggagaccagaagaucccguugaaauagcauucuaccaaccaauaagcgguugcuauauacacuuuuucagagaaccaacagacuuaaaacaauuuaaacaagacgcaaaauacucucaugguauagacguaaccgaucuauuugcagcacaaccaggauuaacaucagcaguaauagaggcauuaccaagaaacaugguuauaacaugucagggaucagaugauauaagaaaacuauuagaaucucagggacgcaaagacauuaaacuaauagacaucgcacuaucaaaaacagauucaagaaaauaugaaaacgcaguaugggaccaauauaaagauuuaugccauaugcacaccggaguugucguagaaaagaaaaagaaaggaggaaaagaagaaauaacaccacauugugcauuaauggacugcauaauguucgacgcggcaguauccgguggccucaacacauuaguauuacgagcaguacuaccacgagauaugguauuuagaacaucaaccccuaaaguaguauuauaa

SEQ ID NO: 2992 - RNA, 1710 nt, Artificial Sequence
  derived and/or modified CDS sequence (opt6) from Lassa virus__ANH09735__NP
augagugcaaguaaagaaguaaaaucauuucuauggacacaaucccuaaggagggaacuaagcggauacugcucuaacauaaaauuacaaguuguaaaagaugcacaagcacuacuacauggacuagauuucucagaaguaucaaacauacagcgucuuaugagaaaagaaagaagagaugauagugacuuaaaaagauugcgagacuuaaaucaagccguaaauaaucuaguagaacuuaaaagcacucaacaaaaaucaguacucagaguaggaacucucucaucagacgacuuacuuacuuuagcagccgauuuagaaaaauuaaaaagcaaagucauaagaaccgaaagaccauuaucauccggaguauauaugggaaacuuaaguacacaacaacuagaucaacgcagagcauuacuaaacaugauaggaaugacaaauggaggacaaggagcaaacgcaggaagagauggaauaguuagaguaugggacgucaaaaaugcagaauuacuaaacaaccaauucggaacaaugccaucacuuacacuagccugcuuaaccaaacaaggacaaguagauuuaaacgacgccguacaagcacuuacugacuuaggauuaaucuauacagcaaaauauccaaacucaucagaccuagauagacuaagucaaaaucacccaauauuaaacaugauagauacaaagaaaucuucauuaaauauaucuggauauaauuucucauugggagcagcaguaaaagccggagcauguauguuagacggagguaauauguuagaaacaauaaaaguaaguccacagacaauggacgguauacuaaaaucaauccuuaaaguaaaaagaagucugggaauguucguaucagacaccccuggagaaagaaauccauaugaaaacauauuauacaaaauaugucuaucuggagauggauggccguauguagcaaguagaacaucaauuauaggacgagccugggaaaauacaguuguagaucuggaaagugacagcaaaccccaaagaccaggaaguaaagaaaguaauagaucccuacaaaccgcaggauuuccagcagguuuaacauauucacaauuaaugacacuaaaagacagcaugcuacaacuagauccaaacgccaaaacauggauggauaucgaaggaagacccgaugauccuguagaaauagcauuauaccaaccaucaucaggcuguuauauacacuucuuucgagaaccaacagacuuaaaacaauuuaaacaagacgcaaaauauucacacgguauagauauaggcgaucuuuuugcagcacaaccaggauuaaccagugccguaauagaagcacuacccagaaauaugguaauaacaugucaaggaagcgaagauauuaaaagacuauuagaaucacaaggacgaaaagauauacggcuaguagacauaucacuaucuaaagcagacucaagaaaauucgaaaacgcaguaugggaucaauucaaagaccuaugcaauaugcauacagguguuguuguagaaaagaaaaagaaaggaggaaaagaagaaauaacaccacacugcgcuuuaauggacuguauuauguuugaugcagcgguuaugggaggauuagaugcaaaaguauuacgcgcaguauuaccaaaagauaugguauucagaacaucaacuccgagaguuguauuauaa

SEQ ID NO: 2993 - RNA, 1710 nt, Artificial Sequence
  derived and/or modified CDS sequence (opt6) from Lassa virus__ANH09737__NP
augagugcaaguaaagaaguaaaaucauuucuauggacucaaucauuaagaagagaacuuucaggauauugcaguaacauaaaacuacaaguagucaaagacgcacaagcucuauuacacggauuagauuucucugaaguaagcaauauacaaagauuaaugaggaaagaaagacgagaugauagugaucuaaaaagacuaagagaccuuaaucaagcaguaaauaaccuaguagaacuaaaaagcacacaacaaaaaagugucuuaagaguaggaacacuaucaagugaugaccuauuaacccuagcugcagaccuagaaaagcuaaaaucaaaaguaauacgaacugaacggccacuaagcucaggaguauacauggguaaccuaaguacacagcaacuugaucaaagaagagcguuacuuaauaugauaggcaugacaaacgggggacaaggagccaaugcaggaagagacgguauaguacgcguaugggacguaaaaaaugcggaguuacuaaacaaccaauuuggaacaaugccaucacuuacccuagcauguuuaacaaaacaaggacaaguugacuugaacgacgcaguacaagcauuaacagacuuaggccuaauauauacagcaaaauauccgaauagcagcgacuuagauagacuaucgcaaaaucacccaauauugaacaugauugauacaaaaaaaaguucucuaaacauaagcggauauaauuucagucuuggagcugcaguuaaagcaggagccugcaugcuagacggaggaaauauguuagaaacaauaaaaguaucaccucagacgauggauggaauauuaaaaucaauauuaaaaguaaaaagaagucuuggaauguuuguaucagauacuccaggggaaaggaauccuuaugaaaauauauuauacaaaauuugcuuaucaggagauggauggccuuacguagccaguagaacaucgauuauaggaagagcaugggaaaacacuguugucgaucucgaaucagacucuaaaccacaaagaccuggcucaaaagaaaguaauagaucacuacaaacagcaggauuuccagcaggcuuaacauauagucaauuaaugacauugaaagacucaauguuacaacucgaucccaaugcaaaaacauggauggauauagaaggaagaccagacgacccaguagaaaucgcauuauaucaaccaagcucaggaugcuauauacacuucuucagagaacccacugaucuaaaacaauucaaacaagacgcaaaauauagccauggaauagauaugggugaucuauuugcagcacaaccuggcuuaacaagugccgugauugaagcacuaccaaggaacauggucauaaccugucaaggaagugaagacauaaaaagacuccuagaaucucaaggaagaagagacauaagauuaguagauauaucauugaguaaagcagacucccgaaaauuugagaacgcaguaugggaccaauucaaagacuuaugcaauaugcacacgggaguaguaguagaaaaaaaaaaaaaaggaggaaaagaggaaauaacaccgcauugcgcuuuaauggauuguauaauguuugaugcagcgguaauggguggauuagaugcaaaaguacucagagcaguacuaccuaaagauaugguauuuagaacaucaacaccuagaguaguguuauaa

SEQ ID NO: 2994 - RNA, 1710 nt, Artificial Sequence
  derived and/or modified CDS sequence (opt6) from Lassa virus__ANH09739__NP
augagcgcaucaaaagaaguaaaaucauuucuauggacacaaucacuaagaagagaacuauccggauauuguuccaacauaaaauuacaaguuguaaaagacgcacaagcacucuuacauggauuagacuuuuccgaaguaagcaacauacaaagauuaaugcguaaagaaagaagagacgacuccgaucuaaaaagacuaagagaucuaaaucaagcaguaaauaaucuaguagaacugaaaagcacacaacaaaaaucuguacuaagaguaggcacccuaagcucagaugaucuacuaacacuagcagcagauuuagaaaaacuaaaaaguaaaguaauacguaccgaaagaccacuuucaucaggaguauauauggggaaccuaaguacacaacaauuagaucaaagaagggcacuauuaaacaugaucggcaugacaucaggaggucaaggggcuaaugcaggaagggauggaauaguaagaguaugggauguuaaaaacgcugagcuacuuaauaaccaauuuggaacgaugccaucauuaaccuuagcaugccuaacaaaacaaggacaaguagaucuaaaugaugcaguccaagcacuaacugaucuaggauuaauauauacagcaaaauauccaaauucaucagauuuagacagacuaucacaaaaucaccccauacuaaacaugauagacacaaagaaaaguucacuaaauauaucaggauacaauuuuagucucggagccgcgguaaaagcaggagccuguaugcuagacggagguaauaugcuagaaacaauaaaaguaucaccccaaacaauggacgguauacucaaaucuaucuuaaaaguuaaaagaaguuuaggaauguuugucucagacacaccaggagaaagaaauccauaugaaaauauauuauacaaaauaugucuaucaggagacggauggccauacguagcuagccgaacuagcauaauagggagagcaugggaaaacacaguagucgaucuggaaucagauagcaaaccucaaagaccaggaucaaaagaaucaaaccgcaguuuacaaaccgccggauuuccagcaggacucacauauucccaauuaaugacacuaaaagauaguaugcuacaauuagauccaaaugcaaaaacauggauggauauugaaggcagaccagaugacccaguagaaauagcauuauaccaaccaucaucaggauguuauauacacuuuuucagagaaccaacagauuuaaaacaauucaaacaagacgcaaaauacagccauggaauugacauaggagaucuauuugcugcccaaccuggacugacuucagcaguuauagaagcauuaccaagaaacaugguaauaaccugucagggaagcgaagauauaaaaagacuccucgaaucacaaggaagaagagauauccgacuuguagauauaagccucucaaaagcagacucaagaaaauuugaaaacgcagucugggaccaauuuaaagacuuaugcaacaugcacacaggaguaguagucgaaaagaaaaagaaaggaggaaaagaagaaauaacaccacacugcgcauuaauggauugcaucauguuugacgcagcagugauggguggauuagacgcgaaaguauuaagggcaguuuuaccaaaagacaugguuuucagaacauccacaccuagaguaguauuauaa

SEQ ID NO: 2995 - RNA, 1710 nt, Artificial Sequence
  derived and/or modified CDS sequence (opt6) from Lassa virus__ANH09741__NP
augaguaauaguaaagaaguaaaaucauuccucuggacccaaucacucagacgagaacuaucaggguauugcacuaauauuaaacuacaaguuguaaaagacgcucaggcuuuauuacacggacuagauuuuucugaaguaucaaauguacaacgcuuaaugagaaaacagaaaagagacgauaacgacuuaaaaagacuaagagaucuaaaucaagcaguaaauaauuuaguagaacuaaaaaguguacaacaaaaaucaguauuaaaaguaggaacuuuaaauagcgaugacuuauuaacucuagcagcagauuuagaaaaauuaaaaagcaaaguaguaagaaccgaaagaccacucucaucaggaguauacauggguaacuuaaguucucaacaacuagaccaaaggcgcgcacuacuaaacaugauuggaauggcaggaggaucacaaggaaaucaaccaucuagagacggaguaguacgaguaugggauguuaaaaaugcagaccuauuaaacaaucaauuuggaacaaugcccucccuaacacuagcaugcuuaacaaaacaaggacaaguagacuuaaacgacguaguauuagcguuaacagaccuaggccuuauauauacagcaaaauauccuaauaguucagaccuagacagauuaucccaaaaccacccaguucuuaauaugauagacguaaacaaaaguagucuaaauauaagcggauacaauuucagccuaggugcugcuguaaaagccggagcauguauguuagacggaggaaacauguuagaaacaauaaaaaucucaccacaaacaguagacggaauacuaaaaucaauacuaaaaguaaagagagcauuagguauguuuguaagcgacacaccaggagaaagaaauccauaugaaaacauacuauacaaagucuguuuaucaggaaauggauggccuuauauagcaucacgaacuucgaucguuggcagagcaugggaaaacacaguagucgauuuagaaagcaauaaaaaucaaccuaaaguaggaaauaacggcuccaauaaaaugcuccaaucuaguggauuugcaacaggccuuacauacagucaacucaugacacuaagggauaguaugcuacaacuagauccaacagccaaaacauggauagacauagagggcagaccagaagacccaguagaacucgcacuauuucaaccaucaucagguuguuauauacacuuuuucagagaaccgacagaucuaaaacaauuuaaacaagacgcaaaauauucacauggaauugacguaaacgaucuauuuucagcacaaccaggauugacaucagcaguacuagaggcauuaccaagaaauaugguauuaacaugucaagguagugaugacauacgaaaacuauuagauucacaagaucgaaaagauauaaaauuaauagacaucucuuuaucaaaagcugaugcaaggaaauuugaaaacgacguaugggaccaauuuaaagacuuaugccauaugcacacaggaauaguaguagagaaaaagaagaaaggcgguaaacaagaaaugaccccacacugugcacuacuagauugcauuauguucgaugcagcagucucaggcggauuaaacguaccaacucuaagagcaguauuaccaacagauaugguuuucagaacaauaaccaccaaaguuguuuuauaa

SEQ ID NO: 2996 - RNA, 1713 nt, Artificial Sequence
  derived and/or modified CDS sequence (opt6) from Lassa virus__CAA36646__NP
auguccgcaagcaaagaagugagaucuuuccuauggacucaaucauuaagacgcgaacuuucagguuauugcagcaacauuaaauugcaaguaguaaaagacgcacaagcacucuugcacggguuagacuuuagugaaguuagcaacguucaaagauuaaugagaaaacaaaaaagagaugauggagaucuaaaaagauugagagaucuaaaucaagcaguaaacaacuuaguagaacuuaaauccacacaacaaaaaucaguacuaagaguaggaacacuaucaagugaugauuuacuuauauuagcagcagaucuagaaaaacuaaaaucaaaaguuacaagaacagaacgaccacuuucuagcgguguauauaugggaaauuuauccucacaacaacuagaucaaagaagagcauuauuaaacaugauagguaugacaggaguaaguggaggaggaaaaggcgcaucagacggaauaguacgaguaugggauguaaaaaaugcagaauuacucaauaaccaguuuggcacaaugccaucacuaacauuagccugcuuaacaaaacaaggacaaguagacuugaaugacgccguacaagcacuaacggaccuggguuugauauauacagcaaaauauccaaauucaucggacuuagauagacuaucucaaagucacccuauauuaaauaugauugauaccaaaaaaucuagccugaauauuucaggauacaauuucucauuaggcgcagcaguaaaagcaggagcauguauguuagacggaggaaauauguuagaaacaauaaaaguaaguccacaaacaauggauggaauauuaaaaaguauacuaaaaguaaaaaaaagucuaggaauguucguaagcgauacaccuggagaaagaaaucccuaugaaaauauauuauacaaaauaugucuaucaggugauggauggccauacauagcgagcagaacuucaauaguaggaagagcaugggaaaacacaguaguagaucucgaacaagauaacaaaccacaaaaaauuggaaauggaggguccaauaaaagccuacaaagcgcagguuuugcagcaggacuaacauauucccagcuaaugacacuuaaagauuucaaaugcuucaacuugaucccaaaugcaaaaacauggauggacauagaaggaagaccagaagacccaguagaaauugcccuauaccaaccuucaucaggaugcuacguacacuucuucagggaaccaacagacuuaaaacaauucaaacaggaugccaaauauucacacggaauugauguaacagaccuauuugcugcacaaccuggacuaacaagcgcagucauugaagcgcuaccaagaaauaugguaauaacaugccaaggcagugaagauauaaggaaauuacucgaaagccaaggaaggcgcgacaucaaacuaauugauauaacccugucaaaagcagacagucgaaaauuugaaaaugcaguaugggaucaauuuaaagauuuaugucacaugcacaccggaguggucguagaaaagaaaaagcgaggaggaaaagaagaaauaacaccucauugugcauuaauggacuguauaauguucgaugcagcaguaaguggaggauuagaugcaaaagucuuaagaguaguuuuaccaagagauaugguauuuagaacguccacaccaaaaguaguacucuaa

SEQ ID NO: 2997 - RNA, 1710 nt, Artificial Sequence
  derived and/or modified CDS sequence (opt6) from Lassa virus__CCA30315__NP
augucagcaagcaaagaaguaaaaucauuucuauggacccaaucacuaagaagagaacuaucuggauauuguucaaacauaaaacuucaaguaguaaaagacgcucaagcacuacuucauggauuagauuuuagugaaguaucaaacguacaaagacuaaugagaaaacaaagaagagacgauuccgauuuaaaaagauuaagagauuuaaaccaagcgguaaauaaccuuguagaauuaaaaaguacacaacaaaaaucagucuuacgaguuggaacacuaaguagugaugacuuacuuacacuagcggcagaucuagagaaacuaaaaucuaaaguaacuagaacagaaagaccuuuaaguucaggggucuacaugggaaaucuuucaagccaacaauuagaucaacgucgcgcuuuacuaaaucuaauagguaugacaaacggaucacaaggaagucaagcuggaagggauggcguaguuagaguaugggauguaaaaaacgcagaauuauuaaauaaucaauuugggacaaugcccucauuaacacuagcuugucuaacaaaacaagggcaagucgacuuaaaugauguaguacaagcacucacagacuuaggauuaauauauacagcaaaguauccuaauacaagugaccuagacagacucacacaaucacauccaaucuuaaacaugauagauacuaaaaaaucaagcuuaaacauaagugguuauaauuucucccugggugcagcaguuaaagcaggagccuguauguuagauggaggaaauauguuagaaacgauaaaaguaagcccacaaaguauggacggaauacuuaaaagcauacuaaaaguuaaaagagcauuaggaauguucguaagcgauacaccaggagaaagaaacccauaugaaaacauauuauacaaaauaugccuaucaggagauggauggccauauauagcaagcagaacuaguauaguaggaagagcaugggaaaacaccguaguagaucuagaaacagaugguaaaccacaaaaaauaggaucaggaaacucaaauaaaucguuacaaucagcaggauuuuccgcaggcuuaacauauagucaacuaaugacauuaaaagaugcaaugcuacaacuagacccaaaugccaaaacauggauggacauagaaggaagaccagaagacccggucgaaguagcacuguaucaaccuaucucaggauguuacauacacuuuuucagagaaccaacagaucucaaacaauucaaacaagacgcaaaauauagccacggaauagauauagcagaccuuuucgcagcacaacccggacuaacaucagcaguaauagaagcauuaccaagaaacaugguaauaacaugccaaggaagugaagauaucaaaaaauuacuagaaucgcaaggcagaaaggauauaaaacucauagacauagcacuaucaaaaauugacucacgaaaauuugaaaacgcagugugggaucaauauaaagaccuaugccauaugcauaccggaguaguaguagaaaaaaaaaaaagaggaggaaaagaagaaaucacaccacacugcgcauuaauggauugcauuauguuugaugcagcagucucuggaggauuaaauacauuaguacuuagggccguauuaccuagagauaugguauucagaacaucaaccccaagagucguacuuuag

SEQ ID NO: 2998 - RNA, 1710 nt, Artificial Sequence
  derived and/or modified CDS sequence (opt6) from Lassa virus__JX985061__NP
augagugcaagcaaagaaauaaaaucauucuuauggacacaaucacuaagaagagaacuaucaggcuauuguucaaauauaaaauuacaaguaguuaaagaugcacaagcacuacuucacggacuagauuucucagaaguaagcaauguacagcgacucaugagaaaagaaagaagagaugacaaugaucuaaaacgacuacgagauuuaaaccaagcaguaaacaacuuaguagaauuaaaaucuacccaacaaaaaucuauucuaagaguuggaacauuaacaucagacgaucuccuuauuuuagcagccgaucuagaaaaauuaagaaguaaaguaauaagaacagaaagaccuuuaagcgcgggaguuuauaugggaaacuuaaguucucaacaacucgaucaacguagagcacuacuaaacaugauaggaaugucaggagguaaccaaggugcaagagcuggaagagauggugucguaagagugugggauguaaaaaacgcagaacuucuaucaaaucaauuuggaacaauacccucuuuaacucucgcauguuuaaccaaacaaggacaaguagaucuuaaugaugccguacaagcuuuaacagaccuaggacuaauauacacagcuaaguacccaaauaccucagaccuugacagauuaacacaaucacauccaaucuuaaauaugauagacacaaaaaaaucaucauuaaauauaucaggauauaauuucaguuuaggagcugcagucaaagccggagcaugcaugcuagaugguggaaauauguuagaaacaauaaaaguaagcccccaaacaauggauggaauauuaaaaucaauacuaaaaguuaaaaaagcacuuggaauguuuauaagugauacuccaggagaaagaaauccuuacgagaauauacuauauaaaauaugucuaucaggcgauggauggccguauauagcaagccgaacaucaaucacuggaagagcaugggaaaauacaguuguagaucuagaaagugauggaaaaccccaaaaagcagacucaaacaacagcucaaaaucucuacaaagcgcuggauuuacagcuggauuaacuuauucucaacuaaugacccuaaaagaugcaauguuacaacucgauccuaaugccaaaacauggauggacauagaaggacgacccgaagaccccguugaaauagccuuauaccaaccaucaucuggaugcuacauacauuuuuucagagaaccaacagaccuaaaacaguucaaacaagacgcuaaauacucacacggaauagauguuacugaccuauucgccacacagccuggauuaacaucugcaguaauagacgccuuaccaagaaacaugguaauaacaugucaaggaucagacgacauaagaaaauuauuagaaucacaaggaagaaaagacauaaaauuaaucgacauugacuuaucaaaaacagacagcagaaaauacgagaacgcuguaugggaucaauauaaagacuuaugccauaugcacacaggaguaguuguagaaaaaaaaaaacgaggcggaaaagaagaaauaaccccacacugugcucucauggauugcauaauguucgaugcagcaguaucaggaggcuuaaauacaucagugcuaagagccguccuaccacgagacaugguauucagaacaucaaccccccgaguagugcucuaa

SEQ ID NO: 2999 - RNA, 1710 nt, Artificial Sequence
  derived and/or modified CDS sequence (opt6) from Lassa virus__NP_694869__NP
augagugcaucaaaagaaauaaaaucauuccuauggacacaaagccuaagaagggaacuaucaggcuauugcucaaacauaaaauuacaaguagucaaagacgcacaagcucucuuacacggucuagauuuuagugaaguaucaaacguucaaagauuaaugagaaaagagagacgagaugauaacgaccuaaaaagacuaagagaucuaaaucaagcaguaaacaaccuuguagaacuaaaaagcacacaacaaaaauccauccuacguguaggaacauuaacuagugaugacuuauuaauccuagcagcagaucuagaaaaacuuaaaagcaaagucauaagaacugaacgaccgcucagugcagguguauauaugggaaaucucucgucgcaacaauuagaucaaagaagagcacuacuuaauaugauaggaaugucaggaggaaaucaaggugcacgcgcaggaagagacggaguagugagaguaugggacguaaaaaacgcagaauuauuaaauaaccaauuuggaacaaugccauccuuaacuuuagccugucuaaccaaacaaggacaaguagaccuaaaugacgcaguacaagcacuaacugacuuaggacuuauauauacagccaaauauccaaauacaucagauuuagacagacucacacaaucacaccccauacuaaacaugauagacacaaaaaaaagcaguuuaaauauaucagguuacaauuuuucacuuggagcagcgguaaaagcaggcgccuguauguuagacggcgguaacauguuagaaacaauaaagguaagcccucaaacaauggauggaauacuaaaaaguauauuaaaaguaaaaaaagcacuaggaauguuuauaagugauaccccaggagaaagaaacccauacgaaaauauauuauacaaaauauguuuaaguggagauggauggccauauauagcauccagaaccagcauaacaggaagagcaugggaaaauaccguaguagaucuagaaucagauggaaaaccacaaaaagcagauucaaacaauaguaguaaaagccuccaaucagcagguuuuacagcaggacuaacauauagucaacuaaugacacuuaaagaugcaaugcuacaacuagauccaaaugcaaaaacauggauggauauagaaggacgaccagaagacccgguagaaauagcacuauaucaacccaguagcggaugcuacauucauuuuuuuagagaaccaacagaucuaaaacaauucaaacaagaugcaaaauauagucacggcauugacguaacagauuuauuugcaacacaaccaggauuaacuagugccgucauagaugcauuaccaagaaacaugguaauaacaugccaaggaagcgaugacauuagaaaacuacuagaaagucaaggaagaaaagacaucaaacugauagauaucgcguuaucaaaaacggacucacgaaaauaugaaaaugcaguuugggaccaauauaaagauuuaugccacaugcauacaggaguaguuguagaaaaaaaaaagagaggaggaaaagaagaaauaacaccacauugcgcauuaauggauugcauaauguuugaugccgcaguaagcggcggacuaaauacuucaguacuacgagcaguacuaccaagagauaugguauuucgaaccucuaccccaaggguaguauuauaa

SEQ ID NO: 3000 - RNA, 1710 nt, Artificial Sequence
  derived and/or modified CDS sequence (opt6) from Lassa virus__SCA79106__NP
augagcaauucaaaagaaguaaaaucauuucuauggacacaaagucuacggagagaauuaaguggauauugcucaaauauaaaacuacaagucguaaaagacgcucaagcauuacuccacggacucgauuucucagaaguauccaauguucaaagacuaaugagaaaacaaaaacgagaugacggagacuuaaaaagauuaagagauuuaaaccaagccguaaacaacuuaguagaacuuaaaaguguacaacaaaaaucaauauuaagagucggaacacuaacgagugacgaccuauuaacuuuagcagcugacuuagaaaaauuaaaaaguaaaguaacacguacagaaagaccacuaaguagcgguguauauaugggaaacuuaucaucacaacaacuagaccaaagacgagcauuauuaucaaugauaggaaugagcggagguaaccaaaacagccaaccaaaaggagacggagucguaagaguaugggaugucaaaaacgcagacuuauuaaauaaucaauuugggacaaugccaucacucacacuagcaugucuuacaaaacaaggacaaguagaccuaaacgaugcaguacaagcacucacagaucuaggucuaauauauacagcuaaauauccuaauucaucugacuuagauagauuaucacaaagccacccuauacuaaacaugauagauacaaagaaaaguucucuaaacauaucaggauauaauuuuucauuaggcgcagccauaaaaacaggagcguguaugcucgacggaggaaauaugcuagaaacaauaaaaguaaccccucaaacaauggacggaauauuaaaaucaauacuaaaaguaaaaagaagccuagguauguucauaucggacacaccaggagaaaggaacccauaugaaaacauauuauacaaaaucuguuuaagcggagauggauggccauacauagcaucaagaacagcaaucauaggaagggcuugggaaaauacaguaguagauuuagaaucagauucgaaaccacaaaagauuggaucuaauggaucaaauaaaucauugcaaagcgcaggauuugcaccaggucuaacauauagucaauuaaugaccuuaaaagauucaaugcuacaacuggacccaaacgcaaaaacauggaucgacauagaaggaagaccagaagauccaguagaaguagcauuauuucaaccaauaagcggaugcuauauucauuucuuuagagaaccgaccgacuuaaaacaauucaaacaagacgccaaauauucacacggaauagauguaacagaucuguuugcagcacaaccaggccuaacaucagcaguaaucgaggcacucccaagaaacaugguauuaacaugucaagguucugaugauauaaagaaauuauuagacucacaagggagaagagacaucaaauuaaucgauguaucacuuaacaaaaucgauagccgaaaauucgaaaacgccguuugggaccaauauaaagacuugugccauaugcauaccggaguaguuguagaaaagaagaagaaaggaggaaaagaagaaaucacaccacauugcgcuuuacuagauugcauaauguuugaugcagcaguaucaggaggauuaaacgcaacaguauuaagagcugucuuaccaagagacaugguauuuagaacaagcaguccaaaaguaguacuauaa

SEQ ID NO: 3001 - RNA, 1473 nt, Artificial Sequence
  derived and/or modified CDS sequence (opt11) from Lassa virus__AAF86703__GPC
augggacaaauaaucaccuucuuccaagaagucccacacgucaucgaagaagucaugaacaucguucucaucgcccucucacuccucgcaauccucaaaggcauauacaacgucgcuaccugcggacuauucggacugaucuccuuccuccuccuaugcggccgaucaugcuccguuaccuacaaaggcgucuacgaacuccaaacccuugaacugaacauggccaaucuaaauaugacaaugccccucuccuguacuaaaaacaacucccaccauuacaucauggucggcaacgaaaccggacuagaacucacccuaaccaauaccuccauaaucaaccacaaguucuguaaccucucagacgcccacaagaaaaaccucuaugaccaugcccuuaugucgauaaucuccaccuuccaucucuccauccccaauuucaaccaauacgaagccaugucaugcgacuucaacggcggcaaaaucuccguccaguacaaccucucacacuccuucgccgucgacgcugcaaaccacugcggaaccaucgcuaauggaguccuacaaacuuucaugagaauggcauggggcggcuccuacaucgcccucgacagcggcaaaggcaacugggacugcauuaugaccuccuaccaauaccucaucauacaaaacaccacaugggaagaucacugccaauucucacgcccaagccccaucggcuaccuaggacuacucagucaaagaacccgugacauauacaucuccagacgccuacucggcaccuucacuuggacccucucugacuccgagggcaacgaagcacccggaggcuacugccucaccagauggaugcucauagaagccgaacuaaaaugcuucggcaacaccgccgucgccaaaugcaacgaaaaacacgacgaagaguucugcgauaugcuacgccucuucgacuucaacaaacaagccauaaaacgccucaaaaccgaagcccaaauguccauccaacucaucaacaaagcaguaaacgcacucaucaacgaccaacucaucaugaaaaaccaucucagagacaucaugggaaucccauacugcaacuacucacgauacugguaccucaaccacaccgucaccggcaagaccucacuuccucgcugcuggcucgucucaaacggauccuaccucaacgaaacccacuucuccgacgacaucgaacaacaagcugacaacaugaucaccgaaaugcuccaaaaagaauacauggaccgacaaggaaaaacuccgcucggccuagucgaccuauucguauucuccaccuccuuuuaccuaaucuccaucuuccuccaccucgucaaaauaccaacccaucgccacauagucggcaaacccugccccaagccccacagacucaaccacaugggcaucugcuccugcggccucuacaagcaccccggcguccccgucaaauggaaacgcuaa

SEQ ID NO: 3002 - RNA, 1476 nt, Artificial Sequence
  derived and/or modified CDS sequence (opt11) from Lassa virus__AAG41802__GPC
augggccagaucguuacauucuuccaggaggucccccacgugaucgaggagguuaugaacaucguccugaucgcccucagcauccuggcagugcuaaaggggcucuacaacaucgcgaccugcggccugaucgggcugaucacguuccuccugcugugcggccgcuccugcagcuccaaccucuacaaggggguguacgagcugcagagccuggaccucaacauggagacccugaacaugaccaugccucuguccugcaccaagaacaacagccaccacuacauccgcgucggcaacgacacgggccucgagcugacccugaccaacaccuccauccucaaccacaaguucugcaaccugagcgacgcccacaagaaggaccuguacgaccacgcccucauguccaucaucagcacguuccaccuguccauccccaacuucaaccaguacgaggcuaugaguugcgacuucaacgggggcaaaaucuccgugcaguacaaccugagccacuccuacgccaucgacgcggccaaccacugcgggaccguggccaacggcauccuccagaccuucaugcgcauggccuggggcgggagcuacaucgcguuggacuccggccgggggaacugggacugcaucaugaccagcuaccaguaccugaucauccagaacacgaccugggagaaccacugucaguucucccgcccuagccccaucggcuaucucgggcuccuuagccagcggacccgcgacaucuacaucucccggcgccuccucggcaccuucacguggacccugagcgacuccgaggguaacgccacccccggcggcuacugccucacucgguggaugcugaucgaggccgagcuuaagugcuucgggaacacggccgucgccaagugcaacgagaagcacgaugaggaguucugcgacaugcuccgccuguucgacuucaacaagcaggcgaucagccggcugaaguccgaggcccagaugagcauccagcucaucaacaaggccgugaacgcccugaucaacgaccagcugaucaugaagaaccaccuccgcgacaucaugggcauccccuacugcaacuacuccaaguacugguaccugaaccacaccauuaccggaaaaaccagccugcccaagugcuggcuuguguccaacggcagcuaccugaacgagacccacuucuccgacgacaucgagcaacaggccgacaacaugaucaccgagaugcugcagaaggaguauauggagcggcagggcaagaccccgcucgggcuggucgaccuguucguguucagcaccuccuucuaccugaucagcaucuuccuccgccuggugaagaucccgacgcaccggcacaucgucggcaagcccugccccaagccccaccgccugaaccacauggggaucugcuccugcggccucuacaagcagccgggggugcccgugcgguggaagcgcuga

SEQ ID NO: 3003 - RNA, 1473 nt, Artificial Sequence
  derived and/or modified CDS sequence (opt11) from Lassa virus__AAL13212__GPC
augggccagaucgucaccuucuuccaagaaguaccccacguuaucgaagaaaucaugaacaucguacucaucacccucucacuccucgccauacucaaaggcgucuauaaccucgcaaccugcggccucaucggacuaauaaccuuccuauuccugugcggccgaaguugcuccaugacauacaaaggcuccuaccaacucgaaacccucgaacucaacauggaaacccucaacaugaccaugccgcucuccugcacuaaaaacaccucccaucacuacauccgagucgguaacgaaacaggccucgaacuaacccucaccaacaccuccauaaucaaccacaaauucugcaaccuauccgacgcccacaagaaaaaccucuacgaccauucacuaauguccaucaucuccaccuuccaccucuccauacccaacuucaaccaauacgaagccauguccugcgacuucaacggcggaaaaauauccauacaauacaaccuaucgcacacguacgccggagacgccgccaaacacugcggaacccuggccaacggcauacuccaaacauuuaugcgcauggccuggggcggaucauacaucgcccuggacuccggccgcggaaacugggacuguaucaugaccagcuaccaauaccucaucauccagaacacaaccugggaagaccauugccaauucucccgccccucccccaucgguuaccucggacuacuaucccaacguacccgcgaaaucuacaucucccgaagacuccucggaaccuucacauggacccucuccgacuccgaaggcaaugaaaaccccggcggcuacugccucacccgauggaugcuaauagaggccgagcucaaaugcuucggcaauaccgccguagccaaaugcaacgaaaaacacgacgaagaguucugcgacaugcuacgacucuucgacuucaacaaacaagccauccaacgccuuaaagcugaagcacaaaugucaauccaacucaucaacaaagcugucaacgcacuaauaaacgaccaacucaucaugaaaaaccaccucagagacauaaugggcauccccuacugcaacuacucaaaauacugguaccuaaaccacacaaccaccggccguacaucccuuccccgaugcuggcucgucucaaacggcuccuaccucaacgaaacccgguucucagacgacaucgaacaacaagcagacaacaugaucaccgagaugcuacaaaaagaauacaucgaccgccaaggcaaaacaccccugggccuagucgaccuauucgucuucuccaccucauucuaccucaucuccaucuuccuacaccucauaaaaauccccacccaccgacacauaguaggcggaccaugccccaagccacaccgccucaaccacaaaggcauaugcuccugcggccuauacaaacgacccggcguauccguacgcuggaaacgauga

SEQ ID NO: 3004 - RNA, 1476 nt, Artificial Sequence
  derived and/or modified CDS sequence (opt11) from Lassa virus__AAO59512__GPC
augggccagaucgucaccuuuuuccaggaaguaccucacgucaucgaagaaguaaugaacaucguacucaucgcacuauccauccucgccguccucaaaggacuauacaauuucgcaaccugcggccucgucggccucgucgccuuccuccucuuaugcggccgcuccugcaccuccucccucuacaaaggcgucuacgaacuccaaacacucgaacuaaacauggaaacccucaacaugacaaugccccucuccugcaccaaaaacaacucccaccacuacauacgcgucggcaacgaaacaggucucgaacugacccucaccaacacaucgauaaucaaccacaaauucugcaaccucuccgacgcccauaagaaaaaccucuaugaccacgcccucauguccaucaucagcaccuuucaccucuccauccccaacuucaaccaauacgaagccaugucaugcgacuucaacggcgggaaaauaucaguccaauacaaucucucacacuccuacgccgucgacgccgcaaaacacugcggaaccgucgccaacggcguccuacaaaccuucaugcgcauggccugggguggcucauacaucgcccuagacucaggacacggccgcugggacugcaucaugacaucuuaucaauaccucaucauccaaaacacaaccugggaagaccacugucaauucucccgacccagccccaucggguaccuaggccuccucucccaacgcacccgagauaucuacauaucccgucgccuccucggcacuuucaccuggacgcugucagacuccgaaggcaaagacacccccggcggcuacugucucaccagauggaugcucaucgaagccgaacucaaaugcuucggcaacacagccguagccaaaugcaacgaaaagcaugacgaagaguucugcgauaugcucagacucuucgacuuuaacaaacaagccauacaacgacucaaaaccgaagcccaaauguccauccagcucaucaacaaagcagucaacgcccuaaucaaugaccaacucaucaugaagaaccaccuccgcgacaucaugggcauccccuacugcaacuacucucgcuacugguaccucaaccacacaaccaccggcaagaccucccuccccaaaugcuggcucguguccaacggcuccuaccugaacgaaacacgcuucuccgacgacauagaacaacaagccgacaacaugaucaccgaaaugcuacaaaaagaauacauggaacgucaaggcaaaacacccuuagggcucgucgaccucuuugucuucuccacuuccuucuaccuaauuuccaucuuccuccaccucgucaaaauccccacacaccgccacaucgucggaaaaucaugccccaagccccaccgacucaaccacaugggaaucugcagcuguggccucuacaaacagcccggcguacccguaaaguggaaaagauag

SEQ ID NO: 3005 - RNA, 1476 nt, Artificial Sequence
  derived and/or modified CDS sequence (opt11) from Lassa virus__AAT49000__GPC
augggccaaauagucaccuucuuccaagaagucccgcacgucaucgaagaaguaaugaacaucguccucaucgcccuauccauccucgcaguucucaaaggccucuacaacguagcaaccugcggccucaucggccucgucaccuuccucuuccucugcggccgguccugcuccacaucccucuauaaaggagucuacgaacuccaaacccuagaacucaacauggaaacccuuaacaugacaaugccacucucaugcaccaaaaacaacucccaccacuacaucauggucggaaacgaaacuggacuagaacucacacucaccaacacauccaucaucaaccacaaauuuugcaaccuauccgacgcccacaaaaagaaccucuacgaccacacccuaaugagcauaaucucaaccuuccaccuaucaauaccaaacuucaaccaauacgaagccauguccugcgacuucaauggcggcaaaaucagcguacaauacaaccuaagccacuccuacgccgucgacgccgccaaccacugcggaaccgucgccaacggcguucuccaaaccuucaugcguauggccuggggcggcucauauaucgcccucgacucgggccgcggcaacugggacugcauaaugaccucauaccaauaccuggucauccaaaacacuacaugggaagaccacugccaauucucccgccccucacccauaggcuaccucggacugcucucccaacgaacgcgcgauauuuacauaagccggcgccuucucggcacuuucaccuggacccuaucagacuccgaaggcaaagacacccccggcggcuacugccuaacacgcuggaugcucaucgaagccgaauuaaaaugcuucggcaacacggccguugccaaaugcaacgaaaagcacgacgaagaguucugcgacaugcucagacuauucgacuucaacaaacaggcaauacaacgccuaaaagccgaggcccaaauguccauacaacucaucaacaaagccguaaacgcccucaucaacgaccaacuaaucaugaaaaaccaccuccgcgacaucaugggaaucccauacuguaacuauuccaaauacugguaccugaaccacaccguaacaggcaaaacaucccugcccaagugcuggcuagucuccaacggcuccuaccucaacgaaacccacuucuccgacgacaucgaacaacaagcagacaaccucaucaccgaaaugcuccaaaaagaauacauggaacgccaaggaaaaacuccccucggacucguagaccucuucgucuucagcaccagcuucuaccucaucuccaucuuccuccacuuagucaaaauacccacacacagacacauagucggaaaacccugcccaaagccacaccgccucaaccacaugggaaucugcucaugcggcgucuacaaacaaccaggcguccccguacgguggaaaagauag

SEQ ID NO: 3006 - RNA, 1476 nt, Artificial Sequence
  derived and/or modified CDS sequence (opt11) from Lassa virus__AAT49004__GPC
augggccaaauagucacauucuuccaagaagucccgcacguaaucgaagaggucaugaacaucguccuaaucgcccucucaguccucgcaguccucaaaggccucuacaacuuugcaaccugcggccuaguaggccuugucacauuccuccuacugugcggucgcuccugcacaaccagcuuauacaaaggugucuacgaacuccaaacccucgaacucaacauggaaacccucaacaugaccaugccccuauccuguaccaaaaauaacucccaucacuacauuaugguaggcaacgaaaccggccucgaacuuacacucacuaacaccuccauaaucaaccacaaauucugcaaccucuccgacgcccacaagaaaaaccuuuacgaccacgcccuaaugucuaucaucuccaccuuccaccucuccauccccaacuucaaccaauacgaagcaaugucaugcgacuuuaauggcggaaaaaucuccguccaauacaaccucucccacagcuacgcaggcgacgcugccaaccacugcggcacugucgccaacggcguacuacagaccuucaugcgcauggcauggggcggaucauauaucgcccuagacucaggcagaggcaauugggacugcaucaugaccucuuaccaauaccucaucauccaaaauaccacaugggaggaccacugccaauucucccgcccaucucccaucggcuaccucggccuccuuucucaacguaccagagacaucuacaucucccgacgucuccuuggcaccuucaccuggacacucagcgacuccgaaggcaaagacacccccggcggcuacugccucacucguuggaugcuaaucgaggccgaacucaaaugcuucgguaacacagccgucgccaaaugcaacgaaaagcacgacgaagaguucugcgacaugcuccgacucuucgacuucaauaaacaagccauccaaagacucaaagccgaagcgcaaauguccauucaacuaaucaacaaagccguaaacgcccucaucaacgaccaacuaaucaugaaaaaucaccuaagagacaucaugggcauacccuacugcaacuacuccaaauacugguaccuaaaucacaccaccaccggccggaccucccuccccaaaugcuggcuagucuccaacggcucauaccuaaacgaaacacacuucuccgacgacaucgaacaacaagccgacaacaugauaacagaaaugcuccagaaagaauacauggagcgccaaggaaaaaccccgcuuggccucgucgaccucuucguguucuccaccuccuuuuaucucaucuccaucuuccuacaccuugucaaaauccccacacaccgacacaucgucggcaagucgugccccaaaccccaccgucucaaccacaugggcauuugcucaugcggccuauacaaacaaccgggcguccccgucaaauggaaacgcuag

SEQ ID NO: 3007 - RNA, 1476 nt, Artificial Sequence
  derived and/or modified CDS sequence (opt11) from Lassa virus__AAT49008__GPC
augggacaaaucgucacauucuuccaagagguaccccaugucaucgaagaagucaugaauaucguucucauagcccuauccauccuugcaguccucaaaggccucuacaacgucgccaccuguggucucaucggccucguuaccuuccuauuccuaugcggccgcuccugcucaaccacccuauacaaaggcgucuacgaacuucagacacuagaacuaaacauggaaacccucaacaugacaaugccccucuccugcaccaaaaacaacucacaccacuacaucauggucggaaacgaaacuggccuugaacuaacccuaacuaacaccucaaucaucaaccauaaauucugcaaccucuccgacgcccacaaaaaaaaccuauacgaccacacucuuauguccauaaucuccaccuuccaccucuccauccccaacuucaaccaauacgaagcuauguccugcgacuucaacggcggcaaaauauccguccaguacaaccucucccacuccuacgcagucgacgcagccaaccacugcggcaccguagccaacgguguacuacaaaccuucaugcgcauggccuggggaggaucauacaucgcacucgauuccggccgcggcaacugggacugcaucaugacaagcuaccaauaccugaucauacagaacaccacuugggaagaccacugccaauucagcagaccauccccaaucggcuaccucggucuacuuagccaacgaacucgagacaucuacaucagccgccgccuacucgguacauuuaccuggacccucuccgacucagaaggcaaagacacccccggcggcuacugccucacacgguggaugcucauagaagcugaacucaaaugcuucggcaacacagcggucgccaaaugcaacgaaaaacacgacgaagaauuuugcgacaugcuacgacuuuucgacuucaauaaacaagccauccaacgccucaaagccgaagcccaaaugagcauacaacucaucaacaaagccguuaacgcucuaaucaacgaccaacuuaucaugaaaaaccaccuccgagacaucaugggcauucccuacugcaacuacucacgcuacugguaucucaaccacaccgucacugguaaaaccucccucccuaaaugcuggcuaguguccaacggcuccuaccucaacgagacccacuucucagacgacauagaacaacaggccgacaaucugaucaccgaaaugcuccaaaaagaauacauggagagacaaggcaaaacaccccucgggcuagucgaccuuuucguguucuccacguccuucuaccucauaucaauauuccuacaccucguaaaaaucccaacccaccgacacaucgucggaaaaccuugcccaaaaccgcaccgccuaaaccacaugggaaucugcuccugcggcguauacaaacaacccggcguaccaguccgauggaaacgcuaa

SEQ ID NO: 3008 - RNA, 1473 nt, Artificial Sequence
  derived and/or modified CDS sequence (opt11) from Lassa virus__AAT49010__GPC
augggccaaauagucacauucuuccaagaaguaccccacgucaucgaagaaguaaugaacaucguacucauagcucucagcguccuugcuauccuaaaaggccucuacaacuucgcuacaugcggacuaaucggccuugucacauuccuccuacucucaggccguagcugcucaaugauauacaaaggcgucuacgaacuccaaacccuagaacuuaacauggaaacucucaacaugaccaugccccucucaugcaccaaaaacacaucccaccacuacauccgagucggcaacgacaccggacuggagcuaacccucaccaacgaaacccuccuacaccauaaauucugcaaccucuccgacgcacacaaacgcaaccucuacgaccacgcccucaugucaaucaucuccaccuuccaccuguccauccccaacuucaaccaauacgaagccaugucuugcgacuucaacgguggaaaaaucaccguccaauacaaccucucgcacuccuacgccgucgacgcugccaaacacugcggcaccguagccaacggaguccuccaaaccuucaugcgcauggcauggggcggcagcuacaucgcccucgacucccgccacggcaacugggacugcaucaugacauccuaccaauaccucaucauccaaaacaccaccugggaagaccacugccaauucagccgcccaucccccauaggcuaccuuggccuccuaucacaacgcacccgcgacauauacaucucccgacgccuacucggcacauucaccuggacacucuccgacuccgaaggaaacgaaacccccggaggcuacugccuaacacgauggaugcucaucgaagccgagcucaaaugcuucggcaauaccgcuguagccaaauguaacgaaaaacacgacgaagaguucugcgacaugcuacgacuauucgacuucaacaaacaagcaauaagacgacucaaaaccgaagcacaaauguccauccaacucaucaacaaagcugucaacgcacuuaucaacgaccagcuaauaaugaagaaccaccuccgggacaucaugggcaucccauacugcaacuauagcaaauacugguaccucaaccacaccuccaccggaaaaaccucccucccccgaugcuggcucguauccaacgggucauaucucaaugaaacccacuucagcgacgacauagaacaacaagcagacaacaugaucaccgaaaugcuacaaaaagaauaccuagacagacaaggcaaaaccccacuaggccucguagaccuauucgucuucucaaccucauucuaccucauaucaaucuuccuacaccucauuaaaauuccaacccaccgacacaucguaggcaaaccaugccccaaaccacaccgccuuaaucacaugggaaucugcuccugcggccucuacaagcaaccaggcgucccaguacgcuggaaacgauag

SEQ ID NO: 3009 - RNA, 1473 nt, Artificial Sequence
  derived and/or modified CDS sequence (opt11) from Lassa virus__AAT49014__GPC
augggccaaauaaucaccuuuuuccaagaagucccccacguuaucgaagaagucaugaacauaguacucaucgcccuaucccuccucgccauccuaaaaggccucuauaauaucgcaaccugcggaaucauagggcucgucgccuuccucuuccuaugcggcaaaucaugcucccucacccucaaaggcggauacgaacuccagacccucgagcucaacauggaaacucuuaacaugaccaugccccuauccugcaccaaaaacagcucccaccacuacauccgggucggcaacgagacaggacuagaacucacccucaccaacacauccaucaucaaccacaaguucugcaaccuauccgacgcccacaagaaaaaucucuacgaccacgcccucaugucaauaaucucaaccuuccaccucucaauccccaacuucaaccaauaugaagcaaugucaugcgauuucaacggcggaaaaauauccguacaauacaacuuaagccacagcuacgccggugacgccgcugaacacugcggcaccgucgcaaacggcguacuacaaaccuuuaugcgcauggccuggggaggccgauacaucgcccucgacuccggaaaaggcaacugggacugcaucaugaccucauaccaauaccuuaucauacaaaacaccaccugggaagaccacugccaauucucccgccccucccccaucggcuaccucggccuacuaucccaacgcacccgugacauauacaucucccgccgccuccucggaaccuucacauggacacuauccgacuccgaaggaaacgaaacucccgggggauacugccucacccgauggaugcucaucgaagccgagcucaaaugcuucggaaacaccgcagucgccaaaugcaacgaaaaacacgacgaagaguucugcgacaugcuacgcuuauucgacuucaacaaacaggccauaagacgccucaaggcugaagcccaaaugagcauccaacucauaaacaaagcaguuaacgcgcuaauaaacgaccaacucaucaugaaaaaccaccuacgcgacaucaugggcauccccuacugcaacuacucaaaauacugguaccucaaccacaccucaucuggccguacuucacuacccaaaugcuggcucaucuccaacggcucauaccucaacgaaacccaauucuccgacgacauagaacaacaagccgaccauaugaucaccgaaaugcuccagaaagaauacaucgaacgccaaggaaaaacaccccucggccuaguagacaucuucaucuucagcaccagcuuuuaccuaauaucaaucuuccuccaccucaucaaaauccccacccacagacacaucgucggcaaacccugcccaaaaccccaccgccuuaaccacaugggaguaugcucaugcggccucuacaaacaccccggcguucccaccaaauggaaaagauaa

SEQ ID NO: 3010 - RNA, 1476 nt, Artificial Sequence
  derived and/or modified CDS sequence (opt11) from Lassa virus__AAV54104__GPC
augggccaaaucgucaccuucuuccaagaggucccacacgucaucgaagaagucaugaacaucguacuuauagcccucucuguccucgcaguccucaagggccucuacaacuucgcuacaugcggacucguaggccucgucaccuuccuccuccuuugcggccgcuccugcaccaccucccucuacaaaggagucuacgaacuccagacccucgagcuuaacauggaaacacuaaauaugacaaugccccucucaugcaccaaaaacaacucacaccacuacaucauggucggcaacgaaaccggacucgagcugacucuaaccaacaccuccaucaucaaccacaaauucugcaaccugagcgacgcacacaagaaaaaccuauacgaccacgcccucauguccauaaucucaaccuuccacuuaagcauccccaacuucaaccaauacgaagccaugucaugcgacuucaacggcggcaaaaucuccguacaauauaaccucagccacuccuacgccggcgacgccgcaaaccauugcggcacaguugccaacggaguucuccaaacauucaugcgaauggcauggggcggcuccuacauagcccucgacuccggccgagggaacugggacugcaucaugacaagcuaccaauaccucaucauccaaaacaccaccugggaagaccacugccaauucagccgccccagcccaaucggauaccucggacuccucucgcaacgcacccgagacaucuacauaucccgccgccuccuaggcaccuucacauggacccucagcgacucagaaggcgaggacacccccggaggcuacugccucacacgcuggaugcucaucgaagccgaacuaaaaugcuucggcaacacagcagucgccaaaugcaacgaaaaacacgacgaggaguucugcgacaugcuacgccuauucgacuucaacaaacaagccauccaaagacuaaaagcagaagcccagaugagcauacaacucaucaauaaagccguaaacgcccucaucaacgaccaacugaucaugaaaaaccaccuccgcgacaucaugggcauccccuacugcaacuacuccaaauacugguaccucaaccacaccacaaccggccgaaccucccuaccaaaauguuggcucgucuccaacggcucauaccucaacgagacacacuucucagacgacaucgaacaacaagccgacaacaugaucaccgagaugcugcaaaaagaauacauggaacgccaaggcaaaacaccccucgggcugguagaccucuucgucuucuccaccuccuucuaccuaaucagcauauuccuccacuuagucaagauccccacccacagacacaucgucggaaaauccugccccaaaccacaccgccucaaccacaugggcaucugcuccugcggccuauacaaacaaccgggcguccccgucaaauggaaacgcuaa

SEQ ID NO: 3011 - RNA, 1476 nt, Artificial Sequence
  derived and/or modified CDS sequence (opt11) from Lassa virus__ADI39451__GPC
augggccagaucguuaccuucuuccaagaaguuccccacgucaucgaagaagucaugaacaucguccuaaucgcccuuuccguccucgcaguucucaaaggccuauacaacgucgcaaccugcggcuuaauuggccucaucgccuuccuccuacucugcggacgauccugcacuaccacacuauacaaaggcgucuacgaacuucaggcccucgaacucaacauggaaacccucaacaugaccaugccccuuuccugcaccaaaaacaauucccaccacuacaucaugguaggcaacgaaacuggacucgaacucacucucaccaacaccuccauaaucaaccacaaauucugcaaccucucagacgcccacaaaaagaaccuuuacgaccacgcccucaugucuaucauuucgaccuuccaucuauccauccccaauuucaaccaguacgaagccauguccugcgacuucaacggcgggaaaaucucagugcaauacaacuuaucccacaccuacgcaguagacgccgccaaccacugcggcaccgucgcaaacggcguacuccaaaccuucaugcgcauggccuggggcggcuccuauaucgcccucgacucaggacgcgguuccugggacugcaucaugaccuccuaccaauaccucaucauccaaaacaccaccugggaagaccacugccaguucucccgcccaucaccaaucggcuaccuaggucuucucucacaacgcacccgagacaucuacaucucccgccgccuccuuggcaccuuuaccuggacccucuccgauuccgagggcaaagacacgcccgggggauacugccucacccguuggaugcucaucgaagccgaacucaaaugcuucggcaacacagcugucgcaaaaugcaacgaaaaacacgacgaagaguucugcgacaugcuccgccucuucgacuucaacaagcaagccauccaacgccucaaagccgaagcccagaugucuauccaacucauaaacaaagccgucaacgccuuaaucaacgaccaacucauaaugaaaaaccaccuccgugacauaaugggcaucccuuacugcaacuacuccaaauacugguaccucaaccacaccaucaccggccgcacaucccuccccaaaugcuggcuagucuccaacggaucauaccuaaacgaaacccacuucucagacgacauagaacaacaggccgacaacaugaucaccgaaaugcuccaaaaagaauacaucgaacgccaaggcaagaccccacucggccucguagaccuuuucgucuucagcacaucauucuaccuaaucuccaucuuccuccaccuuaucaaaauccccacccaccgccacaucgucaacaaacccugcccuaaaccccaccgccuaaaccacaugggcgucugcuccugcggccuauacaaacaaccuggcgucccgguuagauggaaacgauaa

SEQ ID NO: 3012 - RNA, 1473 nt, Artificial Sequence
  derived and/or modified CDS sequence (opt11) from Lassa virus__ADU56610__GPC
augggccaaauagucaccuucuuccaagaagucccacacgucaucgaagaagucaugaacaucguccucauagcccucucacuacuagccauacuaaaaggcauauacaacgucgccacaugcggccucuucggccucaucuccuuccuccuacucugcggccgaucgugcucaaccaccuacaaaggcguuuacgaacuccaaacgcucgagcuagacauggccaaccucaacaugaccaugccacucuccugcaccaaaaauucaucccaccauuacauuauggucggcaacgaaacagggcuagaacucacccuuaccaacacgagcauaaucaaccacaaauucugcaaccuauccgacgcccauaagaaaaaccucuacgaccacgcccucaugucaaucauuucaaccuuccaccuguccauacccaacuucaaccaauacgaagccauguccugcgacuucaacggaggcaaaaucuccguacaauacaaccucucacaugccuacgccguagacgccgcaaaccacugcggcaccaucgcaaacggcguccuucaaaccuuuaugcgcauggcauggggcggcuccuauaucgcccucgacuccggcaagggcaacugggacugcaucaugaccucauaccaauaccucaucauccaaaacacaacaugggaggaccacugccaauucuccagacccucucccaucggauaucuaggucuacucucacaacgaacccgcgauauauacauuucccgacgacuacucggcaccuucaccuggacccucucggacuccgaaggcaacgaagcccccgggggcuacugccucacccgcuggaugcugaucgaagcagagcucaaaugcuucggcaacaccgccauagcuaaaugcaacgaaaaacacgacgaggaguucugcgauaugcuccgccuuuucgacuucaacaaacaagcaauaaaacgccucaaagccgaagcccaaauguccauccagcuaaucaacaaggccgucaacgcccucauuaacgaccaacucauaaugaaaaaccacuuacgcgacauaaugggaauaccguacugcaacuacuccaaauacugguaccucaaccacaccgucaccggcaaaacaucccucccccgcugcuggcuaaucucaaauggcucauaccuaaacgaaacucacuucuccgaugacaucgaacaacaagccgacaacaugaucaccgaacuccuacaaaaagaauacauggaucgccaaggaaaaacaccccuaggccuagucgaccuguucguauucucaacauccuucuaccucauaucaauauuccuucaccucguaaaaaucccaacccaccgccacaucgucggacgccccugucccaaaccccaccgccucaaccacaugggcauaugcuccugcggccucuacaaacauccaggaguccccgucaaauggaaacgcuaa

SEQ ID NO: 3013 - RNA, 1473 nt, Artificial Sequence
  derived and/or modified CDS sequence (opt11) from Lassa virus__ADU56618__GPC
augggccagaucguuacauucuuccaggaaguaccccacguaauagaagaaguaaugaacauaguccucaucgcccucuccauacucgcaauucucaaaggccuuuauaacaucgccacuugcggccucauaggucucgucacauuccuccuucucucaggccgcucaugcuccaugacauauaaaggcgucuaugaacuccaaacccucgaacucaacaugaacacccugaacaugacuaugccccucucaugcacuaaaaacaacucucaccacuacaucaugguaggcaacgaaaccggacucgagcucacccucaccaacaccucccuacuccaccacaaauucugcaaccuauccgacgcacacaagaaaaaccuauacgaccacacccucauguccaucaucuccaccuuccaccucuccauaccuaacuucaaccaauacgaagccaugagcugcgacuucaacggagguaaaaucaccguccaauacaacuuaagccacagcuacgcaaucgacgccgcaaaccacugcggcaccguagccaacggcguccuccaaacuuucaugcgcauggccuggggcggcucuuacaucgcccucgacuccggccgaggaaaaugggacugcaucaugacuuccuaccaauaccuaaucauccaaaacaccaccugggaagaccauugccaauucucucgccccuccccaauaggauaccucggacuccuaucccaacgaacccgggacaucuacaucucacgacgccuccuaggcacauucaccuggacacucucagacuccgaaggcaacgagacccccggcggcuacugccucacccgguggaugcucauagaagccgaacuaaaaugcuuuggaaacacagccguagcaaaaugcaacgaaaaacacgacgaagaguucugcgacaugcuccgccucuucgacuucaacaaacaagcaauacgccgccucaaagccgaagcacaaauguccauacaacucauuaacaaagccguaaacgcccuuauaaacgaccaacuaauaaugaaaaaucaccucagagacauuaugggcauccccuacugcaacuauuccaaauacugguaccucaaccacacauccaccggccguaccucccucccccgaugcuggcuagucuccaacggcuccuaccucaacgagacccacuucucagacgacaucgagcaacaagccgacaacaugaucaccgaaaugcuccagaaagaauaccuggaccgccaaggcaaaacuccccuaggacuugucgaccuauuuguauucuccaccuccuucuaccucaucuccaucuuccuccaccuuguaaaaauaccaacccacagacacauaguaggcaaaccaugcccaaaaccccaccgucucaaccacauggguauauguagcugcggccucuacaaacagcccggcguccccguccgauggaaacgauag

SEQ ID NO: 3014 - RNA, 1473 nt, Artificial Sequence
  derived and/or modified CDS sequence (opt11) from Lassa virus__ADU56622__GPC
augggccaaaucaucaccuucuuccaagaagucccucacguaaucgaagaaguaaugaacauaguccucaucgcccuaucacuccucgcuauccucaaaggcaucuacaacgucgcaaccugcggccucuucggccucgucucuuuccuccuccucugcggccgcucaugcucuaccacuuacaaaggcgucuacgaacuccaaacacucgaacuagacauggccagccuaaacaugacaaugccucucucaugcaccaaaaacaacucccaccauuacauaaugguaggaaacgaaaccggccucgaacuaacccucacaaacaccuccaucauaaaucacaaguucugcaaccucagcgacgcccacaagaaaaaccucuacgaccacgcccucaugucuaucauaucaaccuuucaccuauccauccccaacuucaaccaauacgaagcgauguccugcgauuucaacggcggcaaaaucuccguccaauacaaccucucccacaccuacgcagucgacgcagccaaccacugcggcaccaucgcaaacgguguccuacaaaccuucaugcguauggccuggggagguucauacaucgcccucgacagcggcaaaggcucaugggacugcaucaugaccucauaccaauaccucaucauccaaaacaccaccugggaggaccacugccaauucucccgucccucaccaaucggcuaccuaggccuacuaucacaacgaacccgcgacaucuacaucucacgccgacuccucgggacauucaccuggacacucucugacucggaaggcaacgaaacaccaggcggcuacugccuuacccgcuggaugcuuauagaagccgaacucaaaugcuucggcaacaccgccgucgccaaaugcaacgaaaaacacgacgaagaguucugcgacaugcuccgccuauucgacuucaacaaacaggcaauccgccgccucaaaaccgaagcccaaauguccauccaacuaaucaacaaagcaguaaacgcccucaucaacgaccaauuaaucaugaaaaaccaccuccgagacaucaugggcauccccuacugcaacuacuccaaauacugguaccucaaccacaccgucaccggaaaaaccagccucccccgcugcuggcuugucuccaacggaucauaccuaaaugaaacccacuucucagacgacaucgaacaacaagcggacaacaugaucaccgaacuacuccaaaaagaauacaucgacagacaaggcaaaacaccacucggacucgucgaccucuucgucuucuccaccagcuucuaucucaucuccauuuuccuccaccuugucaaaaucccaacccacagacaugucaucggcaagcccuguccaaaaccacaccgccuuaaccacaugggcaucugcucaugcggccucuacaaacauccaggcgucccuguaaaauggaaaagauaa

SEQ ID NO: 3015 - RNA, 1473 nt, Artificial Sequence
  derived and/or modified CDS sequence (opt11) from Lassa virus__ADU56626__GPC
augggccaaauaaucaccuucuuccaagaagucccccacgucaucgaagaagucaugaacauaguacuaaucgcccucucccuccucgcuauccucaaaggcaucuacaacgucgcaaccugcggccucuucggccuggucucauuucuacuacuauguggccgcuccugcagcaccacauacaaaggagucuacgaacuccaaacacuagaacuaaacauggccagccuaaacaugaccaugccccuauccugcacuaaaaacaacucucaccacuacauuauggucgggaacgaaacaggccucgaacucacacucacuaacaccuccaucauuaaccacaaauucugcaaccuaucggacgcccacaagcgaaaccuauacgaccacgcccucauguccaucauauccaccuuccaccucuccauccccaacuucaaccaauacgaagccaugucaugcgacuucaacggcggaaagaucuccguccaauacaaccuaucccacaccuacgccguagacgccgccaaacacugcggcacuaucgccaacggcguccuccagacauucaugcgcauggccuggggcggcuccuauaucgcccuagacucaggcaaaggcucgugggacugcaucaugaccuccuaccaauaccuaaucauacaaaauacuacaugggaagaccacugccaauucucccgaccuucuccaauaggcuaccuuggccuccucucccaacgcacccgagacauauacaucucccgccgcuuacuaggcaccuucacguggacacucuccgacuccgaaggcaacgaaacccccggcggcuacugccucacccgauggaugcucauagaagccgagcucaaaugcuuuggcaacacagcggucgcuaagugcaacgaaaaacacgaugaagaguucugcgacaugcuccgccucuucgacuucaacaaacaagccauacgacgucucaaagccgaagcgcaaaugucuauccagcucaucaacaaagcaguaaacgcgcucaucaacgaucaacucauaaugaaaaaccaccucagggacaucaugggcauccccuacugcaacuacucuaaauacugguaccucaaccacacuguaaccggcaaaaccucucuaccacgcugcuggcuaguguccaauggcuccuaccugaacgaaacacacuucuccgacgacauagagcaacaagccgacaacaugaucacagaacuacuccaaaaagaauauaucgaccgacaaggcaaaacaccccucggucuagucgaccucuucgucuucucaaccucauucuaucuaaucuccauauuccuccaccucguaaaaauccccacccaccgacacgucaucggcaaaccaugccccaaaccccaccgccucaaccacauggguaucugcuccugcggacuuuacaaacaccccggcguacccguaaaauggaaacgcuaa

SEQ ID NO: 3016 - RNA, 1473 nt, Artificial Sequence
  derived and/or modified CDS sequence (opt11) from Lassa virus__ADU56630__GPC
augggccaaauuaucaccuucuuccaagaagucccacacguuauagaagaaguaaugaacauaguccucaucgcccuaucucuacuagccauacucaaaggcauauacaacguugcaaccugcggccuuuuuggucucgucuccuuccuccuccucugcggccgcucaugcuccaccaccuacaaaggggucuacgaacuccaaacccucgaacucgacauggcaagccucaauaugaccaugccccucucuugcaccaaaaauaacucacaccacuacauaauggucggaaacgaaaccggccucgaacuuacccucacuaacaccuccauaaucaaccauaaauucugcaaccucucugacgcccacaagaaaaaccucuacgaccacgcccuuauguccauaaucuccacauuccaccuaucuauccccaacuucaaccaauacgaagccauguccugcgacuucaacggcggcaaaaucucaguccaauacaaccuuucccacgccuacgcaguagacgccgccaaccacugcggcaccauagccaaugguguccuccaaaccuucaugcgaauggcguggggcggcuccuacauagcccucgacagcggcaaaggcucgugggacugcaucaugaccuccuaccaauaccucauaauacaaaacaccaccugggaagaccacugccaauucucacgccccucucccaucggcuaccuaggccuccucagccaacgaacccgagacauauacauaucccgccgccuucucggcaccuucacauggacccucuccgacucagaagggaacgaaacucccggcggcuacugccucacacgcuggaugcucaucgaagccgaacucaaaugcuucggcaacacagcugucgccaaaugcaacgaaaaacacgacgaagaguucugcgacaugcuccgccuguuugacuucaacaaacaggccauccgccgacucaaaaccgaagcccaaauguccauccaacucaucaacaaagccgucaacgcccuaaucaacgaccaacucaucaugaaaaaccaccuccgcgacaucaugggcaucccguacugcaacuacuccaaauacugguaccucaaccacaccguaacaggcaagaccucccucccccguugcuggcuuguauccaacggcagcuaccuaaacgaaacccacuucucugacgacaucgaacaacaagccgacaacaugaucaccgaacuacuccaaaaagaauacauggaccgccaaggcaaaaccccacuuggucucgucgaccuauuuguuuucuccacuucuuucuaccucaucucaaucuuccuacaccuugucagaauccccacucaccgacacgucaucggaaaaccaugcccaaaaccccaccgccucaaccacaugggcaucugcuccugcggccuguacaagcaucccggcguccccgucaaauggaaacgcuaa

SEQ ID NO: 3017 - RNA, 1476 nt, Artificial Sequence
  derived and/or modified CDS sequence (opt11) from Lassa virus__AFY05588__GPC
augggccagaucgugaccuuuuuucaagaaguaccucacgucaucgaagaagucaugaacaucguccuaauagcccucagcguccucgcaguccucaaaggccucuauaauuucgccacuugcggccuggucggccucguaacauuccuucuccucugcggacgcuccugcaccacaucacucuacaaaggagucuacgagcuccaaacccuagaacuaaauauggagacccucaauaugaccaugccacuauccugcacuaaaaacaacucucaccacuacaucauggucggaaacgaaacaggccuagaacucacacucaccaacaccucaauaauaaaccacaaauuuugcaaccucucagacgcccacaaaaaaaaccucuacgaccacgcccuaauguccaucaucucuaccuuccaccucuccauccccaacuucaaccaauacgaagcaauguccugcgacuucaacggcggaaaaaucagcguccaauacaaccucucccacuccuacgcuggcgacgccgccaaccacugcggcaccguagccaacggcgugcuccaaaccuucaugcgcauggccuggggcggcagcuacaucgcccucgacuccggccgcggcaacugggacugcauuaugaccuccuaccaauaccucaucauccagaacaccacaugggaagaccauugccaauucucccgccccucaccaaucggcuaccucggccuccucucacaacgcacccgagaccuauacauaagccgacgccuucucggcacauucaccuggacccuauccgauuccgaaggugaggacacaccaggaggcuacugucuaacccgcuggaugcucaucgaagccgaacuaaaaugcuucggcaacaccgccguagccaaaugcaacgagaaacacgacgaagaauuuugcgacaugcuccgacucuucgacuucaacaaacaagccauacaacgacuaaaagcagaagcccaaauguccauucaacuaaucaacaaagccgucaacgcccuuauuaacgaccaacuaauaaugaaaaaucaccuccgagacaucaugggcaucccauacugcaacuacucaaaauacugguaccuaaaccacaccaccaccggccgcaccucccuuccuaaaugcuggcuagucuccaacgggucauaucuaaacgaaacccacuucucagacgacaucgaacagcaagccgacaacaugaucaccgaaaugcuccaaaaagaauauauggagagacaaggcaaaacaccccuaggccucgucgaccucuucgucuucuccacauccuucuaccucauaagcaucuuccuccaccucguaaaaaucccuacucaccgccacaucgucggcaaauccugcccaaaaccccaccgccucaaccacaugggcaucugcuccuguggccuauacaaacaaccaggugucccaguaaaauggaaacgcuaa

SEQ ID NO: 3018 - RNA, 1476 nt, Artificial Sequence
  derived and/or modified CDS sequence (opt11) from Lassa virus__AFY05590__GPC
auggggcaaauaguaacauuuuuccaagaagucccucacguuaucgaagaagucaugaacaucguccucauagcucuauccguccuugcaguacucaaagggcuauacaacuucgcaacaugcggacugguaggccucgucaccuuccuccuccucugcggucgcuccugcaccaccucccucuacaaagguguauacgagcuacaaacacucgaacuaaacauggaaacccuaaacaugaccaugccccucuccugcacuaaaaacaacucccaucauuacaucauggucggcaacgaaaccggccucgaacuaacccuuaccaacaccuccauaaucaaccacaaguucugcaaccuaucagacgcccacaagaaaaaccucuacgaccacgcacucauguccauaaucucaaccuuccacuuaagcauccccaacuucaaccaauacgaagccaugucaugcgacuucaacggcggaaaaaucucgguccaauacaaucucagccacuccuacgcaggcgacgcagccaaccacugcggcaccgucgccaacggcguccuccaaaccuucaugcgaauggccuggggaggcucauacaucgcacucgacuccggacgcggaaacugggacugcaucaugaccucauaccaauaccucaucauccaaaacaccacuugggaagaccacugccaauuuucccgucccucaccuauaggcuaccucggacuccuaucccaacgaacccgcgacauguauaucucacgacgacuacucggaaccuuuaccuggacccucuccgacagcgaaggcgaagacacccccggaggcuacugccuaacccgcuggaugcuaaucgaggccgagcuuaaaugcuucggcaacaccgccgucgccaaaugcaacgaaaaacacgacgaagaguucugcgacaugcuccgacuuuucgacuucaacaaacaagccauccaacgccucaaagcggaagcccaaauguccauccaacuaaucaacaaagcagucaaugcccucaucaacgaccaacugauaaugaaaaaccaccuccgcgacaucaugggcauccccuacuguaacuacucaaaauacugguaccugaaccacaccacaaccgggcguacuucccuacccaagugcuggcucguauccaacggcucuuaccucaaugaaacccacuucucagacgacauagaacaacaagccgacaacaugauaaccgaaaugcuacaaaaagaauauauggaacgacaaggcaaaacgccccucggccuuguugaucucuucgucuuuagcaccuccuucuaccucaucuccauauuccuccaccuugugaaaaucccuacccaccgccacaucgucggcaaauccugcccuaaaccccaccgacucaaccacaugggcaucugcuccugcggccucuacaaacaaccuggcgucccgguaaaauggaaacguuaa

SEQ ID NO: 3019 - RNA, 1476 nt, Artificial Sequence
  derived and/or modified CDS sequence (opt11) from Lassa virus__AHC95553__GPC
augggccaaaucgucaccuucuuccaagaaguuccccacgucaucgaagaggucaugaacaucguacucauagcccucagcauacuagccguacuuaaaggccucuacaacaucgcaaccugcggccuuaucggccucgucaccuucuuccucuuaugcggccgcucaugcuccuccaaccuauacaaaggcgucuacgaacuccaaucacuagaccucaacauggaaacacucaacaugaccaugccccuaucauguaccaaaaacaacucacaucacuacauacggguaggcaacgagaccggccucgaacuaacacuuaccaacacaucacuccucgaccacaaauucugcaaccucuccgacgcccacaagaaaaaccuauacgaccacgcccucauguccauuaucuccacguuccaccucuccauacccaacuucaaccaauacgaagcgaugucaugcgacuucaacggcggcaaaaucacaguacaguacaaccucucccacuccuacgccggcgaugccgcccgccacugcggaaccaucgccaacggcguccuccaaaccuucaugcgcauggccuggggaggcagcuacaucgcccucgacuccggacauggcaacugggacugcauuaugaccucuuaccaauaccuaaucauacagaacaccacaugggaagaccacugccaauucucacgucccucacccaucggauaucucucccuacucucgcaacgcacaagagacaucuacauaucucgacgccuccucggcacguucaccuggacccucucagacagcgaaggcaacgccacucccgggggcuacugucucacgagauggaugcucaucgaagcagaacuaaaaugcuucggcaacacagccgucgccaaaugcaacgaaaaacacgacgaggaguucugugacaugcuccgacuauucgacuucaacaaacaagccaucucacgccuccgauccgaagcacaaaugucaauacaacucaucaauaaagccguaaacgcccuuauaaacgaccagcucauaaugaaaaaccaccuacgcgacauaaugggcauacccuacugcaacuacuccaaguacugguaccucaaccacaccgucaccggaagaacaucccuccccaaauguuggcucguuuccaacggcuccuaccucaacgaaacccacuucuccgacgacaucgaacaacaagccgacaacaugaucaccgaaaugcuacagaaagaauacauggauagacagggcaaaacuccccucgggcuaguagaucuauucguguucuccaccuccuucuaccuaaucuccaucuuccuacaccuagugaaaauccccacccacagacacauaguaggaaaacccugccccaaaccacaccgacucaaccgaaugggaauaugcagcugcggacuauacaaacaacccggcguacccgucaaauggaaacgcuaa

SEQ ID NO: 3020 - RNA, 1476 nt, Artificial Sequence
  derived and/or modified CDS sequence (opt11) from Lassa virus__AHC95555__GPC
augggacaaauagugaccuucuuccaagaagucccacacgucauagaagaagugaugaauauaguccuaauagcacucuccauccuugcgguacucaagggccucuacaacaucgccacaugcggccuuaucggcuuagugaccuuccucuuacuuugcggacgcuccugcucauccaaccucuacaaggggguauacgaacuccaaucccuagaccuaaacauggaaacauuaaacaugaccaugccccucagcugcaccaaaaacaacagccaccacuacauccgagccggcaacgaaacaggccucgaacucacccucacaaacaccucacucaucaaccacaaauucugcaacuuauccgacgcgcacaagaaaaaccucuacgaccacacccucauguccaucauaucaacauuccaccuauccauccccaacuucaaucaauacgaagcaauguccugcgacuucaacggcgguaaaaucucaguccaauacaaccucucccacgccuacgccaucgacgcagccgaacacugcggaaccgucgccaacggcguccuccaaaccuucaugcgaauggcuugggguggcuccuacaucgcacucgacagcgggcgcggcaacugggacugcauaaugacauccuaccaauaccuaauaauacaaaacacaaccugggaggaccacugccaauucucccgucccucgcccaucggcuaccuaggccuccucucccaacguacacgugacaucuacaucucccgccgacuccucggcacauucaccuggacacucagcgacagcgaggguaacgccaccccaggcggcuacugccucacccgcuggaugcucauagaagccgaacucaaaugcuucggcaacaccgcagucgccaaaugcaacgaaaaacacgacgaagaguucugcgacaugcuacgccucuucgacuuuaacaaacaagcaauauccagacuaaaauccgaagcccagaugucaauucaacuaaucaacaaagcagucaacgcccucaucaacgaccaacucauaaugaaaaaccaccuccgcgacaucaugggcauccccuacuguaacuacagcaaauacugguaccucaaccacaccaucacaggacgaaccucacuacccaaaugcuggcucguuuccaacggauccuaccucaacgaaacucacuucucagacgacaucgaacaacaagccgauaacaugaucaccgaaaugcuccaaaaagaauacauggaaagacaaggcaaaacaccccucggccucgucgaucucuucgucuucagcaccuccuucuaccucauauccaucuuccuccaccuuguaaaaauccccacccacagacacaucgucggcaaaccgugcccgaaaccccaucgccucaaccacaugggaaucugcagcugcggccucuacaaacaaccuggcgucccccucaaguggaaacgcuaa

SEQ ID NO: 3021 - RNA, 1476 nt, Artificial Sequence
  derived and/or modified CDS sequence (opt11) from Lassa virus__AHC95557__GPC
augggccaaauaguaaccuucuuccaggaagucccacacgucaucgaagaggucaugaacaucguacuaaucgcucucuccauccuagccguacucaaaggacuguacaacaucgcaaccugcggccucauuggccuagucaccuucuuccuccuuugcggcagauccugcuccuccaaccuauauaagggaguauaugaacuucagucacucgaccucaacauggagacacucaauaugaccaugccccuauccugcaccaaaaauaacucacaccacuacauccgugucggcaacgaaaccggccucgaacuaacccuaaccaacaccucacuucucaaccacaaauucugcaaccucuccgacgcccacaaacgcaaccucuacgaccacgcccucauguccauaaucuccacuuuccaccucuccauccccaacuuuaaccaauacgaagccauguccugcgacuucaacggcggcaaaauuaccguacaguacaaucucucccacuccuacgccggcgacacugccaaacacugcggcaccauugccaacggaguccugcaaaccuucaugagaauggccuggggcggcucuuacauugcccucgacuccggccacggcaacugggacugcaucaugaccuccuaccaauacuuaaucauccaaaacaccaccugggaggaccacugccaauucucccgccccuccccaaucggauaccucggccuacucagccaacguaccagagacaucuacaucucacgccggcuccuuggaaccuucaccuggacacucucugacuccgagggcaacgccaccccaggcggcuacugccucacacgauggaugcucauagaagccgaacucaaaugcuucggaaacaccgccgucgccaaauguaacgagaaacacgacgaagaguucugcgacaugcuccgccuauucgacuucaacaaacaagccaucucccgccuccgcucagaagcacaaauguccauacaacucaucaacaaagccgucaacgcccucaucaacgaccagcuaauaaugaaaaaucaccuccgcgacauaaugggaauccccuacugcaacuacuccaaguacugguaccucaaccacaccgucacaggccgaaccucacuacccaaaugcuggcucguuucaaacggcucauaccucaacgaaacccacuucucagacgacaucgaacaacaagcagacaacaugauaaccgaaauguuacaaaaagaauacauggaccgacaaggcaaaacaccccuaggccuaguagaccuuuuugucuuuucaacauccuucuaccucaucuccauauuucuccaccuaguuaaaauccccacccaccgccacaucguuggaaaacccugcccaaaaccccaccgccucaaccgcaugggaaucugcuccugcggccucuauaaacaacccggcguaccagucaaauggaaacgcuaa

SEQ ID NO: 3022 - RNA, 1476 nt, Artificial Sequence
  derived and/or modified CDS sequence (opt11) from Lassa virus__AHC95559__GPC
augggacaaaucauaaccuucuuccaagaagucccccacguaaucgaagaaguaaugaacaucguccuaaucgcccuuuccauccucgccguccucaaagggcuauacaacaucgccaccuguggccucauaggccucgucacauuccuccuccuaugcggcagaucuugcucaucaucccucuacaaaggcguuuacgaauuacaaucccuagaccucaauauggaaacacucaacaugaccaugccccucucuugcacuaaaaacaacucccaccacuacauacgcgucggaaacgaaaccggccucgaacuaacacucaccaacaccucccuaauaaaccacaaauucugcaaucugucagacgcccacaaaaaaaaccucuacgaccacgcacucaugucaaucaucuccacauuccaccucagcauccccaacuucaaccaauacgaagccaugucuugcgacuucaauggcggaaaaauaucaguacaauacaaccuaucccacgccuacgccaucgacgccgcaucccacugcggcaccgucgcaaacggcguacuccaaacuuucaugcguauggccugggggggauccuacaucgcccucgacucaggccacggcaacugggacugcaucaugaccuccuaccaguaccuaaucauccaaaacaccaccugggaagaccacugccaauucucacgucccucaccaaucggcuaucucggucuccuaucccaacgcacccgcgacauauacaucucccgccgccuccuaggcaccuucacuuggacucucuccgacucugaaggcaacgccacccccggcggcuacugccucacacgcuggaugcucaucgaagcagaacucaaaugcuucggcaauaccgcagucgccaaaugcaacgaaaaacacgacgaagaauuuugcgacaugcuccgccuuuucgacuucaacaaacaagccaucucccgccucaaaucagaagcccaaauguccauccaacuaauuaacaaagccgucaacgcccucaucaacgaccaacucaucaugaaaaaccaccuucgagacauaaugggaauccccuacugcaacuacuccaaauacugguaccuaaaccacacagucacaggcaaaacuucucucccaaaaugcuggcucguuucuaacggcuccuaccuaaacgaaacccacuucuccgacgacaucgaacaacaagccgacaacaugaucaccgaaaugcuccaaaaagaauacauggaacgccaaggcaaaaccccccugggucucgucgaccucuucgucuucuccacauccuucuaccuuaucucaaucuuccuccaccucgucaaaauacccacccaccgacacaucgucggaaaacccugcccuaaaccgcaccgccuuaaccacaugggcauaugcucgugcggacuauacaaacaacccggcguccccgucaaauggaagcgcuaa

SEQ ID NO: 3023 - RNA, 1476 nt, Artificial Sequence
  derived and/or modified CDS sequence (opt11) from Lassa virus__AIT17126__GPC
augggacaaaucguuaccuucuuccaagaagucccccacguaaucgaggaagucaugaacaucguccucaucgcacuauccauacucgccguccuuaaaggacucuacaacuucgcaaccugcggccuagucggacuacuaaccuuccuccuacuaugcggacgcuccugcaccaccggacucuacaaaggagucuacgaacuccagacccuagaacuaaauauggaaacccucaacaugacaaugccccucuccugcaccaaaaacaacucacaccacuacaucaugguuggcaacgaaaccggccucgaacucacgcucaccaacaccucaaucauuaaccacaaauucugcaaccuaucagacgcccacaagaaaaaccuauacgaccacgcccucaugucaaucaucuccacauuccaccucuccauccccaacuucaaccaauacgaagccaugagcugcgacuuuaacggcggcaaaaucuccguccaauacaaccucucccacagcuacgcaggcgacgcagccgaccauuguggcaccgucgccaacgggguccuccaaacuuuuaugcgcauggccugggguggaucauacaucgcccuagacucaggccgcggacgcugggacugcaucaugaccuccuaccaauaccucaucauccaaaacaccacaugggaagaccacugccaauucucccgccccucccccaucggauaccugggccuccucucgcaacgcacacgcgacauauacaucucccgcagacuccuaggcaccuucaccuggacacucucagacuccgaaggcaaagacacaccaggcggcuacugccuaacacgguggaugcuaaucgaagcggaacucaaaugcuucggcaacacagccguugcaaaaugcaacgaaaaacacgacgaagaguucugcgauaugcuccgacucuucgacuucaacaaacaagcaauccaacguuuaaaagcagaagcccaaaugucaauccaacuaaucaauaaagcagucaacgcccuaauaaacgaccaacucgucaugaaaaaccaucuccgcgacaucaugggcauccccuacugcaacuauagucgcuacugguaccuuaaucacaccaccaccggccgcaccucacuacccaaaugcuggcucguaucaaacggcuccuaccucaacgaaacacacuucagcgacgacaucgaacaacaagccgacaacaugauaaccgaaaugcuacaaaaagaguacauggaacgccaaggaaaaaccccauuaggccucguugaccucuucgucuucucaaccuccuucuaucuaaucuccaucuuccuccaccucgucaaaauccccacccaccgacacaucgucggcaaguccugcccaaaaccccaccgacuaaaccacaugggcauaugcucaugcggccuguacaaacaacccggcguccccguuaaauggaaacgcuaa

SEQ ID NO: 3024 - RNA, 1476 nt, Artificial Sequence
  derived and/or modified CDS sequence (opt11) from Lassa virus__AIT17130__GPC
augggccaaauagucacauucuuucaagaagucccacacgucaucgaagaagucaugaacaucguccugaucgcccucuccauacuggccguucugaaaggccucuacaacuucgccacaugcggcuucgucggccuaguaacauuccuccuccucugcggacgcucauguacaaccucccuauacaaaggcgucuacgaacuccagacccucgaacucaacauggaaacgcuaaauaugaccaugccccuguccugcaccaaaaacaacucacaccacuacauacgcguaggcaacgacaccggccucgaacucaccuuaaccaacaccuccaucaucaaccacaaauucugcaaccuuagcgacgcccacaagaaaaaccucuacgaccacgcacuaaugucaaucaucuccaccuuccaccuauccauccccaacuuuaaccaauacgaagccauguccugugacuucaacggcggcaaaaucuccguccaauacaaccucucccauuccuacgcagucgacgccgccucccacugcggcaccaucgcaaauggaguccuccaaacauucaugcgcauggcauggggcggcucguacaucgcccuagauuccggccgcgaccgcugggacugcaucaugaccucuuaccaauaccucaucauacaaaacaccaccugggaagaccacugccaauucucacguccguccccaauaggcuaccucggucuccucucacaacguacccgcgacaucuacauuucacggcgucuccuaggaacauuuacauggacucucuccgacagcgaaggcaaagauacaccuggcggcuacugccucacccgcuggaugcucauagaagccgaacucaaauguuucggaaacaccgccgucgccaaaugcaacgaaaaacacgacgaagaauuuugcgacaugcuacgccuauuugacuucaacaaacaagccauccaacgacucaaagccgaagcccaaaugucaauccaacuaaucaacaaagcagucaacgcccucaucaaugaccaacucaucaugaaaaaccaccucagagacauaaugggcauccccuacugcaacuacuccaaauacugguaccucaaccacacaacuaccggaaaaacaucacuccccaaaugcuggcuuguguccaacggcagcuaccucaacgaaacccacuucucagacgacaucgaacaacaagccgacaacaugaucaccgaaaugcuccaaaaagaauacauggaacgccaaggcaaaacgccccuaggacucgucgaccuuuuugucuucucaacguccuucuaccucaucucaaucuuccuacacuuaguaaaaaucccaacccaccgucacaucguaggcaaaucaugccccaagccccaccgccucaaccacaugggcaucuguuccugcggacucuauaaacaacccggaguccccgucaaguggaaaagauag

SEQ ID NO: 3025 - RNA, 1476 nt, Artificial Sequence
  derived and/or modified CDS sequence (opt11) from Lassa virus__AIT17134__GPC
augggccaaaucgucacauucuuccaggaagucccccacgucaucgaggaaguaaugaacaucguacuuauagcauuaagcauccuagccguccucaaaggacucuacaacuucgcaacaugcggucuaguuggacuggucacauuccuccuccuauguggacgcucaugcaccaccucacucuacaaaggcgucuacgaacuccaaacacucgaacucaacauggaaacccucaacaugaccaugcccuuaagcugcaccaaaaacaacucccaccacuauauaaugguaggcaacgaaaccggccuagaacucacacuaaccaacacauccaucauaaaccacaaguucugcaaccucagcgacgcccacaaaaagaaccuuuacgaccacgcacucauguccaucaucucaaccuuccaccucucaauccccaacuucaaccaauacgaagcaauguccugcgacuucaacgggggcaaaaucagcguacaauacaaccucucccacuccuacgcaggcgacgccgccaaccacugcggcaccguagccaacggcgugcuacaaaccuucaugcgaauggccuggggcggcuccuacauagcccucgacaguggccgcggccgaugggacugcaucaugacauccuaucaguaccuaaucauccaaaacaccaccugggaagaccacugccaguucucaagaccaucaccaaucggcuaccucggccuccucucccaacgcaccagagacaucuacaucucccgacgccuucucggcacuuucaccuggacccucucugacagugaaggcaaagacacccccggcggcuacugccugacccgauggaugcuaaucgaagccgagcuaaaaugcuuuggcaacaccgccgucgccaaaugcaaugaaaagcacgacgaagaauuuugcgacaugcuaagacucuucgacuucaacaaacaagccauacagcgccucaaagcagaagcccaaauguccauccaacuaaucaacaaagcagucaacgcacucaucaacgaccaacucaucaugaaaaaccaccuacgcgacauaaugggcaucccuuacugcaacuacuccaaauacugguaccucaaccacaccaccacggguaaaacaucucuaccuaaaugcuggcucgucuccaacggcuccuaccuaaacgaaacacacuuuagcgacgacaucgaacaacaagccgacaacaugaucaccgaaaugcuccaaaaagaguacauggaacgccaaggaaaaacaccacucggccuagucgaucuauucguauucuccacuuccuucuaccucauaagcaucuuccuacaccucguaaaaaucccaacccaccgacacauagucggcaaaagcugccccaaaccccaccggcuaaaccacaugggcauaugcuccugcggccucuacaaacaaccaggcguccccguaaaguggaaaagauaa

SEQ ID NO: 3026 - RNA, 1476 nt, Artificial Sequence
  derived and/or modified CDS sequence (opt11) from Lassa virus__AIT17138__GPC
augggccaaaucgucacauucuuccaagaagucccacacgucauagaagaagucaugaacaucguacucaucgcacucucuauacucgcuguacucaaaggacuauacaaccucgcuaccugcggccucguaggccucgucaccuuccuccuacuaugcggccgcagcugcaccaccucccucuacaaaggcguuuacgaacuccaaacuuuggaacuuaacauggaaacccucaacaugaccaugccacucucuugcaccaaaaacaacucccaccacuacaucauggucggcaacgaaaccggacucgaacucacccugacaaacaccucccuaaucaaccacaaauucuguaaccucuccgaugcccacaagaaaaaccucuacgaccacgcccucaugucaaucaucucgacauuccaccuauccauacccaacuucaaccaguacgaagccauguccugcgacuuuaacggcggcaaaaucuccguccaauacaaccucucccauuccuacgccguagacgcagccucacacuguggcacagucgcaaacggcguccuccaaaccuucaugcgcauggcguggggaggaucauacaucgcacuagacucaggccgaggcgguugggacugcaucaugaccuccuaccaauaccucaucauccaaaauacuacuugggaagaccauugccaauucucccgcccaucucccauaggcuaccucggccuccucucccaacgaacccgagacauauacaucagccgccgccuucuuggcaccuucacauggacccuuucugacucagaaggaaaagacacccccggcggcuacugccuaacccgcuggaugcucaucgaagcugaacuuaaaugcuuuggcaauaccgcagucgccaaaugcaacgaaaaacacgacgaagaguucugcgacaugcuaagacucuucgauuucaacaaacaagccauucaacggcucaaagccgaagcccaaauguccauccaacucauaaacaaagccguuaacgcccucaucaacgaccaacucauaaugaaaaaucaccuccgcgacaucaugggcaucccauacugcaacuacuccaaauacugguaccuaaaccacacaaccaccggccgcaccucccucccgcgcugcuggcucguaucaaacggcuccuaccucaacgaaacacacuucucagacgacaucgaacaacaagcagacaacaugaucaccgaaaugcuccaaaaagaauauauggaacgacaagggaaaacaccccuaggucucgucgaccuauucgucuucuccaccuccuucuaccucaucagcaucuuccuacaccucgucaagauccccacccaccgccacaucgucggaaaauccugccccaagccccaccgacucaaccacaugggaaucugcuccugcggucucuacaaacagccuggaguuccagucaaauggaaacgauga

SEQ ID NO: 3027 - RNA, 1476 nt, Artificial Sequence
  derived and/or modified CDS sequence (opt11) from Lassa virus__AIT17142__GPC
auggggcaaauagucaccuucuuccaagaaguaccacacguaauagaagaagucaugaacaucgugcuaaucgcccucucaguacuugccguccucaaaggucucuacaacuucgcaaccugcggaauuguaggccuagucaccuuucuccuccuaugcggaagauccuguaccacaucccucuauaaaggagucuaugagcuccagacccuugaacucaacauggaaacccucaacaugacaaugccccucagcuguaccaaaaacaauucacaccauuacaucaugguaggcaacgacaccggccucgaacuaacucucaccaacaccagcaucaucaaccacaaauucugcaaccuaagcgacgcacacaaaaaaaaccuauacgaccacgcacuaauguccaucaucucaaccuuccaccucuccauccccaacuucaaccaguacgaagccaugagcugcgacuucaacggcggcaaaauauccguccaguacaaccucagccacuccuacgccggcgaugccgccgaccacugcggcacagucgccaacggcguucuacaaaccuuuaugcgcauggccuggggcggcucauacaucgcccuagacucaggcagaggaagaugggacugcaucaugacuagcuaccaauaccuaaucauccaaaacacaacaugggaagaccacugccaauuuagccgcccaucccccauuggcuaccuaggccuccucucacaacgcacccgagacaucuacauaucccgacgccuucucggcaccuucaccuggacccucuccgacucugaaggcaaagacaccccaggcggcuacugccucacacgcuggaugcuaaucgaggcagaacucaaaugcuucggcaauacagccgucgccaaaugcaacgaaaaacacgacgaggaauuuugcgacaugcuccgacucuucgacuucaacaaacaggccauccaacgucuaaaagccgaagcccaaauguccauacaacucauaaacaaagccguaaacgcccucaucaacgaccaacucauaaugaaaaaccaccuccgagacauuaugggcauacccuacugcaacuacuccaaauacugguaccucaaccacaccacaaccggcaaaaccucacuccccaaauguuggcuagucucaaacggcucuuaccucaacgaaacccacuucucagacgacaucgaacagcaagccgacaacaugaucacagaaaugcuacaaaaagaauacauggaacgacaaggaaaaaccccacucggacuggucgaccucuucgucuucagcaccuccuucuaccucaucucaaucuuccuccaccugguaaaaaucccuacccaccgccacaucgucggcaaacccugccccaaaccgcaccgccuaaaccacaugggcaucugcagcugcggacuauauaaacaaccgggcgucccugucaaauggaaacgcuaa

SEQ ID NO: 3028 - RNA, 1476 nt, Artificial Sequence
  derived and/or modified CDS sequence (opt11) from Lassa virus__AIT17146__GPC
augggacaaauaguaacauuuuuccaagaagucccccaugugaucgaagaagucaugaacaucguucucaucgcccucaguauacucgcaguccucaaaggccucuacaaccucgcaaccugcggccucgucggccucguaaccuuccuccuacuaugcggccgcuccugcaccaccucucucuacaaaggcguauacgaacuccaaacccucgaacucaacauggagacccucaacaugaccaugccucuaagcugcaccaaaaacaacucccaccacuauauaauggugggcaacgaaaccggccucgaacuaacccucaccaacaccuccaucaucaaccacaaauucugcaaccuuuccgaugcccacaagaaaaaccuuuacgaccacgcccucaugagcaucaucuccacauuccaccuguccauccccaacuucaaccaauacgaagcaaugucaugcgacuucaacggcgguaaaauauccguccaauacaaucuaucacacucauacgccggcgacgccgccaaccacugcggcaccguagccaacggaguacuccaaacguucaugcguauggcauggggcggcuccuacaucgcucucgacucaggacggggcagaugggacugcauaaugaccuccuaccaauaccucaucauccaaaacaccacuugggaagaccacugcagcuucucccgccccuccccaaucggauaccuaggccuccuaucccaacgaacccgcgacaucuacaucucccgccgucuucucgguacguucaccuggacccuaagcgacuccgaaggaaaagacacucccgggggcuacugccucacccgcuggaugcucaucgaagccgaacucaaaugcuucggcaacacagccgucgccaaaugcaacgaaaaacacgacgaagaguucugcgacaugcuccgccucuucgacuucaacaaacaagcaauacagcgacuaaaagcugaagcccaaauguccauccaacucauaaacaaagccguaaacgcccuaaucaacgaccagcuaauuaugaaaaaccaccuccgagacauaaugggcauccccuacugcaacuauucaaaauacugguaccugaaucacaccaccaccggcaaaacaagccuccccaaaugcuggcucgucuccaauggcucauaccucaacgaaacacacuucuccgacgacaucgaacaacaggccgacaacaugaucacagaaaugcuucagaaagaauacauggaaagacaaggcaaaacuccccuaggccuaguggaccuuuucgucuucuccaccuccuucuaccucaucagcauuuuccuccaccucguuaaaauccccacccaccgccacauagucggaaaaagcugccccaaaccgcacagacuaaaccacaugggcauaugcuccugcggcuucuacaaacaacccggcguccccgucaaauggaaacgcuag

SEQ ID NO: 3029 - RNA, 1476 nt, Artificial Sequence
  derived and/or modified CDS sequence (opt11) from Lassa virus__AIT17154__GPC
augggccaaaucgucaccuucuuccaagaagucccccacgucaucgaagaagucaugaacauaguccucaucgcucucuccauccucgcaguccucaaaggcuuauacaauuucgcgaccugcgggaucgucggacucgucuccuuccuccuccuaugcggccguuccugcaccaccucccuauacaaaggcguauacgaauuacaaacccucgaacuuaacauggaaacacucaacaugaccaugccccucagcugcacgaaaaacaacucacaccacuacaucauggucggcaacgaaaccggucuagaacuaacccucacgaacaccucaaucaucaaucacaaauucugcaaccucucagacgcccacaagaaaaaucucuacgaccacgcccucaugucaauaaucuccaccuuccaccuguccauccccaauuucaaccaauacgaagccaugucaugcgacuucaacggcggcaaaauaucaguccaauacaaccucucccacucauacgccggcgacgccgccaaccacugcggcacaaucgccaacggaguccuccaaacauucaugcgcauggccugggguggcuccuacaucgcccucgacuccggacgcgaccgcugggacugcauuaugaccucauaccaauaccucauuauacaaaacaccacgugggaggaccacugccaauucucacgcccaucccccaucgguuaccucggacuucucagccaacgaacccgcgacaucuacaucucccgccgccuacucggaaccuucaccuggacccucuccgacagcgaaggcaaagacacccccggaggcuacugccuuacccgcuggaugcuuaucgaagccgaacucaaaugcuucgggaacacagcagucgccaaaugcaacgaaaaacacgacgaagaguucugcgauaugcuucgccucuucgacuucaacaaacaagccauccagcgacucaaagccgaagcccaaauguccauccaacucaucaacaaagcugucaacgcccucaucaacgaucaacucaucaugaaaaaccaccuacgcgauauaaugggcauccccuacugcaacuacuccaaauacugguaucugaaccacaccaccacaggcaagaccucccucccaaaauguuggcucguauccaacggcuccuaccuaaacgaaacccacuucuccgacgacaucgaacaacaggcugacaacaugaucaccgaaaugcuccaaaaagaauacauggaacggcaaggaaaaacuccccuaggccuagucgaccucuuugucuucucaaccagcuucuaccucaucucaaucuuccuccaccucgucaaaaucccgacccaccgccacgucgugggcaaaucaugucccaaaccccaccgucucaaucacaugggcaucugcuccugcggccucuacggccagcccggagucccugucaaauggaaacgauaa

SEQ ID NO: 3030 - RNA, 1476 nt, Artificial Sequence
  derived and/or modified CDS sequence (opt11) from Lassa virus__AIT17158__GPC
augggucaaaucgucacauucuuccaggaggucccccacguuaucgaagaagugaugaacaucgugcucaucgcccucagcauccucgccguccucaaaggccucuacaacuucgccaccuguggccucguuggccucguaaccuuccuccuacugugcggccgcucaugcaccaccucccucuauaaaggagucuacgaacuccaaacccucgagcuaaacauggaaacccucaacaugacaaugccucucagcugcacaaaaaacaacucccaccacuauaucauggucgggaacgagacaggacucgaacuaacucuaacgaacacuucaaucauaaaccacaaauucugcaaccuuuccgacgcccacaaaaaaaaccucuacgaccacgccuuaauguccauuaucucgaccuuucaccucagcauacccaacuucaaccaauaugaagccauguccugcgauuucaacggcggaaaaaucuccguacaauauaaccucucccacucauacgccggagacgccgccaaccacugcggcacaguugcaaacggaguccugcaaacauucaugagaauggccuggggugguagcuacaucgcccucgacagcggccgcgaccgcugggacugcaucaugacguccuaccaauaccucaucauccaaaacacaaccugggaagaccacugccaauucuccagaccaagccccaucggauaccuaggccugcucucccaacgaacacgcgacaucuacaucagccgacgccuccucgguaccuucaccuggacccucuccgauuccgagggcaaagacacacccggcggcuacugccucaccagauggaugcuuauagaagcggaacucaaaugcuucgguaacacagccguugcaaaaugcaacgaaaaacacgacgaggaauuuugcgacaugcuucgccucuucgacuucaacaaacaagcaauacaacgccuaaaagccgaagcccaaaugucuauccaacucaucaacaaagcagucaacgcccucaucaacgaccaacuaaucaugaaaaaccaccuccgcgacaucaugggcaucccuuacugcaacuauuccaaauacugguaccucaaccacaccaccaccggcaaaaccucccuacccaaaugcuggcucgucuccaauggauccuaccucaacgaaacacacuucuccgacgacaucgaacaacaagccgacaacaugaucacagaaaugcuccaaaaagaauacauggagcgacaagggaaaaccccccucggacuagucgaccucuucgucuucuccaccucuuucuacuugaucucaaucuuccuccaccucgucaaaauacccacucaccgccacaucguaggcaaaucaugcccaaaaccgcaccgccucaaccacaugggaaucugcuccugcggacucuacaaacaacccggcgucccagucaaauggaaacgcuaa

SEQ ID NO: 3031 - RNA, 1476 nt, Artificial Sequence
  derived and/or modified CDS sequence (opt11) from Lassa virus__AIT17164__GPC
augggccagaucgucaccuuuuuccaagagguaccacacgucaucgaagaaguaaugaacauuguacucauagcccucuccauccucgccguccuuaaaggccuuuacaacuucgccacaugcggccuagucgggcucgucacuuuccuccuccucugcggccgaucaugcaccagcucccucuacaaaggcguuuacgaacugcaaacccucgaacucaacauggaaacucuuaacaugaccaugccucucaguugcaccaaaaacaauucucaccacuacauccgagucgguaacgaaacaggccucgagcuaacacucacaaacacgagcaucaucgaccacaaauucugcaaccuaagcgacgcccacaagaaaaaccuuuacgaccacgcccucaugucaauaaucagcaccuuccaccucuccaucccaaacuucaaccaguacgaggcaaugucaugcgacuucaacggcggcaaaaucuccguccaauauaaccucucucacuccuacgccggcgacgccgccaaacacugcggcaccgucgcgaacggcguccuacagaccuucaugcgcauggccuggggcggcuccuacaucgcccucgacuccggccacggcaacugggacugcaucaugaccagcuaccaguacuuaaucauacaaaacaccacuugggaagaccacugccaauuuucacgccccucccccaucggcuaccucggccuccucucacaaagaacccgugacauauauaucucccgccgccuacuuggcacauucaccuggacccucuccgauucagaaggcaacgacgccccgggcggcuacugccuaacucgcuggaugcucauccaagcagagcuuaaaugcuucgggaacaccgcugucgccaaaugcaacgaaaaacacgacgaagaguucugcgacaugcuccgccuauuugacuucaacaaacaagccauccaacgacuuaaagcagaagcacaaauguccauacaacucaucaacaaagccgucaacgcccucaucaacgaucaacuaaucaugaaaaaccaccuccgcgacauaaugggaaucccuuacugcaacuacagcaaauacugguaccucaaccacaccaccaccggccgcacguccuuaccccgcugcuggcuagucucuaacggcucuuaccuaaacgaaacccacuucuccgacgacaucgaacaacaagccgacaacaugauaaccgaaaugcuacaaaaagaauacauggaacgccaaggaaaaaccccacucggccucgucgaccucuucgucuuuuccacaucauucuaccucaucuccaucuuccuccaccuagucaagauccccacccaucgccacaucgucggcaaaucaugcccuaaaccacacagacucaaccacaugggcauuuguuccuguggacuauucaaacaacccgguguuccugucaaauggaaacgauaa

SEQ ID NO: 3032 - RNA, 1476 nt, Artificial Sequence
  derived and/or modified CDS sequence (opt11) from Lassa virus__AIT17168__GPC
augggacaaaucgucaccuucuuccaggaagucccacacgucaucgaagaaguaaugaacauuguccucauagcccucucaauccucgccguacuuaaaggccucuacaacuucgccacaugcggccuagucggucugcucacauuccuccuccuaugcggacgcucaugcaccgccucccgcuacaaaggaguauacgaacuacaaacacucgaacuuaacauggaaacccugaacaugaccaugccccucucaugcaccaaaaauaacucccaccacuacaucauggucggcaacgaaaccggccuagaacucacacucaccaacacauccaucaucaaccacaaauucugcaaccucuccgacgcccacaagaaaaaccuauacgaccacgcacucaugagcauaauauccacguuucaccucuccauccccaacuucaaccaauacgaagccauguccugcgacuuuaacggcgguaaaauauccguccaauacaaccucagccacucauacgccggcgacgccgccaaccauugcgguacggucgccaacggaguccugcaaaccuucaugcgaauggcuuggggcggcuccuacaucgcccuagacucuggccacggaagcugggacugcaucaugacguccuaccaauaccucaucauacagaacacuaccugggaagaccacugccaauucagccgccccucccccauuggauaccucggccuccugucccaacgcacccgcgacauauacaucucacgacgccuccucggcacuuucaccuggacacucucagacucagaaggcaaagacacccccggaggcuacugccuaacccgcuggaugcucauagaagccgaacucaaaugcuucggaaacacugcaguagccaaaugcaacgaaaaacacgacgaagaguucugcgacaugcuacgccuguuugacuucaacaaacaagcaauccaacgccucaaagcagaagcccaaauguccauccaacucaucaacaaagccguaaacgcccucaucaacgaccaacucaucaugaaaaaccaccuccgcgacauaaugggcauacccuacugcaacuauuccaaauacugguaccuaaaccacaccacaacaggaaaaaccucgcuccccaaaugcuggcuaguauccaacggcagcuaccucaacgaaacccacuucucugacgacaucgaacaacaagcagacaacaugauaacagaaaugcuccaaaaagaauacauggaacgucaaggcaaaacaccccucggacucgucgaccuuuucguuuucucaacuuccuucuaccuaauauccaucuuccuccaccucgucaaaauaccaacccaccgacacaucguuggcaaauccugccccaaaccacaccgacuuaaccacaugggcaucugcucauguggccuauacaagcaacccggcguuccuguuaaauggaagcgcuag

SEQ ID NO: 3033 - RNA, 1476 nt, Artificial Sequence
  derived and/or modified CDS sequence (opt11) from Lassa virus__AIT17172__GPC
augggccaaaucgucacauucuuccaagaagucccccacgucaucgaagaaguuaugaacauaguacuaaucgcccucagcauacucgccguucucaaagggcucuacaacuucgccacaugcggucucgucggccucgucaccuuccuccugcugugcgggcgcucuugcaccacaucacucuacaaaggcgucuaugaacuacaaacccucgaguuaaacauggagacccucaacaugacaaugccccucuccugcaccaaaaacaacucccaccacuacaucaugguuggaaacgaaaccggccucgaacuaacucuaaccaacacauccaucaucaaccacaaauucugcaaccuauccgacgcccacaagaaaaaccuauacgaccacgcccuaaugucaaucaucucaacauuccaccucuccauccccaacuucaaccaguacgaagccaugucuugcgacuucaacggcggcaaaaucuccguccaauacaaccuaucccacaguuaugccggagacgcugccaaccacugcggaacaguugccaacggcguucuccaaaccuucaugcgcauggccuggggcggcagcuacauagcccuagacuccggccgcggccgcugggacugcauaaugaccucauaccaauaccucaucauccagaacacaaccugggaagaccacugccaauucagucgcccaagcccuaucggauaccucggccuacucucccagcgcacccgcgacaucuacaucucccgccgccucuuaggcaccuucaccuggaccuuaagugacucagaaggcaaagacacccccggcggcuacugccucacccgcuggaugcuaauagaagccgaacucaaaugcuucggcaacaccgccgucgccaaaugcaacgaaaaacacgacgaagaguucugcgacaugcuccgccucuucgacuucaacaaacaagcaauccaaagacucaaagccgaagcccaaauguccauucaacuaaucaacaaagccgucaaugcucucaucaacgaccaacucaucaugaaaaaccaccuccgcgacauaaugggcauccccuacugcaacuacagcaaauacugguaccucaaccacaccacaaccggcaaaaccucacuacccaagugcuggcucguauccaacggaucauaccuaaacgaaacccacuucucagacgacaucgaacagcaagccgacaacaugaucacagaaaugcuccaaaaagaauacauggaacgccaagguaaaacaccccucggccucguggaccucuucgucuucucaaccucauucuaccucaucuccauauuccuacaccuuguuaaaauccccacacaccgccacauagucggaaaaccaugcccacgcccacaccgccucaaccacaugggcaucugcucuugcggccucuacaaacagcccggcguacccgucaaauggaagcgguaa

SEQ ID NO: 3034 - RNA, 1476 nt, Artificial Sequence
  derived and/or modified CDS sequence (opt11) from Lassa virus__AIT17176__GPC
auggggcagaucgucaccuucuuucaagaaguaccccacgucaucgaagaagucaugaacaucguucuaaucgcacucucucuccucgcaguacuaaaaggccucuacaacgucgcaaccugcgggcucaucggcuuaaucaccuuccuccuacucugcggacgcuccugcaccaccaaccuuuacaaaggugucuacgaacuacaagcccucgaacucaacauggagacccucaacaugaccaugccccucuccugcaccaaaaacaacagccaccacuacaucaugguaggaaacgaaaccgggcucgaacucacccucaccaacaccuccaucauaaaccacaaauucuguaaccucagcgacgcccacaagaaaaaccuuuacgaccacgcacuaauguccauaaucagcaccuuccaccucagcauccccaacuucaaccaauacgaagcaauguccugcgacuucaacggaggccguaucucaguccaauacaaccucucccacucauacgccggcgacgccgcaucccauuguggcaccaucgccaacggcguccuucaaaccuucaugcguauggcuuggggcggcuccuacaucgcccuugacagcggccacggcggaugggacugcaucaugaccuccuaccaauaccuuaucauacaaaacaccaccugggaagaccacugccaauucucucgccccagcccuauaggcuaccuaggucuccucucccaacgaacccgcgauauauacaucagccgacgucuccucggcaccuucaccuggacccuauccgacuccgaaggcaaagacacccccggcggcuacugccucacccgauggaugcucaucgaagccgaacucaaaugcuucggcaauaccgccguggccaaaugcaacgagaaacacgacgaagaguucugcgacaugcuccgccucuucgacuucaacaaacaagcaauacaacgccuaaaagccgaagcccagaugucaauccaacuaaucaacaaagccgucaacgcccuaauaaacgaccagcucauaaugaaaaaccaccuccgagacaucaugggcaucccuuacugcaacuacuccaaauacugguaccuaaaccacaccgucaccggcaaaaccucucuucccaaaugcuggcucguauccaacggcuccuaccucaacgaaacccacuuuucugacgacaucgaacagcaagccgacaacaugaucaccgaaaugcuccaaaaagaauacauggaacgccaaggcaaaacaccccuaggccuagucgaccucuucguuuucuccaccuccuucuaccuuaucuccaucuuccuccaccucgucaaaaucccuacccaccgccacgucguaggcaaaccaugcccaaaaccccaccgccucaaucacaugggcaucugcuccugcggccucuacaaacaaccaggcguccccguccgauggaaacgcuag

SEQ ID NO: 3035 - RNA, 1476 nt, Artificial Sequence
  derived and/or modified CDS sequence (opt11) from Lassa virus__AIT17180__GPC
augggacaaaucgucaccuucuuccaagaagucccccacgucaucgaagaaguaaugaacauaguacucaucgcccucuccauacuagcaguccuuaaaggccuauacaacgucgcaaccugcggccucaucggccucgucacauuccuccuacucugcggacgauccugcacaacaacccucuacaaaggcgucuacgaacuccagacccucgagcucaacauggaaacccucaacaugacuaugccccucucaugcaccaaaaauaacucacaccacuacauccgagucggcaaugaaaccggccucgaacuaacccuaacgaacaccucuauaaucaaccacaaauucugcaaccucucagacgcccacaagaaaaaccucuacgaccacgcccuuauguccaucaucucaaccuuccaccucuccauacccaacuucaaccaauacgaagcaaugucgugcgacuucaacggcggaaaaaucuccguccaguacaaccugucccacuccuacgccggcgacgcggccaaccacuguggcacaguugccaacggaguacuacaaaccuucaugcgcauggcguggggcggguccuacaucgcucucgacucaggccguggcaacugggacugcaucaugaccuccuaccaauaccuaaucauccaaaacaccacuugggacgaccacugccaauucucccgacccucgcccaucggcuacuuaggccuacucucccaacgaacccgcgacgucuacaucucccgucgccuacuaggcaccuucaccuggacccucucugacucugaaggcaaagacacccccgggggauacugccucaccagauggaugcuuaucgaagcagaacucaaaugcuucggcaacacagccgucgccaagugcaacgaaaaacacgacgaagaguucugcgacaugcuccgccuauucgacuuuaacaagcaagccauacaacgccucaaagcagaagcccagauguccauccaacucauaaacaaggccgucaacgcucuaaucaacgaccaacuaauaaugaaaaaccaccuccgcgacaucaugggaauaccauacugcaacuacagcaaauacugguaccuuaacaacacugcaaccggcaaaacaucccuccccaaaugcuggcucaucuccaacggcuccuaccucaacgaaacccacuuuuccgacgacaucgaacaagaagccgacaacaugaucaccgaaaugcuccaaaaagaauauauggaacgccaaggcaaaaccccacucggccucgucgaccucuucgucuucuccacaucauucuaccucauuuccauauuccuacaccuaguaaagauccccacccaccgccauauagucggaaaaucaugcccuaaaccccaccgacucaaccacaugggcaucugcuccugcggccuuuacaaacaacccggaguucccguccgcuggaaacgauaa

SEQ ID NO: 3036 - RNA, 1476 nt, Artificial Sequence
  derived and/or modified CDS sequence (opt11) from Lassa virus__AIT17184__GPC
auggggcagaucguuacuuucuuccaagaagucccccacguaaucgaagaaguaaugaacaucguccucauagcccucucaauccuagccguccugaaaggccucuacaacguagccacaugcggacucauaggacuggucacauuccuccugcucugcggccggucaugcaccacaacacucuacaaagggguuuacgaacuccaagcccuagaacuaaacauggaaacccucaacaugaccaugccucuauccugcaccaaaaacaacucccaccacuacauacgcguaggaaacgaaaccggccuagaacuaacccuuacuaacacauccaucaucgaccacaaauucugcaaccuaucagacgcccauaaaaaaaaccuauacgaccacgcacuaauguccauaauauccaccuuccaccucuccauccccaacuucaaccaauacgaagccauguccugcgacuucaacgguggcaaaaucagcguacaauacaaccucucccacagcuacgccggcgacgcagcaaaccacugcggcaccgucgccaacggcguccuccaaaccuucaugcgaauggcuuggggcgggucauacaucgcacucgacucuggacgcaacggcugggacugcaucaugaccucauaccaauauuuaaucauucagaacaccaccugggacgaccacugccaauucucgcgccccucccccauuggcuaccucggccuucucucccaacgaacccgugacaucuacauaucccgcagacuacucggcaccuucacuuggacucuaagcgacuccgaaggaaaagacacccccggcggcuacugccugacccgcuggaugcuaauagaagcugaacuaaaaugcuucggaaacaccgccguagccaagugcaacgaaaaacaugacgaagaauuuugcgacaugcuccgccuguucgacuucaacaaacaagccauuagacgccuuaaagccgaagcacaaauguccauucagcucaucaacaaagccgucaacgcccucauaaacgaccaacucaucaugaagaaccaccuccgcgacauaaugggcaucccuuauuguaacuacagcaaauacugguaccugaacaacaccgcaacaggaaaaaccucacucccccgcugcuggcucgucagcaacggcuccuaccucaacgaaacucacuucuccgacgacaucgaacaacaagccgacaacaugauaaccgaaaugcuccaaagagaauacauggaacggcaaggcaaaaccccccucggccucgucgaccucuucgucuucucaaccucauucuaccucaucuccaucuucuuacaccuaguaaaaauaccaacacaccgccacaucgucggcaaacccugccccaaaccccaccgacucaaccacaugggcaucugcuccuguggccucuacaaacaacccggcguucccgucaaauggaaacgcuaa

SEQ ID NO: 3037 - RNA, 1476 nt, Artificial Sequence
  derived and/or modified CDS sequence (opt11) from Lassa virus__AIT17188__GPC
augggacaaaucguaaccuucuuccaagaaguaccacacgucauugaagaaguaaugaacaucguacucaucgcccucuccaucuuagccguccucaaaggccucuacaacuucgcaaccugcggcuucguaggccucgucucauuccuccuccuaugcggccgaucaugcaccaccucccucuacaaaggaguuuacgaacuccaaacccucgaacucaauauggaaacccucaacaugaccaugccccucuccugcaccaaaaauaacucccaccacuacaucauggucggcaacgagaccggccucgaacuaacccucacaaacaccuccaucauaaaccacaaauucugcaaucucucagacgcccacaagaagaacuuauacgaccacgccuuaauguccaucauaucaaccuuccaccucuccaucccaaacuuuaaccaauacgaagccauguccugcgacuuuaacggcggcaaaaucuccguccaauacaaccucucacacagcuacgcugucgacgccgccaaccacugcggcaccguagccaacgggguacuucaaaccuucaugagaauggcauggggcggaucuuacaucgcccuugacuccggacacggcucaugggauugcauaaugaccuccuaccaauaccucaucauccagaacacaaccugggaagaccacugccaauucucccgccccagccccauaggcuaucugggacuccuaucccaacgaacccgagacaucuauaucucccgcagacuacucggcacauucaccuggacccuaagcgacagcgaagguaaggacacccccggcggauacugccucacccgcuggaugcucaucgaggcugaacucaaaugcuucggaaacaccgccgucgccaaaugcaacgaaaaacacgacgaagaguucugugacauguuacgccuauucgacuucaacaagcaagccauccagcgacuacgcgccgaagcucaaaugagcauacaacucaucaauaaagcagucaacgccuuaauaaacgaccaacuaaucaugaagaaccaccuacgagacaucaugggcauccccuacugcaacuacagcaaguacugguaccucaaccacacuacgaccggacgcaccucccuacccaagugcuggcuaguauccaacggcuccuaccucaacgaaacccacuucucagacgacaucgaacaacaagccgacaacaugaucacagaaaugcuccaaaaagaauacauggaacgccaaggaaaaacaccccucggccucgucgaccucuucgucuucuccaccuccuucuaccuaaucuccaucuuccuccaccucgucaaaauccccacccaccgccacaucgucggaaaaucgugcccaaagccacaccgccucaaccacaugggcauaugcucaugcggccucuacggacaacccggagucccagucaaauggaaacgcuaa

SEQ ID NO: 3038 - RNA, 1476 nt, Artificial Sequence
  derived and/or modified CDS sequence (opt11) from Lassa virus__AIT17192__GPC
auggggcaaauaguaaccuucuuccaagaaguuccccacgucaucgaggaagucaugaacauaguccucauagcccucuccauucucgccguccucaagggacucuacaacuucgcaaccugcggcuucauaggccuaguaucauuccuacuucuaugcggccguucauguaccaccucccucuacaaaggcgucuacgaacuacaaacccucgagcucaacauggaaacacuaaacaugaccaugccacucagcugcaccaaaaacaacagccaccacuauaucauggucgguaacgaaaccggacuagaacucacccucaccaacaccuccauaaucaaucacaaauucugcaaccuaucagacgcccacaagaaaaaucucuacgaccacgcccucauguccauuaucuccaccuuccaccucagcauccccaacuucaaccaauucgaggccauguccugcgauuucaacggcggcaaaaucuccguccaguacaaccucagucacuccuacgccguagacgccgccaaccacuguggaaccgucgccaacggaguccugcaaaccuucaugcgcauggccuggggaggcuccuacaucgcccuagacucaggacacggcagcugggauugcaucaugaccuccuaccaauaccucaucauccaaaacaccacaugggaagaccacugccaguucucccgaccaucccccaucggcuaccucggauuauuaucccaacggacacgcgacauauacaucucccggcgccuccucggcaccuucaccuggacccuuucagacuccgaaggcaaagacaccccagggggauacugccuaacacgcuggaugcucaucgaagccgaacucaaaugcuucggcaacaccgccguagccaaaugcaacgagaaacacgacgaagaguucugcgacaugcuacgccucuucgacuucaacaaacaagccauccaacggcuaaaagccgaagcacaaaugucuauacaacuaaucaacaaagccguaaacgcccuaauuaacgaccaacuuaucaugaaaaaccaccuacgagacaucaugggaauccccuacugcaacuacagcaaauacugguaccuaaaccacaccacuacaggccgcaccucacuccccaaaugcuggcucguaucaaacggcucauaccuaaacgaaacccacuucucagacgacaucgaacaacaagccgauaacaugaucaccgaaaugcuccaaaaagaauacauggaacgucaaggcaaaacuccccucggccuagucgaccuauucgucuucucaaccuccuucuaucuaaucucaaucuuccuccaccucgucaaaauacccacccacagacacaucgucggcaaauccugucccaaaccccaccgacucaaccacaugggcaucugcucaugcggccucuacggccagccuggaguccccgucaaguggaaacgcuaa

SEQ ID NO: 3039 - RNA, 1476 nt, Artificial Sequence
  derived and/or modified CDS sequence (opt11) from Lassa virus__AIT17196__GPC
augggacaaaucgucacuuucuuccaagaggucccccacgucaucgaagaagucaugaacaucguccuaaucgcccuauccauccuagccguccuaaaagggcucuacaaccucgcaacaugcggccucgucggccucgucacauuccuucuccucugcggccgcucaugcaccaccucccucuacaaaggcguauacgaacuccaaacauuagaacucaacauggaaacccuuaacaugaccaugccccuguccugcaccaaaaacaacucucaccacuacaucauggucggcaacgaaaccggccucgagcugacucucacaaacaccucaaucaucaaccauaaauucuguaaucucucagacgcacacaagaaaaaccuauacgaccacgcccucaugucaaucaucuccaccuuccaccuauccauucccaacuucaaccaguacgaggccaugucaugcgacuucaacggcggcaaaaucuccguucaauacaaccucucacacuccuacgccggcgacgccgccaaccacugcggcacagucgcuaacggaguccuccaaaccuucaugcgcauggccuggggcggcucauacaucgcucucgacucaggccgaggaagaugggacugcauaaugaccuccuaccaauaccuaaucauccaaaacacaacaugggaagaccacugccaauucucccggcccuccccaaucggcuaccuaggccuccucucccagagaacccgcgacaucuacaucuccagacgccuccuaggcaccuucaccuggacccugucagacucagaaggcaaagacacccccgggggcuacugucucacccgcuggaugcucauugaggcagaacucaaaugcuucggcaauaccgccgucgccaaaugcaacgagaaacacgacgaagaguucugcgacaugcuacgacucuucgauuucaacaaacaagcaauccaacgccuaaaagcagaagcacaaaugaacauccaacuaaucaacaaagcggucaacgcccucauuaacgaccaacucaucaugaaaaaccaccuccgagacaucaugggcauccccuacugcaacuacuccaaauacugguaucuaaaccacaccacaacaggcaaaacuagccucccccggugcuggcuugucagcaacggcucauaccucaacgagacccauuucuccgacgacauagaacaacaagccgacaacaugaucaccgaaaugcuacaaaaagaauacauggaacgucaaggaaaaacaccccucggccucgucgaucucuucgucuucucaaccuccuucuaccuaaucucaaucuuccuccaucucgucaaaauacccacacaccgccauaucgucggcaaacccugcccaaaaccccacagacuuaaccacaugggaauaugcuccugcggcuucuacaaacaacccggcguacccgugaaauggaaaagauaa

SEQ ID NO: 3040 - RNA, 1476 nt, Artificial Sequence
  derived and/or modified CDS sequence (opt11) from Lassa virus__AIT17204__GPC
augggacaaauagucaccuucuuccaagaaguaccccacgucaucgaagaagucaugaacaucguacucaucgcccucuccauccuagcaguccucaagggccuauauaaccucgcaaccugcggccucgucggccucguaaccuuccuacuacuaugcggccgcagcugcaccuccucccucuacaaaggagucuacgaacuacaaacccucgaacucaacauggagacccucaacaugaccaugccccucuccugcaccaaaaacuccucccaucacuacauucgcgucggcaacgaaaccggacucgaacucacacucaccaacacauccauuaucaaccacaaguucugcaaccucagcgacgcucauaaaaagaaccuauacgaccacgcccucauguccaucauaagcacauuucaccucuccauccccaacuucaaccaguacgaagccauguccugcgacuucaacggcggcaaaaucucuguccaauauaaccucucccacucauaugccggugacgcagcaaaccacugcggaaccgucgccaacggaguccuacagaccuucaugcgaauggcauggggcggcuccuacaucgcacucgacuccggacacgaccguugggauugcaucaugaccuccuaucaauaccucauaauccagaacaccaccugggaggaccacugccaauucucccgcccuuccccaauaggauaccuuggccuccucucccaacgcacccgggacaucuacaucucccgccgccuucucggcaccuucacuuggacccuauccgacuccgagggcaaagacacacccggaggcuacugccuuacccgguggaugcuuauugaagcagaacugaaaugcuucggcaacaccgccguagcuaaaugcaacgaaaagcacgacgaagaguucugugauaugcuccgccucuucgacuucaacaaacaagccauccagagacucaaagcugaggcccagauguccauccaacucaucaacaaagccgucaacgcccuaaucaacgaccaacucaucaugaaaaaccaccuccgcgacaucaugggcauucccuacugcaauuacuccaaauacugguaccuuaaccacaccauaaccggcaaaaccucccugcccaaaugcuggcucgucuccaacggcagcuaccuaaacaaaacacacuucuccgacgacauagaacaacaagccgacaacaugaucaccgagaugcuccaaaaagaauauauggaacggcaaggcaaaacaccccucggccuugucgaccuauucguauucucuacuuccuucuaccuaaucuccaucuuccuccaccucaucaaaauccccacccaccgccacaucgucggcaagcccugcccuaaaccgcaccggcucaaccacaugggcaucugcuccugcggccucuacaaacaacccggcgucccagucaaauggaaacgcuaa

SEQ ID NO: 3041 - RNA, 1476 nt, Artificial Sequence
  derived and/or modified CDS sequence (opt11) from Lassa virus__AIT17208__GPC
augggacaaauuguuaccuucuuccaagaagucccacacgucaucgaagaagucaugaauaucguacuaauugcccucucaauccuagcaguacuaaaagggcuuuacaacuucgcaaccugcggccucauuggccucguaaccuuccuccuacugugcggacgaucaugcaccaccagccuuuacaaaggcgucuacgaacuccaaacccucgaacucaacauggaaacccucaacaugaccaugccacugagcugcaccaagaacaacucacaccacuacauaauggucggcaacgagaccggccucgaacucacgcucacaaacaccucaauaaucaaccacaaauucugcaaccuaagcgacgcccacaagaaaaaccucuacgaccacgccuuaauguccaucauuuccaccuuccaccucuccauacccaacuucaaccaauacgaagccaugucaugugacuucaacggcggcaaaauauccguacaauacaaccucagccacuccuacgcaggcgacgccgccaaccacugcggcaccgucgccaacggcguccuucaaacuuucaugcguauggccuggggaggaagcuacauagcccuggacucgggccgcggacaaugggacugcaucaugaccuccuaccaauaucucauuauccaaaacaccaccugggaagaccacugccaauucucccgccccucccccaucggcuaccucggacuacuaagccaacgcacccgcgacaucuacaucucccgucgacuccucggcacauucaccuggacccuauccgacagcgaaggcaaggacacaccaggcggcuacugccucacccgauggaugcuuaucgaagccgagcucaaaugcuucggaaacaccgcagucgccaaaugcaacgaaaaacaugacgaagaguucugcgacaugcuccgucucuucgauuucaacaaacaagccauccaacgacuuaaggccgaagcccaaaugagcauccaacuaaucaauaaagcaguuaacgcccucaucaacgaccaacuuaucaugaaaaaccaccucagagacauaaugggcauacccuacuguaacuacucaaaauacugguaucucaaccacacaaccaccggaaaaacaagccuacccaaaugcuggcuaguguccaacggcuccuaccugaacgaaacacacuucuccgacgacaucgaacaacaagcagacaacaugaucacagaaaugcuccaaaaagaauacauggaacgccaaggcaaaacgccacuaggccucgucgaccucuucgucuucuccaccuccuucuaccucaucucaaucuuccuacaccucgucaagauccccacacacagacacaucgucggcaaauccugcccaaaaccacaccgacucaaccacaugggcauauguagcugcggacucuacaaacagcccggcguccccgucaaauggaaacgcuaa

SEQ ID NO: 3042 - RNA, 1476 nt, Artificial Sequence
  derived and/or modified CDS sequence (opt11) from Lassa virus__AIT17210__GPC
augggccaaaucgucaccuucuuccaagaagucccccacguaauagaagaaguaaugaacaucguccucaucgcgcuauccauacucgccguucucaaaggccuuuacaaccucgcuaccugcggccuaguaggccuagucacauuccuucuccucugcggccgcuccugcacaaccucacucuacaaaggcgucuaugaacuccaaacccucgaacuaaacauggaaacccuaaacaugaccaugccccuaucaugcaccaaaaacaacucacaccacuacaucauggucggaaacgaaaccggacuagaacucacccucacgaacaccuccaucaucaaccacaaguucugcaaccucagcgacgcccacaaaaagaaccucuacgaccacgcccucauguccaucauaucaacauuccaccucuccaucccaaauuucaaccaauacgaagcaauguccugcgacuucaauggcgguaaaaucaguguccaauacaaccucucacacuccuacgccggcgacgcagccaaccacugcggcacagucgccaacggaguccuccaaaccuucaugcgaauggccuggggcggaagcuacaucgcccucgacucaggccgcgaccgcugggacugcaucaugacaucauaccaauaccuaaucauacaaaacaccaccugggaagaccacugucaauucucccgccccuccccuaucggcuaccucggccuccucucacaacgaacccgcgacaucuacauaucacgccgcuuacucggcaccuuuaccuggacucucuccgacuccgaagguaaagacacccccggcggcuacugcuuaacccgcuggaugcuaaucgaggccgaacuaaaaugcuucggcaacacagcggucgccaaaugcaacgaaaaacacgacgaagaguucugcgacaugcuccgccucuucgacuucaacaagcaagcuauccagcgacuaaaagcagaagcccaaauguccauccaacugaucaacaaagcagucaacgcccuuaucaacgaccaacucaucaugaaaaaucaucucagggacauaaugggaauaccauacugcaacuacuccaaauacugguauuuaaaccacaccacaaccggcaaaaccucacuacccaaaugcuggcuagucagcaacggcuccuaccuaaacgaaacccauuuuuccgacgacaucgaacaacaagccgacaacaugaucacagaaaugcuacaaaaggaauacauggaaagacaaggaaaaacaccccucggacuugucgaccuuuucguauucagcaccuccuucuaccucaucuccaucuuccuccgccucgucaaaaucccuacccaucgacacaucgucggcaaaccaugccccaaaccacaccgccucaaccacaugggcaucugcucaugcggacuuuacaaacaacccggaguaccagucaaauggaaacgcuaa

SEQ ID NO: 3043 - RNA, 1476 nt, Artificial Sequence
  derived and/or modified CDS sequence (opt11) from Lassa virus__AIT17212__GPC
augggccaaaucgucaccuucuuccaagaagucccacacguaaucgaagaagucaugaacaucguccugaucgcccucuccauccucgcuguccucaaaggccucuacaaccuagccacaugcggucuggucggccucgucaccuuccuacuacucugcggccgcuccugcaccaccucccucuacaaaggcguauacgaauuacaaacacucgaauuaaacauggaaacccuaaacaugaccaugccccuauccugcaccaaaaauaacucacaccacuacaucauggucggcaacgaaacgggccuugaacuaacgcuuacaaacacauccaucaucaaccacaaguucuguaaccucuccgacgcacaccgcaaaaaccuuuacgaccacgcucucaugucaauaaucuccaccuuucaccucuccauccccaacuucaaccaguacgaagccaugucuugcgacuucaacggcgguaaaaucuccguacaauacaaucucucucacuccuacgcaggcgacgccgcuaaucacugcggcacaguagccaauggcguacuccaaaccuucaugcgaauggccuggggcggguccuacaucgcucuagacuccggacggggcaaaugggacugcauaaugacauccuaucaauaccuuaucauacaaaacaccaccugggaagaccacugccaauucucccgaccgucccccaucggcuaccucggccuccuaucccaacgaacccgagacaucuacaucucccgccgccuccucggaacuuucacauggacacuauccgacuccgaaggcaaagacacccccggaggauauugccucacucgcuggaugcuaauagaagccgaacucaaaugcuucggcaacacagccgucgccaaaugcaacgaaaaacacgaugaagaguucugcgacaugcuccgccucuucgacuuuaacaaacaagccauacaacgccugaaagccgaagcacaaaugucgauccaacuuaucaacaaagccgucaacgcacucauaaacgaccaacugaucaugaaaaaccaccuccgugacaucaugggcaucccauacugcaauuacuccaaauacugguaccucaaccacaccacaacuggcaaaaccucccuaccucguugcuggcuggucuccaacggaucauaccucaacgaaacccauuucuccgacgacaucgaacaacaagccgacaacaugaucaccgaaaugcuucaaaaagaauacauggaacgacaggguaagaccccacucggccucgucgaccuauucgucuucucaaccuccuucuaccucaucuccaucuuccuccaccuagucaagauccccacccacagacauauaguagguaaacccugcccuaaaccccaccgacucaaccacaugggcaucugcuccugcggccucuacaaacaacccggcguccccguaaaauggaaacgauaa

SEQ ID NO: 3044 - RNA, 1476 nt, Artificial Sequence
  derived and/or modified CDS sequence (opt11) from Lassa virus__AIT17216__GPC
augggacaaaucguaaccuucuuucaagaaguaccucacgucaucgaagaagucaugaacaucguccuaaucgcccuauccauccucgccguccuaaaaggccuauacaacuucgccacaugcggccucguuggccucgucacauuccuacuccucuguggccgcuccugcaccaccucacucuacaaaggagucuacgaacuccaaacccuagaacucaacauggaaacccucaacaugaccaugccccucucaugcaccaaaaacaacucucaccacuacaucauggucggcaacgaaaccggacuagaacucacccucaccaauacauccaucaucaaccacaaguucugcaaccucagcgacgcccacaagaaaaaccuauacgaccaugcccugauguccauaaucucaacauuccaccucucuauacccaacuucaaccaauacgaagccauguccugcgacuucaacggaggaaaaaucucaguacaauacaaccucucccacucauacgccggcgacgcagccaaccacugcggcaccguugccaacggaguccuccaaacauucaugcgcauggccuggggcggcuccuacaucgcucuugacuccggccacggccgcugggacugcaucaugaccucauaucaauaccucaucauccaaaacacaacaugggaagaccacugccaauucagcagaccaucacccaucggauaccuaggacuccucucacaacgcacccgggacaucuacaucucucgccgccuacucggcaccuucaccuggacguugucugacuccgaaggcaaagacacccccggcggcuacugccuaacacgcuggaugcucauagaagccgaacuaaaaugcuucggcaacacagccgucgcaaaaugcaaugaaaaacacgacgaagaguucugcgacaugcucagacucuucgacuucaacaaacaagccauccagcgacucaaagccgaagcccaaauguccauccaacucaucaauaaagcagucaacgcccucaucaacgaccagcucaucaugaaaaaccaccuccgcgacaucaugggaaucccauacugcaacuacuccaaguacugguaccucaaccacacaaccaccggaaaaacaagccuccccaagugcuggcuagucuccaacggcuccuaccucaacgaaacacacuucucagaugacaucgaacaacaggccgacaacaugauaaccgaaaugcuccaaaaagaauacauggaacgccagggcaaaacaccccuuggccucguagaccucuucgucuucucaaccagcuucuaccuaaucuccaucuuccuccaccuaguaaaaauacccacccaccggcacaucguaggaaaacccugccccaagccccaccgccucaacuacaugggcauauguuccugcggacucuacaagcaacccggaguacccguacgauggaaacgguag

SEQ ID NO: 3045 - RNA, 1476 nt, Artificial Sequence
  derived and/or modified CDS sequence (opt11) from Lassa virus__AIT17224__GPC
augggacaaaucgucaccuucuuccaagaaguaccccauguaaucgaagaaguaaugaacaucguccuaaucgcccucucaaucuuagccguccugaaaggccuauacaacgucgcaacaugcggacucaucggccuuguaaccuuccuccuccugugcggacgcuccugcaccaccacacuauacaaaggcguauaugaacuccaagcccucgaacuaaacauggaaacccuaaacaugacaaugccacuauccugcacuaaaaauaacagccaccacuacauccgagucggcaacgacacaggucucgaacucacacucacaaacaccuccaucauccaacacaaauucugcaaccucagcgacgcccacaagaaaaaccuauacgaccacacucuuauguccaucaucuccaccuuccaccuuuccauucccaacuucaaccaauacgaagccaugucaugcgacuucaacggaggcaaaauaucgguccaguacaaccuaucccacucauacgccggcgacgccgccucacacugcggcaccgucgcaaacggaguccuacaaaccuucaugcgaauggccuggggcgguuccuacaucgcgcucgacagcggccgcggcaacugggacugcaucaugaccucauaccaauaccucaucauccaaaacaccacaugggaagaccacugccaauucucccgacccuccccaaucggcuaucuaggacuacuaucccaacggacccgcgacauauacaucucccgccgccuccucggcacauucacauggacccuguccgacucugaaggccgcgacacccccggcggcuauugccucacccguuggauguuaaucgaggccgaacucaaaugcuucggcaacacagcagucgcuaaaugcaacgaaaaacacgacgaagaguucugcgacaugcuaagacuauucgacuucaacaaacaagccauccaacgacuaaaaaccgaagcccaaaugagcauccaacuuauuaauaaagccguaaacgcacuaaucaacgaccaacuaauaaugaaaaaccaccuccgagacaucauggguauccccuacugcaacuacucaaaguacugguaccucaacaacaccauaaccggcaaauccagccuccccaaaugcuggcucgucuccaacgguagcuaccucaacgaaacacacuucuccgacgacaucgaacaagaagccgacaacaugaucaccgaaaugcuacaaaaagaauacauggagcgccaaggcaaaaccccacuaggccuagucgaccucuucgucuucuccacuuccuucuaccucauuuccaucuuccuccaccucguaaaaauccccacccaccgccacaucguaggaaaacccugccccaaaccccaccgacucaaccacaugggaguaugcucaugcggccucuacaaacaacccggcgucccaguccgauggaagcguuaa

SEQ ID NO: 3046 - RNA, 1476 nt, Artificial Sequence
  derived and/or modified CDS sequence (opt11) from Lassa virus__AIT17228__GPC
augggacaaaucguaacauucuuccaagaagucccccacgucaucgaagaagugaugaacauaguccucaucgcccucuccauccuagccguccucaaaggccucuacaacuucgcaaccugcggccuugucggccuacucaccuuucuccuccuaugcggccgcuccugcacaaccucgcuuuacaaaggcgucuacgaacugcaaacccuggaacucaacauggaaacacuuaacaugaccaugccacuauccugcaccaaaaacaacucccaucacuacaucauggucggcaacgaaaccggccucgaacuaacacuaaccaacaccuccauaauagaucacaaauucugcaaccuauccgacgcccacaaaaagaaccucuacgaccacgcacucauguccaucaucuccacauuccaccucuccauaccaaacuucaaccaauacgaagccaugucaugcgacuucaacggcggaaaaaucuccguccaauacaaccuaucccacuccuacgccggcgacgcagccaaccacugcggcacagucgccaacggagugcuacaaaccuucaugcguauggccuggggcggcucauacaucgcccucgacucaggccgcggcggcugggacugcaucaugaccucuuaccaauaccucaucauccagaacaccaccugggaagaccacugccaguucucacgccccucccccauaggauaccuaggacuccucucacaacgcacccgcgacaucuacaucagccgccgccuucucggaaccuucacauggacucucuccgacucugagggaaaggacacccccggcggcuacugccucacccgcuggaugcucaucgaagcagaacucaaaugcuucggcaacacagccgucgccaaaugcaacgaaaaacacgacgaagaguucugcgacaugcugcgccucuucgacuucaacaaacaagccauccaacgccucaaagcagaagcccaaauguccauucaacucaucaacaaggcuguaaacgcucuaaucaacgaccaauuaaucaugaaaaaccaccuccgcgacauaaugggcauucccuacugcaacuauaguaaauacugguaccuaaaccauaccacaaccggaaaaaccagccuacccaaaugcuggcuagucucaaacggcuccuaccuaaacgaaacacacuucagcgacgacauagaacaacaagcagacaacaugaucacagaaaugcuccaaaaagaauacauggaacgccaaggaaaaacuccccuaggacucguagaccucuucgucuucuccaccuccuucuaccugaucuccauauuccuacaccucgucaaaaucccaacacaccgccacaucgucgguaaauccugccccaaaccccaccgacuaaaccacaugggcaucugcagcugugggcucuacaagcagcccggggucccagucaaauggaaacgcuga

SEQ ID NO: 3047 - RNA, 1476 nt, Artificial Sequence
  derived and/or modified CDS sequence (opt11) from Lassa virus__AIT17232__GPC
augggccagaucgucaccuucuuccaggaaguaccccacgucaucgaagaaguaaugaacaucguccuaaucgcccuuuccauccuagccguccucaaaggccucuacaacuucgccacaugcggccucguaggccucgucaccuucuuacuacucugcggacgcuccugcaccaccucacuauacaaagguguuuacgaacuucaaacccucgaacucaacauggaaacccucaacaugaccaugccacucuccugcaccaaaaacaacagccaccacuacauccgcgucggcaacgaaacaggccucgaacucacccuaacaaacacgagcaucaucaaccauaaauucugcaaccuaagcgacgcacacaagaaaaaccucuacgaccacgcccucaugucaaucaucuccacauuccaccucuccauccccaauuucaaccaauacgaagccauguccugcgacuucaacgaaggcaaaaucagcguccaauacaaccucucccacucauacgccggcgacgccgccaaccacugcggcaccguggccaacggcguacuccaaaccuucaugcguauggcuuggggcggcuccuacaucgcucuagacuccggacguggcaaaugggacugcaucaugaccuccuaccaguaccucaucauccaaaacacaacuugggaagaccacugucaauucuccagacccuccccgaucgguuaccucggccugcugucacaacguacccgcgacauauacaucucccgccgucuacucggcaccuucaccuggacccucagcgacuccgaaggcaaagacacccccgggggcuacugccuaacacguuggaugcuaaucgaagccgaacuaaaaugcuucggcaacacagcagucgcaaaauguaacgaaaaacacgacgaagaguucugcgacaugcuccgccucuucgacuucaacaaacaagcgaucgaacgacucaaagccgaagcucaaauguccauccaacucaucaacaaagcugucaacgcccucaucaacgaccaacucaucaugaaaaaucaccucagagacaucaugggcauacccuacugcaacuacuccaaauacugguaccucaaccacaccacuaccggcaaaaccucacuacccaaaugcuggcucgucagcaacggaucauaccuaaacgaaacccacuucucagacgacauagaacaacaagccgacaacaugauaaccgaaaugcuacaaaaagaauacauggagcgucaaggaaaaacaccacuaggccuagucgaccucuucgucuucuccaccucauucuaccucauauccauauuccuacaccuugucaaaauucccacccaccgccacauuguaggaaaaucaugccccaaaccccaccgccugaaccacaugggcaucuguuccugcggacucuacaaacaacccggagucccugucaaauggaaacgcuag

SEQ ID NO: 3048 - RNA, 1476 nt, Artificial Sequence
  derived and/or modified CDS sequence (opt11) from Lassa virus__AIT17236__GPC
augggccagaucgucaccuucuuccaggaagucccacacgucaucgaagaagucaugaacaucguccuaaucgcgcucuccauccucgcaguacucaaaggccucuacaacuucgcaaccugcggccucguuggccucguaacuuuccuucuucuaugcggacgauccugcaccacaucccucuacaaaggagucuacgaacuccaaacccuggaauuaaacauggaaacccucaacaugaccaugccacuauccugcaccaaaaacaacucccaccacuacaucauggucggaaacgaaacaggccuggaacuuacacucacaaacaccuccaucaucaaccacaaauucugcaaccuaucagacgcccacaagaaaaaccuauacgaccacgcccugauguccaucaucuccaccuuccaucuaucuauaccuaacuuuaaccaauacgaagccauguccugcgacuucaacggcggccgcaucucaguccaguacaaccucucccacucauacgccggcgaagccgcaaaccacugcggcacaguagcaaacggcguccuccaaaccuucaugcgcauggccuggggcggcucauacauagcccuagacucaggccgcggcaaaugggacugcauaaugaccucuuaccaauaccuaaucauccaaaacaccaccugggaagaccacugccaauucagccgcccauccccaaucggcuaccucggucuccucucacaaagaacccgcgacaucuacaucucccgccgccuccucggcaccuucaccuggaccuuaucagauuccgaaggcaaagacacccccggcggauacugccucacacgauggaugcucaucgaagcagaacuuaaaugcuucggcaacaccgcagucgccaaaugcaacgaaaaacacgacgaagaauuuugcgauaugcuccgccuauucgacuucaacaaacaggccauccaacgccucaaagcagaagcccaaaugagcauacaacucauuaacaaagcaguaaacgcccucaucaacgaccaacucaucaugaagaaucaccuccgcgacauuaugggaauaccauacugcaacuacucccgcuacugguaccucaaccauaccaccaccggcaaaacuucccuccccaaaugcuggcucguauccaacggauccuaccucaacgaaacccacuucucagacgacaucgaacaacaagcggacaacaugauuaccgaaaugcuucagaaagaauacauggaacgucaaggcaaaaccccacuaggccuagucgaccuauucgucuucagcacauccuucuaccuuaucucaaucuuccuucaccuugucaagauccccacccaccgccacauagucggcaaaagcugccccaaaccccaccgacucaaccacaugggcaucugcucaugcggucucuacaaacaacccggagucccagucaaauggaaacgcuaa

SEQ ID NO: 3049 - RNA, 1476 nt, Artificial Sequence
  derived and/or modified CDS sequence (opt11) from Lassa virus__AIT17240__GPC
augggccaaaucgucaccuucuuccaagaagucccacacguuaucgaagaggucaugaacaucguccucaucgcccucuccauccucgcaguacucaaaggacuguacaaccuggcgaccugcggacucgucggccuggucaccuuccuccuacucugcgguagauccugcacaaccucccucuacaaaggcuucuaugaacuccaaacccucgaacucaauauggagacacucaacaugaccaugccccuguccugcaccaaaaacaacucacaucacuacauccgcguaggcaacgagaccggucucgaacuaacacucaccaauacauccaucaucgaccacaaauucugcaaccuaagcgacgcccacaaaaagaaccuguacgaccacgcccucaugagcaucaucuccaccuuccaccucagcauacccaacuucaaccaauacgaagcaaugucaugcgacuucaauggaggcaaaaucuccguccaauauaaccuaucccacagcuacgccggugacgcagccaaucacugcggcacggucgccaacggcguccuccaaacauucaugcgcauggcauggggcggcucauacaucgcccucgacuccggacgcggacgcugggacugcaucaugaccuccuaucaguaccugauaauacaaaacaccaccugggaggaucacugccaauucucgagaccaucccccaucggcuaccuaggccuccucucacagaaaacccgagacaucuacauaucccgccgccuccucggcaccuuuaccuggacccucucggacucagaaggcaaagacaccccaggcggcuacugccucacccgauggaugcucaucgaagcagaacuaaaaugcuucggcaacaccgccgucgcaaaaugcaacgaaaaacacgaugaggaguucugcgacaugcuccgccucuucgacuuuaacaaacaagccauacaacgccucaaagccgaagcccaaauguccauccaacuaauaaacaaagccguuaacgcacuaaucaacgaccaacucaucaugaagaaccaccuacgagacaucaugggcauccccuacugcaacuacuccaaauacugguaccucaaccacacgaccaccggcaaaacuucacucccuaaaugcuggcucgucuccaacggcuccuaccuuaacgaaacacacuucucagacgauaucgaacaacaagccgacaacaugaucaccgaaaugcuacagaaagaauacauggaacgacaaggcaaaaccccacucggccucgucgaccuauucgucuucuccacuucauucuaccuuaucuccauauuccuacaccuagucaaaauccccacccaccgacacaucgucgguaaaucaugccccaaaccccaccgccuaaaccacaugggcaucugcuccugcggccucuacaaacaacccggcguccccgucaaauggaagagauaa

SEQ ID NO: 3050 - RNA, 1476 nt, Artificial Sequence
  derived and/or modified CDS sequence (opt11) from Lassa virus__AIT17244__GPC
augggccaaaucgucacauucuuccaagaagucccccacguuaucgaagaagucaugaacaucguccucauagcccucucuauacucgcaguccucaaaggccuauacaaccuugccacaugcggccucgucggccuagucaccuuccuccuccuaugcggacgauccugcacaaccaaucucuacaaagggguauacgaacuacaaacacuugaacuaaacauggaaacccucaacaugaccaugccccuuucaugcaccaaaaacucgucccaccacuauauacgcgucggcaacgaaaccggccucgaacucaccuuaaccaauacauccaucaucgaccacaaauucugcaaccucucagacgcccacaagaaaaaccuauacgaccacgcccucauguccauuaucuccaccuuccaccuuuccauccccaacuucaaccaauacgaagccaugagcugcgacuucaacggcggcaaaaucuccguccaauacaaccucucccacuccuacgucggagacgccgccgaccacugcggcaccguagcaaacggcguccuucaaacauucaugcgaauggccuggggaggauccuacauagcccucgacuccggccgcggcaaaugggacugcaucauaacgucauaccaauaucucauaauucaaaacacgaccugggaggaccacugccaauucucccgccccuccccuaucggauaccuaggacuccuaucccaacgaacccgcgacaucuacaucucacgccgucuccucggcaccuucacuuggacacuaagcgacuccgaaggcaaagacacccccggcggcuauugccucacccgauggaugcucaucgaagcagaacucaaaugcuucggaaacacagcaguugcaaaaugcaacgaaaagcacgacgaagaguucugcgacaugcuccgacucuucgacuucaacaaacaagcgauccaacgacugaaagcggaagcccaaaugucgauccagcucauaaacaaagcaguaaacgcacucaucaacgaccaacucaucaugaaaaaccaccucagggacaucaugggcauccccuacugcaacuacagcaaauacugguaccucaaccauaccaucaccggaaaaaccagccucccccgcugcuggcucgucucuaacggcuccuaccucaacgaaacccgauucucagacgacaucgaacaacaggccgacaacaugauaacagagaugcuccaaaaagaauacauggagcgacaaggaaaaacuccccuuggccucguagaccucuucguauucucuaccuccuucuaccuaaucucuaucuuucuccaucuagucaaaauacccacccaccgccacauaguaggcaaaccuugccccaaaccccaucgccucaaccacaugggcauuugcucaugcggccucuacaaacaaccgggcgugcccguaaaauggaaacgauaa

SEQ ID NO: 3051 - RNA, 1476 nt, Artificial Sequence
  derived and/or modified CDS sequence (opt11) from Lassa virus__AIT17246__GPC
augggccaaaucgucaccuucuuccaagaagucccccacgucaucgaagaagucaugaacaucguccucaucgcccucucccugcucgccguccuaaaaggacucuacaacguagccacaugcggccucaucggucucaucaccuuccuccuccuaugcggucgcucaugcaccaccaacuuauacaaaggcgucuacgaacuccaaacccucgaacucaacauggaaacccuaaacaugaccaugccccuauccugcaccaaaaacuccucccaccacuacaucauggucggcaacgaaaccggucuagaacugacccuuaccaacaccuccauaaucaaccacaaguucugcaaccucucugacgcacacaagaaaaaccucuacgaccacacccucaugucuauaaucucaacauuccaccuuucaauccccaacuucaaccaauacgaggcuauguccugcgacuucaacggcggaaaaaucuccguacaauacaaccucucccacagcuacgcugucgacgcggccaaccacugcggcacgguugccaacggcauccuccagaccuucaugcgcauggccuggggaggguccuacauugcccucgauuccggccgcggaaacugggacugcauuaugaccuccuaccaauaccugaucauacaaaacacuaccugggaagaccacugccaguucucccgacccucgcccaucggcuaccucggucuacuaucccaacgcacccgagacaucuacaucucccgccgccuacucggcacuuucaccuggacucucuccgacagcgagggcaacgacacacccggaggauacugccucacacgauggaugcucaucgaagccgaacucaaaugcuucggcaacaccgccgucgccaaaugcaacgaaaaacaugacgaggaauuuugcgacaugcuccgccucuucgacuucaacaaacaagccauccaacgccuaaaagccgaagcccaaauguccauccaacuaaucaauaaagccguuaacgccuuaaucaacgaccagcucaucaugaaaaaccaccuccgcgacaucauggguauucccuacugcaacuacuccaaguacugguaccucaaccacaccaccaccggaaaaacaucacuccccaaaugcuggcucgucuccaacggcuccuaccucaacgaaacccacuucucagacgacaucgaacaacaagcagacaacaugaucacagagaugcuccagaaagaauacauggaacgacaaggcaaaacuccccucggucuagucgaccuauucgucuucuccaccucauucuaccucaucuccaucuucuuacaccucgucaaaauccccacacaccgccacauuguaggaaaacccugccccaaaccacaccgccuuaaccauaugggcaucugcucaugcggccucuacaaacaacccggcguacccguccgauggaaacgcuaa

SEQ ID NO: 3052 - RNA, 1476 nt, Artificial Sequence
  derived and/or modified CDS sequence (opt11) from Lassa virus__AIT17250__GPC
augggccaaaucgucaccuucuuccaagaagucccacaugucaucgaagaagucaugaacauaguccuaaucgcccucagccugcucgcgguccucaaaggacuauacaacguagcaaccugcggccuaaucggacucguaaccuuccuucuccucugcggacgcuccugcacaaccaaccucuacaaaggcguauacgaacuccaaacccucgaacugaacauggaaacacucaacaugaccaugccccucucaugcaccaaaaacaacucccaccacuacaucauggucgggaacgaaaccggccucgaacucacccuuaccaacacaucaaucaucaaucacaaauucugcaaccucucggaugcccacaagaaaaaccuauacgaccacacccucaugagcaucaucuccacauuccaucucuccaucccuaacuucaaccaauacgaggccauguccugcgacuucaacggaggcaaaaucucugugcaauacaaccucucccacagcuacgccguagacgccgccaaccacugcggcaccgucgccaacggcguccuccaaaccuucaugcgaauggcauggggaggauccuacauagcccucgacuccggccgaggcaacugggacugcauaaugaccuccuaccaauaucucaucauccagaacacuaccugggaagaccacugccaauucucccgacccucucccauagguuaccucggccuccuuucacaacgaacccgcgacaucuacaucucccgacgccuccucggaaccuucaccuggacacuguccgacagcgaaggcaaugacacaccaggcggcuacugccucacccgcuggaugcucaucgaagccgaacuaaaaugcuucggcaacaccgccgucgccaagugcaacgagaaacacgacgaagaguucugcgacaugcuacgcuuauucgacuucaacaaacaagccauccaacgccugaaagcagaagcccaaaugucaauccaacuaauaaacaaagccgucaacgcccuaaucaacgaucaacuaaucaugaagaaucaccuccgcgacaucaugggcauccccuacugcaacuacucaaaauacugguaccuaaaccacacuaccacaggcaaaaccucccuacccaaaugcuggcucguaagcaacggcuccuaccucaacgaaacccacuucucugacgacauagaacaacaagccgacaacaugauuacagaaaugcugcaaaaagaauacauggaacgccaaggcaaaacaccccugggacucguagaucuauucgucuuuuccaccuccuucuaccuaauauccaucuuccuccaccucgucaaaauacccacccacagacacaucgucggcaagcccugcccaaaaccccaccgccuaaaccacaugggaauuugcucaugcggccucuauaaacaacccggcguccccguccgauggaaacgcuaa

SEQ ID NO: 3053 - RNA, 1476 nt, Artificial Sequence
  derived and/or modified CDS sequence (opt11) from Lassa virus__AIT17254__GPC
augggacaaauagucaccuucuuccaagaaguuccacacgucaucgaagaagucaugaacaucguacucauagccuuauccauccucgccguccugaaaggccuauacaacuucgcaaccugcggaauagucggccucgucacauuccuccuauuaugcggacgcuccugcacuaccucacucuacaaaggaguauacgaacuccaaacccuugaacucaacauggaaacccucaacaugaccaugccacucuccugcaccaaaaacaauucccaccacuacaucauggucggcaacgaaaccggccuagaacucacccucaccaacaccuccaucaucaaccacaaauucuguaaccucucagacgcccacaagaaaaacuuauacgaccacgcacucauguccauaaucuccaccuuccaccuguccauucccaacuucaaccaauacgaagccaugucaugcgacuucaacggcggcaaaaucuccguccaauacaaccucucgcacagcuacgccggugacgccgccaaccacugcggcacagucgccaacggcguccuucaaacguucaugcgcauggccuggggaggcuccuacauugcccucgacuccggucgcgaccgcugggauugcauaaugacauccuaccaauaccucauaauacaaaacaccacgugggaagaccacugccaauucucacgccccagccccauaggauaccuaggccuccuaucucaacgaacccgcgacaucuacaucucucgucgacuccucggcaccuucaccuggacacucagcgacuccgaaggcaaaaacacccccggagguuacugccucacccgauggaugcucauagaagccgagcucaaauguuucggcaacaccgcagucgccaaaugcaacgaaaaacacgacgaagaguucugcgacaugcuacgacucuucgacuucaacaaacaagcaauacagagacucaaagccgaagcccaaauguccaucucccucaucaacaaggcugucaacgcccuaaucaacgaccaacucauuaugaaaaaccaucuccgcgacauuaugggaauacccuacugcaacuacuccaaguacugguaccuaaaccacaccacaaccggaaaaacauccuuaccccgcugcuggcuaguaucuaacggaucauaccuaaacgaaacccacuucucagacgauaucgaacaacaagcugauaacaugaucaccgaaaugcuacaaaaggaauacauggaccgucaaggcaaaacaccccucggccucgucgaccucuucgucuucucaaccuccuucuaccuaaucucaaucuuccuccaccucgucaaaauccccacccaucgccacaucguuggcaagaccugccccaaaccacaucgacucaaccacaugggaaucugcuccugcggccucuacaaacaacccggcgucccaguuaaauggaaacgcuag

SEQ ID NO: 3054 - RNA, 1476 nt, Artificial Sequence
  derived and/or modified CDS sequence (opt11) from Lassa virus__AIT17258__GPC
augggccaaaucgucaccuucuuccaagaggucccacacguaauagaagagguaaugaacaucguccucauagccuuaagcauacucgccguccucaaaggccucuacaacauagcaaccugcggacuugucggccuugucaccuuccuacuccucugcggccguagcugcaccaccucccuauacaaaggcgucuacgaacugcaaacccuugaacucaacauggagacccucaacaugacuaugccccuaucaugcaccaaaaacaacucccaccacuacauaauggucggaaacgaaacgggccucgaacuaacccucacuaacacauccauaauuaaccacaaauuuugcaaccucuccgacgcccacaagaaaaaccucuacgaccacgcccuaauguccaucguauccaccuuccaccucuccauccccaacuucaaccaauacgaagcaauguccugcgacuucaacggaggcaaaauauccguccaauacaaccucagccacucauacgcagucgacgccgccaaucacugcggcacggucgcaaacggcguucuccaaaccuucaugcguauggccuggggcggaucuuacaucgcacucgacuccggccgcggaggcugggacugcaucaugaccucuuaccaauaccucauaauccaaaacgucaccugggaagaccacugccaauucucucgcccaucacccaucggcuaccuaggccucuuaucccaacguaccagagacgucuacauaagccgacgccuccucggaaccuucacauggacccucucagacuccgaaggaaacgacacccccgggggauacugucuaacacgguggaugcuaaucgaagcagaacucaaaugcuuuggcaacaccgcagucgccaaaugcaacgaaaaacacgacgaagaguucugcgacaugcuccgccucuucgacuucaacaagcaagccauacaacgucucaaagccgaagcacagauguccauccaacucaucaacaaagccgucaacgcccuaaucaacgaccaacucaucaugaaaaaccaccuccgcgacaucaugggaauaccauacugcaacuauagcaaauacugguaccuaaaccacaccaccaccggaaaaaccucacuacccaaaugcuggcucgucucaaacggauccuaccuuaacgaaacacacuucagcgacgacaucgaacaacaggccgacaacaugauaaccgaaaugcugcaaaaagaauacauggaacgacaaggcaagacaccccucggccucguugaccucuuugucuucuccaccuccuucuaccuuauaucaaucuuccuucaucuaguaaaaauccccacccaccgccacaucguaggcaaacccugccccaagccccaccgccucaaccacaugggcaucugcagcugcgggcuuuacaaacaacccggcguccccguaaaauggaaacgcuag

SEQ ID NO: 3055 - RNA, 1476 nt, Artificial Sequence
  derived and/or modified CDS sequence (opt11) from Lassa virus__AIT17262__GPC
auggggcaaaucgucaccuucuuucaagaaguaccacacgucaucgaagaagucaugaacaucguacuuaucgcccuauccauccucgccguacucaaaggacucuacaaccucgccacaugcggccuagucggacucgucacauuccugcuacuaugcggccgauccugcaccaccucccuguacaaaggcgucuacgagcuccaaacacucgaacucaauauggaaacccucaacaugacaaugccacucuccuguaccaagaacaauucccaccacuacaucauggucggcaacgaaacaggccuagaacucacucuuaccaacaccagcaucauuaaccacaaauucugcaaccuauccgacgcccacaaaaagaaccucuacgaccacgcccucaugucaaucaucuccacguuucaccucuccauacccaacuucaaccaauacgaagcaauguccugcgacuucaacggcggcaaaaucuccguccaguauaaccucucccacucguacgcuggcgacgccgcuacacacugcggcacaguagccaacggaguccuccaaaccuucaugcgcauggccuggggagguuccuacauagcccucgacucuggucguggaaaaugggacugcaucaugacaagcuaccaauaccucauuauccaaaacaccaccugggaagaccacugccaauucucccgccccagccccauaggauaccucggccuucuuagccaacgaacacgugacaucuacaucucccgccgucuccucggcacauucaccuggacacuuucagacagcgaaggaaaggacaccccuggaggcuacugccucaccagauggaugcuaaucgaagccgaacucaaaugcuucggcaacacagccgucgcuaaaugcaacgaaaaacacgacgaagaguucugcgacaugcucagacuauucgacuucaauaaacaagccauacaacgucucaaaaccgaagcccagauguccauccaacucaucaacaaagccgucaacgcacucaucaacgaccagcuuaucaugaaaaaccaccuacgagacaucaugggcauccccuacugcaacuacuccaaauacugguaccucaaccacaccaccaccggaaaaaccucucucccacgcugcuggcucgugagcaacggcuccuaccucaacgaaacacauuucucagacgacaucgaacaacaagccgacaacaugaucaccgaaaugcuccaaaaagaauacauggaacgucaaggaaagacaccccucggccuuguagaccucuucgucuucuccaccuccuucuaccuaaucuccaucuuccuccaucucgucaaaauccccacacaccgucacauugucgggaaacccugccccaaaccacaccgacucaaccacauggguauaugcuccugcggccucuacaagcaaccaggcguucccgucaaauggaaacgcuga

SEQ ID NO: 3056 - RNA, 1476 nt, Artificial Sequence
  derived and/or modified CDS sequence (opt11) from Lassa virus__AIT17266__GPC
augggccaaaucgucaccuucuuucaagaagucccccacguaaucgaagaagucaugaacauaguccuaauagcccuaucaauccucgccguccucaaaggacucuacaaccuugcaaccugcggccucgucggccuagucaccuuccuccuccuuugcggccgaucaugcacaacgucccucuacaaaggcgucuacgaacuacaaacccuagaacucaacauggaaaccuuaaacaugaccaugccccucuccugcaccaaaaacaacucacaccacuacaucauggucggcaacgaaaccggacucgaacucacccucaccaacaccagccucaucaaccacaaauucugcaaccuauccgacgcccacaagaaaaaccuauacgaccacgcccucauguccaucaucuccacauuccaccugucaauacccaacuucaaccaguacgaggccauguccugcgauuucaacgguggcaaaauaagcguccaauacaaccucucccacagcuacgccgucgacgccgcuaaucacugugguaccgucgcaaacggcguccuccaaaccuucaugcguauggcauggggcggcucauacaucgcccucgacuccggccgaggcggcugggacugcaucaugaccuccuaccaauaccucaucauccaaaacaccacaugggaagaucacugucaauuuucacgucccagccccaucggcuaccucggacuccucucccaacgcacccgcgacaucuacaucucccgccggcuccuaggcacauucaccuggacccuauccgacuccgaaggaaaagacacgcccggaggcuacugccucacccgauggaugcucaucgaagcagaacucaaaugcuucggcaacaccgccgucgcaaaaugcaacgaaaaacacgacgaagaguucugcgacaugcuccgccucuucgacuucaacaaacaagcgauacaacgacucaaagcagaagcccaaaugucaauucagcucaucaacaaagccguaaacgcccuaaucaacgaccaacucaucaugaaaaaccaucuacgcgacaucaugggaaucccuuacugcaacuacuccaaauacugguaccucaaccacacuaccaccggccgcacaucccugccccgauguuggcucgucuccaacggcucauaccuaaacgaaacccacuucuccgacgacauagaacaacaagcagacaacaugauaaccgaaaugcuacaaaaagaauacauggaacgacaaggcaaaacaccgcucggucuagucgaccucuucgucuucucaacauccuucuaccucauauccaucuuccuccaccucgucaaaauccccacccaccgacacauuguuggcaaaagcugccccaaaccacaccgccuuaaccacaugggcauauguuccuguggccucuacaaacagcccggcguuccgguaaaauggaagcgcuag

SEQ ID NO: 3057 - RNA, 1476 nt, Artificial Sequence
  derived and/or modified CDS sequence (opt11) from Lassa virus__AIT17270__GPC
augggccagaucgucaccuucuuccaggaagucccccacgucauagaggaggucaugaacaucguccuaaucgcacucuccguacuagcaguccucaaaggccucuacaacuucgccacaugcggucucgucggccuugucaccuuccuccuccucuguggccgcucuugcucaacaucgguauacaaaggcgucuacgaacuccaaacccuugaacucaacauggagacccucaacaugaccaugccccuaagcugcacuaaaaacaauucccaccacuacaucauggucggaaaugaaaccggccucgaacuuacccuaaccaacaccuccaucauaaaccacaaauucugcaaccuauccgacgcccacaaaaagaaccucuacgaccacgcccugauguccaucaucucaaccuuccaccucuccauacccaacuucaaccaauacgaagccauguccugcgacuucaacggaggcaaaaucucagugcaauacaaccucagccacucauacgccgucgacgccgcgaaucacugcggaaccguagcaaacggcguccuccaaaccuucaugcgcauggcauggggaggcuccuacaucgcccuagacuccggccacggcggaugggacugcaucaugacgaacuaccaauaccuaaucauccaaaacacaaccugggaagaccacugccaauucucccgccccucucccaucggcuaccucggcuuacucucccagcgcacccgcgacaucuacaucagccgccgccuccucggcaccuucaccuggacccucuccgauucagagggaaaagacacccccggaggcuacugucucacccgcuggaugcucaucgaagcggaacucaaaugcuucggcaacacagccgucgcaaaaugcaacgaaaagcacgacgaagaguucugcgacaugcuccgacucuucgacuucaacaaacaggccauccagcgccuaaaagccgaagcccaaaugagcauacaacuuaucaacaaagccguaaacgcccucauuaacgaccaacucaucaugaaaaaccaccuaagagacauaaugggaauccccuacuguaacuacuccaaauacugguaccucaaccacaccaccacaggccgcacgucacuaccgaagugcuggcuagucuccaacggcagcuaccucaacgaaacccauuucagugacgacaucgaacaacaagccgacaacaugauaaccgaaaugcuucaacgagaauacauggagcgacaagguaagaccccucuaggucucgucgaccucuucgucuucuccaccuccuuuuaccuaaucucaaucuuccuccaccuagucaaaauccccacccaccgccacaucguaggcaaaucaugccccaaaccccaccgacucaaccacauggggaucugcuccugcggccuauacaaacaacccggcguccccguuaaauggaagcgcuaa

SEQ ID NO: 3058 - RNA, 1476 nt, Artificial Sequence
  derived and/or modified CDS sequence (opt11) from Lassa virus__AIT17274__GPC
augggucaaaucguuaccuucuuccaagaagucccccacguaaucgaagaagucaugaacaucguccuuauagcacuaucaauccucgccguccuaaaaggccuauacaacgucgccacaugcggccuaacaggccucgucgccuuccuccuccuuugcggccgguccugcaccaccacccucuacaaaggagucuaugaacuccaagcccucgaacucaacauggaaacccuaaacaugacaaugccccuaucuugcaccaaaaacaacucccaccacuacaucagagucggcaacgaaacaggacucgaacucaccuuaaccaauaccucaauaauagagcaccgauucugcaaccucuccgacgcacacaagaaaaaccuuuacgaccacgcccucauguccauaauuucuacguuccaccucuccauccccaauuucaaccaauacgaagccauguccugcgacuucaacggagggaaaaucucaguucaauacaaccucucccacagcuacgccguagacgccgcaaaccacugcggcaccguagccaacggcgugcugcaaaccuuuaugcgaauggcaugggguggcuccuacauagcucuagacuccggacgcaauggcugggacugcauaaugaccuccuaccaauaccucaucauacagaacaccaccugggaggaccacugccaauucucccgccccuccccaaucggcuaccucggccuacucucccaacgaacucgcgacaucuacaucucccgccgccuacucggaaccuucacauggacccugucagacuccgaaggaaaagacacacccgggggcuacugccuaacccgcuggaugcuaauagaagcugaacuuaaauguuucggaaacaccgccgucgcaaaauguaacgaaaaacacgacgaggaguucugcgacaugcuccgccuguucgauuucaacaaacaagccauccaacgacuaaaagccgaagcccaaaugucaauccagcucaucaacaaagccgucaacgcacugaucaacgaccaacuaaucaugaaaaaccacuuaagagacauaaugggcaucccauacugcaacuacuccaaauacugguaucucaacaacaccgccaccggaaaaaccucccucccgcgcugcuggcucgucucaaacggcuccuaccucaacgaaacccauuucuccgacgacaucgaacaacaagccgacaacaugauaaccgaaaugcuccaaaaagaauacauggaacgacaaggcaaaacaccacuuggccuagucgaccuguucguauucuccaccuccuucuaccucaucuccaucuuccuccaccucgucaagauacccacccaccgccacaucgucggcaaacccugccccaaaccccaccgccucaaccacaugggaaucugcucaugcggacucuacaaacaaccaggcgcccccguccgcuggaaacgcuag

SEQ ID NO: 3059 - RNA, 1476 nt, Artificial Sequence
  derived and/or modified CDS sequence (opt11) from Lassa virus__AIT17276__GPC
augggacagauaguaaccuucuuccaggaagugccccacgucaucgaagaagucaugaacaucguacucaucgcccugucuauccucgcuguucucaaaggccucuacaacuucgcaaccugcggccucgucggccucgucacuuuccuacuccucugcggccgcagcuguaccacaucucuauacaaaggcgucuacgaacuccaaacccuugaacuuaacauggaaacccucaacaugacaaugccccuauccugcaccaaaaacaacucccaccacuauaucaugguaggcaacgaaaccggccucgaacucacacucaccaacacaucgaucaucaaccacaaguucugcaaccucuccgacgcccacaagaaaaaccucuacgaccacgcccuaauguccaucaucucaaccuuccaccuaucaauucccaacuucaaccaauacgaagccaugucaugcgacuucaacggcggcaaaaucagcguucaauacaaccucucccacagcuacgcaggcgacgccgccaaccauugcggcacagucgcaaacggcguccuucaaaccuucaugcgcauggccuggggcggcuccuacaucgcccucgacucaggccacggaaaaugggacugcaucaugacaucauaccaguaucuaaucauccaaaacaccaccugggaagaccacugccaauucucacgccccucacccaucggcuacuugggccuacucucccaacgcaccagagacaucuacaucagccgacgcuuacucggaacauucaccuggacacuaucugacuccgaaggcaaagacacaccuggaggcuacugccucacccgcuggaugcucaucgaagcagaacuaaaaugcuucggcaacacagccgucgccaagugcaacgaaaaacacgacgaagaguucugcgacaugcuccgacucuucgacuucaacaaacaagccauccaacgccucaaagccgaagcacaaauguccauccaacucauaaacaaggccgucaacgcccuaauaaacgaccaacucauaaugaaaaaccaccuccgcgacaucaugggcauccccuacugcaacuacagcaaauacugguaccugaaccacaccaccacaggaaaaaccucucuaccuaaaugcuggcucgucuccaacggcucauaccuaaacgaaacccacuucagcgacgacaucgaacaacaagcugacaacaugaucaccgaaaugcuacagaaagaauacauggaacgccaaggcaaaacaccccuuggccuagucgaucucuucgucuuuuccaccuccuucuaucucaucucaaucuuucuccaccucguaaaaauccccacccaccgccacaucgucggaaaauccugccccaaaccccaccgccucaaccacaugggcaucugcuccugcggccucuacaaacaaccaggcguucccguacgcuggaaacguuaa

SEQ ID NO: 3060 - RNA, 1473 nt, Artificial Sequence
  derived and/or modified CDS sequence (opt11) from Lassa virus__AIT17280__GPC
augggccaaaucguuaccuucuuccaagaaguaccccacguaaucgaagagguuaugaacaucguacuuaucgcacucuccauccucgccguccucaaaggucucuacaacuucgcuaccugcggacucgucggacucguaaccuuccuacuccuaugcggccgaucuugcaccaccucccucuacaaaggcgucuaugaacuacaaacccucgaacucaacauggagacccucaacaugaccaugccccuauccugcaccaaaaacaacucucaccacuacauacgugucggaaacgaaaccggccucgaacucacucucacaaauacuuccaucaucgaccacaaauucugcaaccucuccgacgcccacaagaaaaaccuuuacgaccacgcacucauguccaucaucuccaccuuccaccucuccauccccaacuucaaccaauaugaagcaauguccugcgacuuuaacggcggcaaaaucagcguccaauacaaccucagccacuccuacgccggugacgcagccaaccacugcggcaccgucgccaacggcguccuucaaaccuucaugcgcauggccuggggaggcucauacaucgcacuggacuccggacacgagugggacugcaucaugaccagcuaccaauaccuaauaauccaaaacacaaccugggacaaccacugccaauucucccgcccaucccccauaggcuaucucggucuacucucacagcgaacucgugacaucuacaucucacgccgccuccucggaacguucacauggacccucuccgacuccgaaggcaaagacaccccaggcgguuacugucucacucgcuggaugcucaucgaagccgaacuaaaaugcuucggaaacacagcagucgcaaaauguaacgaaaaacacgacgaagaguucugcgacaugcuccgccucuucgacuucaacaaacaagccauccaaagacucaaaguagaagcacaaauguccauccaacucauuaacaaagcuguaaacgcacuaaucaacgaccaacuaaucaugaaaaaccaccuccgcgacauaaugggaauaccauacugcaauuacuccaaauacugguaccucaaccacaccaccacugggaaaaccucccuccccaaaugcuggcuagucuccaacggaagcuaccuaaacgaaacccacuucuccgacgacaucgaacaacaagcagacaacaugaucacagaaaugcuccaaaaggaauacauggagcgacaaggcaaaacaccccucggccucgucgaccucuucgucuucuccaccucauucuaccucaucuccauauuccuacaccucgucaaaauccccacccaccgccacauagucggcaaaagcugccccaaaccccaccgccucaaccacaugggaaucuguuccugcggcuucuacaaacagcccggaguccccguaaaauggaaacgcuaa

SEQ ID NO: 3061 - RNA, 1476 nt, Artificial Sequence
  derived and/or modified CDS sequence (opt11) from Lassa virus__AIT17288__GPC
augggacaaaucguuacauucuuccaagaggucccccaugucauagaagaggucaugaacaucguccuaaucgcccuauccauacuagccguccucaaaggccucuacaacuucgccaccuguggccuagucggacuugucacauuucuacuacuaugcggccgcuccugcaccacuucucucuacaaaggagucuacgaacuacaaacccuagaacucaacauggaaacacuaaacaugacaaugccccuauccugcacaaaaaacaacucccaccacuacauaaugguaggcaacgaaaccggucucgaguuaacccuaaccaacacauccaucaucaaccacaaauuuugcaacuuaucagacgcccacaaaaaaaaccucuacgaccacgcccugaugucaaucaucuccaccuuccaccuauccauucccaacuucaaccaauacgaagcaauguccugcgacuucaacggaggaaaaaucucaguacaauacaaccugucccacuccuacgcaguagacgccgcuaaccacugcggcacagucgccaacggcguccuccagaccuucaugcgaauggccuggggcggcggcuacaucgcccucgacuccggacgcggcaacugggacugcaucaugaccucuuaccaauaccuaaucauccaaaacaccaccugggaagaccacugccaguucucacgcccuucacccaucggauaccucggccugcucucacagcgaacccgcgacaucuacaucuccaggcgacuucuaggcaccuucacauggacucucuccgacuccgaaggaaaagacacacccggcggcuacugcuuaacccgauggaugcucaucgaagccgaauuaaaaugcuucggcaacacagcagucgccaaaugcaacgaaaaacacgacgaagaguucugcgacaugcuacgccuauucgacuucaacaaacaagcuauccaaagacucaaagcagaagcccaaauguccauccaacuaauaaacaaagccgucaacgcccucauaaacgaccaacucaucaugaaaaaccaccuccgcgacaucaugggcaucccauacugcaacuauuccaaauacugguaccucaaccacaccgucaccggcaaaaccucccucccaaaaugcuggcuagucuccaacggcagcuaccucaacgaaacccacuucucagacgacaucgagcagcaagcagacaacaugauaaccgaaaugcuccaaaaagaguacauggaaagacaggguaaaaccccccuuggccucguagaccuauucgucuucuccaccuccuucuaccugaucuccaucuuccuccaccuaguaaaaauacccacacaccgccacaucgucggaaaaagcugcccgaaaccccaccgccuaaaccacaugggcaucuguuccugcggccuauacaaacaacccggcguccccguccgcuggaaacgcuaa

SEQ ID NO: 3062 - RNA, 1476 nt, Artificial Sequence
  derived and/or modified CDS sequence (opt11) from Lassa virus__AIT17292__GPC
augggccaaaucgucaccuucuuccaggaagucccucacgucaucgaagaagucaugaacaucguccucaucgcccucucaaucauggccguacuaaaaggacuuuacaacaucgccacaugcggacucgucgggcucgucacauuccuccuccucugcggucgauccugcaccaccacacuuuacaaaggcgucuacgaacuacaaacccucgaacuaaacauggaaacacucaacaugaccaugccccuaucaugcaccaaaaacaacucacaccacuacaucauggucggcaacgaaaccggacuagaacuaacccuuaccaauaccuccaucaucaaccacaaauuuugcaaccucuccgacgcccacaaaaagaaccuauacgaccacgcccucaugucuaucaucuccacauuccaccuaagcauccccaacuucaaccaauacgaagcuauguccugcgacuuuaacggcggcaaaaucucgguucaauacaaccuaagccacuccuacgccggcgacgccgccaaccacugcggcacggucgccaacggcguccuccaaaccuucaugcgcauggcuuggggcggcuccuacaucgcccucgacagcggccacggaggcugggacugcauaaugaccucguaccaauaccucaucauucaaaacaccaccugggaagaucacugccaauucacgcgcccuucgcccaucggauaccucggacuccucagccaaagaacccgcgacaucuacauaucacgaagacuccucggcaccuucaccuggacucucagcgacuccgaaggcaacgauacccccggcggcuacugccucacccgcuggaugcuuaucgaagccgaacuuaaaugcuucggaaacacggccgucgccaagugcaacgagaaacacgaugaagaguucugugacaugcuccgccuauucgacuucaacaaacaagcaauccaacggcuccgcgcagaagcacaaaugagcauacaacucaucaacaaagccgucaaugcacucaucaacgaccagcucaucaugaaaaaccaccuaagagacaucaugggcaucccuuacugcaacuacaguaaauacugguaccuuaaccacacaaccaccggcagaacuagccucccccgaugcuggcucgucuccaacggcagcuaccucaacgaaacacacuucagcgacgacaucgaacaacaagccgacaacaugauaacugaaaugcuacaaaaagaauacauggaacgccaaggaaaaacaccccucggccuagucgaccucuucgucuuuuccaccucauucuaccucaucagcaucuuccuccaccucauaaaaaucccaacccaccgccacaucgucggaaaacccugccccaaaccccacagacuuaaccacaugggcgucugcucaugcggccucuacaaacagcccggaguucccguccgcuggaaaagauaa

SEQ ID NO: 3063 - RNA, 1476 nt, Artificial Sequence
  derived and/or modified CDS sequence (opt11) from Lassa virus__AIT17294__GPC
augggccaaauagucaccuucuuccaagaagucccccacgucaucgaagaagucaugaacaucguccucauagccuuaagcauucucgcaguccucaaaggacuuuacaaccucgcuaccugcggccucgugggacucgucaccuucuuacuccucugcggccgcuccugcaccaccucacucuacaaggguguauacgaacuccaaacgcuagaauugaacauggaaacucucaacaugacuaugccccucuccugcacuaaaaacaacucccaccacuacaucauggucgguaacgaaacaggccucgaacucacacucaccaacaccuccaucaucgaccacaaauucugcaaccucucagacgcccacaaaaagaaccucuaugaccacgcccuuaugucaaucaucagcacauuccaccucuccauacccaacuucaaccaauacgaagccaugucaugcgacuucaaugguggcaaaauauccgugcaauacaaccucucccacuccuacgccggcgacgccgcaaaucacugcggcacaguagcaaacggcguccuccaaaccuucaugcgaauggccuggggcggaagcuacaucgcacuugacuccggucgcggaggaugggacugcaucaugaccuccuaccaguaccuaauaauccaaaacaccacaugggaagaccacugccaauucagccgcccaagccccguaggcuaccuuggccugcucucccaacgcaccagagacaucuacaucucaagacgacuccucggaaccuucaccuggaccuuaagcgacuccgaaggcaaggacaccccaggcggcuacugccucacacgcuggauguuaauagaggccgaacuaaagugcuucgguaacaccgccgucgcaaaaugcaacgaaaaacacgacgaagaguucugcgacaugcuacggcuuuucgacuucaacaaacaagccauccaacgccugaagaccgaggcacaaauguccauccaacucaucaacaaagccgucaacgcgcucaucaacgaccaacuaaucaugaagaaccaccucagagacaucauggguaucccauacugcaacuacuccaaauacugguaccuaaaccacaccacaaccggaaaaaccucccucccccgcugcuggcucguauccaacggauccuaccucaacgaaacccacuucuccgacgacaucgaacaacaagcagacaacaugauuacagaaaugcuccaaaaagaauacauggagagacaaggcaaaacaccccucggacucgucgaccucuucguauucuccaccuccuucuaccuaaucuccauauuccuccaccucgucaaaauccccacccaccggcacaucgucggcaaaccaugcccaaagccgcacagacucaaccacaugggcaucugcucgugcggacucuacaaacaacccggcguacccguuaaauggaagcguuaa

SEQ ID NO: 3064 - RNA, 1476 nt, Artificial Sequence
  derived and/or modified CDS sequence (opt11) from Lassa virus__AIT17298__GPC
augggccaaaucgucacauucuuccaagaagucccgcacgucaucgaagaagucaugaauaucguucucaucgcacuaagcauccucgccguacugaaaggccucuacaacauagccacaugcggccuccuuggccucguaugcuuccuccuccuaugcggacgauccugcacuaccucgcuguacaaaggcguuuacgaacuccaaacacuagaacucaauauggaaacccuuaacaugaccaugccccuauccugcaccaaaaacaacucgcaucacuacauuauggucggcaacgaaaccggccuugaacuaacacucacaaauaccuccauaaucaaccacaaguucugcaaccuauccgacgcucacaagaaaaaccucuacgaccacgcccucauguccauaaucucuaccuuucaccucuccauacccaacuucaaccaauacgaagccaugagcugcgacuucaacggcggcaaaaucuccguccaauacaaccucucacacucguacgccgucgaugccgcuucccacugcggcaccaucgcaaacggcguccugcaaaccuucaugcgcauggccuggggaggcagcuacauagcccuagacuccggccacggcgguugggacugcauaaugacauccuaccaauaccucaucauccagaacacuaccugggaagaccacugccaauucucccgccccucccccauuggauacuuaggccuacuaucacaacgaacccgagauaucuacaucucccgucgacuccuuggaaccuucaccuggacacucuccgacagcgaaggcaaagacaccccaggcggcuacugccugacccgcuggaugcucauagaagccgaacuaaaaugcuucggcaacacugccgucgcuaaaugcaacgaaaaacacgacgaagaauuuugcgacaugcucagacuauucgacuucaacaagcaagcaauccagcgccuaaaagccgaagcccaaauguccauacagcucaucaacaaagccguaaacgcccucaucaacgaccaacuaaucaugaaaaaccaccucagagacaucaugggaauccccuacuguaacuacucaaaauacugguaccucaaucacacaaccaccggcaaaaccucccuccccaaaugcuggcuagucucaaacggcucauaccuuaacgaaacacacuucagcgacgacauagaacaacaagcagacaacaugaucaccgaaauguuacaaaaagaauacauggaacgccaagggaaaaccccucucggccucgucgaccuuuucgucuucucaaccagcuucuaccucaucuccaucuuccuacaccuaguaaaaauccccacacacaggcacgucgucggaaaacccugcccaaaaccccaccgccucaaccacaugggcaucugcuccugcggccucuacggccaacccggcgucccugucaaauggaaacgcuaa

SEQ ID NO: 3065 - RNA, 1476 nt, Artificial Sequence
  derived and/or modified CDS sequence (opt11) from Lassa virus__AIT17302__GPC
augggccaaauagucaccuucuuccaagaagucccucacgucaucgaagaaguaaugaacauaguccucaucgcacugucucuccuagcaguccucaaaggacuauacaacgucgcaaccugcggccuaaucggccucgucaccuuccuccuccucugcggccgcuccugcacuacaaaccuuuauaaggguguguaugaacugcaaacccucgaacucaauauggaaacccuaaacaugaccaugccccucucaugcaccaaaaacaacucacaccacuacaucaugguaggaaacgaaaccggccuagaacucacacuaaccaacaccuccaucaucucccauaaauuuugcaaccugagcgacgcccauaagaaaaaccuuuacgaccauacccucaugagcauaaucuccacauuucaccuauccauccccaacuucaaccaauacgaagccaugucaugcgacuucaacggaggcaaaaucuccguccaauacaaccuaucccacucauacgccgucgacgccgccaaccacugcggcaccgucgccaacgguguccuccaaaccuuuaugcgcauggccuggggcgguagcuacaucgcccucgacucaggacgcggcaacugggacuguaucaugacauccuaccaauacuuaaucauacaaaacaccacuugggaagaccacugccaauucucccgaccauccccgaucggcuaccugggccuccuaucacaacggaccagagacaucuacaucucccgucgacuccucggcaccuucacuuggacccuaagcgacuccgaaggcaacgacacccccggcggcuacugccuaacucgcuggaugcucaucgaagcagaacucaaaugcuucggcaacacagccgucgccaaaugcaacgagaaacacgacgaagaguucugcgacaugcuacgccucuuugacuucaacaaacaagccauccaacgccuaaaagccgaagcacaaaugucaauccaacucauaaacaaagcugucaacgcccucauuaacgaccaacuaauaaugaaaaaccaccuaagagacauaaugggaauccccuacugcaauuacucaaaguacugguaccucaaccacaccaccaccggaaaaaccucccugcccaaaugcuggcucguguccaacggcuccuaccugaacgaaacccacuucuccgacgauaucgaacaacaagcagauaacaugauaacggaaaugcuacaaaaagaauacauggaacgacaaggaaagaccccacucggccuaguagaccuauuugucuucucaaccuccuucuaccucaucuccaucuuccuccaccucgucaaaauccccacccaccgacacaucgucggcaaacccugccccaaaccccaccgacucaaccacaugggcaucuguucaugcggccuauacaaacagcccggcguccccguccgguggaaacgcuaa

SEQ ID NO: 3066 - RNA, 1476 nt, Artificial Sequence
  derived and/or modified CDS sequence (opt11) from Lassa virus__AIT17310__GPC
augggacaaauagucaccuucuuccaagaagucccccacgucaucgaagaagucaugaacaucguacucaucgcccuauccauccucgccguccuaaaaggacuguacaaccuagccacaugcggccucgucggccuaguaacauuccuccuccucugcggccgaucaugcacaacaucacuauacaaaggagucuacgaacuccaaacacuggaacucaacauggaaacccucaacaugacuaugccccuguccugcaccaaaaacaacucacaucacuacaucaugguagguaacgaaaccggccucgagcuaacucuaacaaacaccagcaucaucaaccacaaauucugcaaccucuccgacgcccacaagaaaaaccucuacgaccacgcacucaugucaaucaucuccaccuuccaccuaagcaucccgaacuuuaaucaauacgaagcaauguccugcgacuucaacggaggcaaaaucucagugcaauacaaucucucgcacuccuacgccggagacgcagccacccauugcgguacagucgccaacggcguccuccaaacuuucaugcgcauggcaugggguggcagcuacauugcucuagacuccggccgagguaagugggacugcauaaugaccuccuaccaauaccucaucauccaaaacaccaccugggaagaccacugccaauucagccgccccucccccaucggauaccugggccuccuuucucaacgcacccgcgacaucuacauuucccggcgccuccucgguacuuucacauggacccucuccgacucugaaggcaaggacaccccuggcggcuacugccuaacccgguggaugcucaucgaagccgaacuaaaaugcuucggaaacaccgccgucgccaaaugcaacgaaaaacacgacgaagaguucugcgacaugcucagacuauucgacuucaacaagcaagccauccaacgcuuaaaaaccgaagcccaaaugucgauccaacugaucaacaaagcagucaacgcacucaucaaugaccagcucaucaugaaaaaccaccuccgagacaucaugggcauaccuuacugcaacuacucaaaauacugguaccucaaccauaccaccaccggaaaaaccucacucccccgcugcuggcucgucuccaacggcucauaucuaaacgaaacccacuucuccgacgacaucgaacagcaagccgacaacaugauaaccgaaaugcuacaaaaagaauacauggaacgucaaggaaaaacaccccuaggauuagucgaccucuucgucuucucaaccagcuucuaccucaucucgaucuuccuccaccucgucaaaauccccacacaccgccacaucgucggaaaaccaugccccaaaccccaccgacucaacuacaugggcauaugcucaugcggccuuuacaaacaacccggaguccccgucaaauggaaacgcuag

SEQ ID NO: 3067 - RNA, 1476 nt, Artificial Sequence
  derived and/or modified CDS sequence (opt11) from Lassa virus__AIT17314__GPC
augggccaaaucgucaccuucuuccaagaagucccccacgucaucgaagaagucaugaacaucguccucauaacccucuccauccuagcaguccucaaaggccuauacaacgucgccacaugcggacucguaggccuaguaaccuuccuccuccucugcggccgcuccugcacaacaagccucuacaaaggggucuacgaacuccaaacccucgaacuaaacauggaaacccuaaacaugacuaugccccuauccugcaccaaaaacaacagccaucacuacaucaugguaggaaacgaaaccggccucgaacuaacccucacaaacaccucaauaauaaaccacaaauucugcaaccucuccgacgcacacaaaaaggaccuguacgaccacgcacuaauguccaucaucuccaccuuccaccugagcauccccaacuucaaccaauacgaagccauguccugcgacuucaacggagguaaaaucucuguccaguauaaccuuucccacuccuacgccguagacgccgccaaccacugcggcaccgucgccaacggaguccuacaaaccuucaugcgcauggcauggggcggcucuuacauagcccucgacuccggacgcggcggcugggacugcaucaugaccagcuaccaauaccucaucauccaaaacaccaccugggaagaccacugccaauucucgcguccuagcccaauaggcuaccucggccugcuaucccaaagaaccagagacauauacaucucccgccgccuccucggcacuuucaccuggacccucuccgacucagagggaaacgacacaccaggagguuacugccucacccgcuggaugcucaucgaggcagaacucaagugcuucggcaacacagccgucgccaaaugcaacgaaaaacacgacgaggaguucugcgacaugcuaagacucuucgacuucaacaaacaagccauccaacgccucaaagcagaagcccaaauguccauacaacucauaaacaaagccgucaacgcacucaucaacgaccaacucauuaugaaaaaccaccuucgcgacaucaugggcaucccauacugcaacuacucaaaauacugguaccuaaaccacacaacaacuggaaaaacaucacuacccaaaugcuggcucguguccaacggcucuuaccuaaacgaaacucacuucucugacgacaucgaacaacaagccgauaacaugaucaccgaaaugcuacaaaaagaauacauggaacgacaggguaaaacuccccuaggccucgucgaccuauucgucuucuccacauccuucuaccucauaucaaucuuccuacacuuggucaagauccccacacacagacacauaguaggcaaaccaugcccaaaaccccacagacuaaaccacaugggaaucugcagcugcggccuauacaagcaaccuggaguccccgucaaauggaaacgcuaa

SEQ ID NO: 3068 - RNA, 1476 nt, Artificial Sequence
  derived and/or modified CDS sequence (opt11) from Lassa virus__AIT17318__GPC
augggacaaauagucacuuucuuccaggaaguuccccacguaaucgaagaagucaugaacaucgucuuaauagcccucucccuccucgccguccuuaaaggccuauacaacgucgcaaccugcggccuaaucggccuugucacauuccuccuccuuugcggacgcuccugcacuacgaacuuguauaaaggcgucuacgaacuacagacgcucgaacucaacauggaaacccuaaacaugaccaugccccuauccugcaccaaaaacaacucacaccacuacaucauggucggcaacgaaaccggacucgaacuaacccucacaaacacuuccauaauaaaccacaaauucugcaaccucuccgacgcccacaagaaaaaccucuacgaccacgccuuaauguccaucaucucuacuuuccaccuuucaaucccaaacuucaaccaauacgaagccauguccugcgacuucaacggcggaaaaauaaguguccaauacaaccuaucccacucauaugccgucgacgccgccaaccacuguggaaccgucgcaaacggcguccuacaaaccuuuaugcgcauggccuggggaggauccuacaucgcccucgacuccgggcgcggcaacugggauugcaucaugaccagcuaucaauaccuaaucauccaaaacaucaccugggaagaccacugccaauucuccagacccucccccaucggauaccucggacuccucucccaacgaacccgggacaucuacaucagccgccgccuccucggaaccuucacuuggacucucuccgacuccgaaggaaacgacacccccgguggcuacugccuaacccguuggaugcucaucgaagccgaacugaaauguuucggcaacacagcaguagcuaaaugcaaugaaaaacacgacgaagaguucugcgacaugcuacgccuauucgacuucaacaaacaagcaauccaacgacucaaagccgaagcccaaauguccauccaacucauaaacaaagccgucaacgcccuuauaaacgaccaacuaauaaugaaaaaccaccucagggacaucaugggaauccccuacuguaacuauuccaaauacugguaccuaaaccacaccaccaccggcaaaacaucccucccaaaaugcuggcuagucucaaacggcuccuaccucaacgaaacccacuucuccgaugacaucgaacaacaagccgacaacaugaucaccgaaaugcuacaaaaggaauacauggaacgacaaggaaaaacaccccucggccuagucgaccuauucgucuucucaaccucguucuaccucauuuccaucuuccuucaccuuguaaaaaucccuacacaccgacacaucgucggcaaacccugcccuaaaccccaccgccucaaccacaugggaaucugcucaugcggccucuacaaacaaccuggcguccccguccgguggaaacgauaa

SEQ ID NO: 3069 - RNA, 1476 nt, Artificial Sequence
  derived and/or modified CDS sequence (opt11) from Lassa virus__AIT17322__GPC
auggggcagauaguuacguucuuccaagaggucccacacguaaucgaagaaguaaugaacaucguccucaucgcccuuucccuccucgccguacuaaaaggacuuuacaacgucgcgaccugcggccucaucggucuagucaccuuccuccuacucugcggucgcuccugcaccaccaaccucuacaagggcgccuacgaacuccagacacucgaacucaacauggaaacgcucaacaugaccaugccccuauccugcaccaaaaacaacagccaccacuacaucauggucggcaacgaaacaggacucgaacucacgcucacaaacacaucaauuaucaaccauaaauucugcaaccucagcgacgcccacaagaaaaaccucuacgaccacacgcuaauguccaucaucuccacauuccaccucagcauccccaacuucaaccaauacgaagccaugucaugcgacuucaacggcggcaaaaucagcguacaauacaaccucagccacucuuacgccguggacgccgccaaccacugcggaacugucgccaacggcguccuccaaacauucaugcgcauggccuggggcggcuccuacaucgcacucgacuccggacgcggaaacugggacugcauaaugaccucauaccaauaccugaucauccagaacaccaccugggaggaccacugccaauucucccgcccgucccccauuggauaccucggccuccucagccaaagaacccgcgacauuuacauaucccgacgucuucugggaacguuuaccuggacucucuccgacuccgaaggcaacgacaccccaggaggcuacugccucacccgcuggaugcucauagaggccgagcucaaaugcuucggcaacaccgccguagccaaaugcaacgaaaaacacgacgaggaguucugcgacaugcuuagacucuucgauuucaacaaacaagcuauccaacgccucaaagcagaagcccaaaugagcauccaacucauaaacaaagcagucaacgcccucaucaacgaccaacuuaucaugaaaaaccaccuccgcgacaucauggguauccccuacugcaacuacuccaaauacugguaucugaaccacacuaccacaggcaaaaccucccuaccuaagugcuggcuugucuccaacggcuccuaccucaacgaaacccauuuuuccgacgacauagaacaacaagccgacaacaugaucacagaaaugcuccaaaaagaauacauggaacgccaaggcaagacuccccucggccuaguagaccucuucguauucuccaccagcuucuaccucaucuccaucuuccuccaccucguuaaaauacccacccaccgccacaucgucggaaaaccuugccccaaaccccaccgacuaaaccacaugggcaucugcucuugcggccuauacaaacaacccggcguccccguacgcuggaaacgcuaa

SEQ ID NO: 3070 - RNA, 1476 nt, Artificial Sequence
  derived and/or modified CDS sequence (opt11) from Lassa virus__AIT17328__GPC
augggccaaauugucacauucuuccaagaagucccucacgucauagaggaaguuaugaacauaguccucaucacacucucaauacucgccguccucaaaggacuuuacaacauagcaaccugcggucucguaggccucgugaccuuccuacugcucugcggcaaaucuugcaccaccucacuauacaaaggcgucuacgaacuccaaacccucgagcucaacauggaaacccuaaacaugaccaugccccucuccugcaccaaaaacaacucacaccacuacauacgcguuggaaacgaaacaggccucgaacucacccuaaccaacaccuccaucaucaaccacaaauucugcaacuuguccgacgcccacaagaaaaaucucuacgaccacgcccuaaugucaaucauuucuaccuuccaucucuccaucccaaacuucaaccaauacgaagccauguccugcgacuucaacggcggaaaaaucuccgugcaauacaaccuaucccacuccuacgccgucgacgcagccaaccacugcggcaccgucgcaaacgguguccuacaaacauucaugcgaauggccuggggcggcucauacaucgcacucgacuccggccacggcaacugggacugcauuaugaccucauaccaauaccucaucauacaaaacaccacaugggaagaccacugccaauucucccgccccagccccaucgguuaccucggccuccucucccaacgaacccgcgacaucuacauaucccgccgccuacucggcacauucacauggacccuauccgacucagaaggaaacgacgcacccggaggcuacugccuaaccagauggaugcucauagaagccgaacucaaaugcuucggcaacaccgccgucgccaaaugcaacgaaaaacacgacgaagaguucugcgacaugcuccgucuauucgacuucaacaaacaagccauacaacgccuuaaagccgaagcacaaaugucaauccagcucaucaacaaagcagucaaugcccucauaaacgaccaacuaauaaugaaaaaccaccuccgcgacaucaugggaaucccauacugcaacuacucaaaauacugguaccucaaccacaccaccacuggcaaaacaucccuccccaaauguuggcucgucucaaacggcagcuaccucaacgaaacacacuucuccgacgacaucgaacagcaagcagacaauaugaucacagaaaugcuccaaaaagaauacauggaacgccaaggcaaaacaccccucggccuaguagaccucuucgucuucucaaccucauuuuaccucauaucuaucuuccuccacuuaguuaaaauccccacccaccgccacguagucggaaagagcugccccaaaccccaccgccuuaaccacaugggcaucugcucaugcggccucuacaaacaacccggcguccccgugaaguggaaacgcuaa

SEQ ID NO: 3071 - RNA, 1476 nt, Artificial Sequence
  derived and/or modified CDS sequence (opt11) from Lassa virus__AIT17332__GPC
augggucaaaucgucacauucuuccaagaaguaccacacguaaucgaagaagucaugaacaucguccucaucgcacuuuccauccucgccgucuuaaaaggacucuacaaccuugcaaccugcggccuuguaggccuuguuaccuuccuccuacuaugcggccgcagcugcaccacaagccucuacaaaggagucuacgaacuccaaacccucgagcucaacauggaaacccucaacaugaccaugccacuauccugcaccaaaaacaacagccaccauuacauccgaguaggcaacgaaaccggacucgaacucacacuaaccaacaccuccaucaucaaccacaaauucugcaaccucucagacgcccacaagaaaaaccucuacgaccacgcccuaaugucaaucaucuccacauuccaccuaagcauacccaacuucaaccaguacgaagccauguccugcgacuucaacggcggcaaaaucucaguccaauacaaccucagccacuccuacgccguagacgccgccaaccacugcggcaccgucgcaaacggaguccuacaaacauucaugcgcauggccuggggaggcuccuacaucgcacucgacuccggacacggacgcugggacugcaucaugaccagcuaccaauaccuaauaauccaaaacaccaccugggaagaccacugccuguucucgcgccccucacccauuggcuaccucggccugcucagccaacgcacaagagacaucuacaucucacgccgucuucucggcaccuucaccuggacccuaucagacucagaaggccgcgacacacccgguggcuacugccuaacccgauggaugcucaucgaagcagaacuaaaaugcuucggcaacaccgccgucgcaaaaugcaacgaaaaacacgacgaagaguucugcgacaugcuccgccucuucgacuucaacaaacaggccauccaacgacucaaagcagaagcccaaaugucaauacaacuaaucaacaaagccgucaacgcccucaucaacgaccaacucauaaugaaaaaccaccuccgagacauaaugggcauaccauacugcaacuacuccaaauauugguaucuuaaccacaccacaacaggccgaaccagccuccccagaugcuggcucguauccaacggcagcuaccuaaacgaaacccacuuuucagacgacaucgaacaacaggccgacaacaugauaaccgaaaugcuccaaaaagaauacauggaacgacaaggaaaaaccccucuuggacucguugaccucuuugucuucuccacgucauucuaccucauaucaaucuuccuacaccucgucaaaauccccacacaucgacacaucgucggcaaauccugcccaaaaccacaucgccucaaccacaugggaaucugcucauguggccucuacaaacaaccaggcgucccagucaaauggaaacgcuaa

SEQ ID NO: 3072 - RNA, 1476 nt, Artificial Sequence
  derived and/or modified CDS sequence (opt11) from Lassa virus__AIT17340__GPC
augggccagauagucacuuucuuccaagaagucccccacgucaucgaagaagucaugaacauaguccuaaucgcucuaucaauacucgccguccucaaaggccucuacaacuucgccacaugcggacucgucggccucgucaccuuccuccuucucugcggacgcucaugcaccaccucccuauacaaaggcguauacgaacuacaaacccucgaacucaacauggaaacacuaaacaugacaaugccccucucaugcaccaaaaacaacucccaccacuauaucauggucgguaacgaaaccggucucgaacucacccucaccaacauaucaaucaucaaccacaaauucugcaaucucuccgacgcucacaaaaagaaccucuacgaccacgcgcucauguccaucaucuccaccuuccaccucagcauccccaacuucaaccaauacgaagccaugucaugcgacuucaacggcgggaaaaucuccguucaauacaaccucucccacuccuacgccggcgacgcagccaaccacugcggcaccgucgccaacgggguacuccaaaccuucaugcgcauggccuggggcggcuccuacauagcacucgacuccggccgcggcgaaugggacuguauuaugacuucguaccaguaccucaucauccaaaacaccaccugggaagaccacugccaauucucccgccccucccccaucggauaccucggacuacucucacaacgaacccgagacaucuacauaucccgacgccuccuaggcaccuuuacauggacccuuuccgacuccgaaggcaaagauacccccggcggcuacugccucacacgauggaugcucaucgaagccgaacucaaaugcuucggaaacacagcagucgccaaaugcaacgaaaaacacgaugaagaguucugcgacaugcuacgacucuucgacuucaacaaacaagcuauccaacgccuaaaagccgaagcucaaaugucuauccaacucaucaauaaagcagucaacgcacuaaucaaugaccaacucaucaugaagaaccaccuucgagacaucaugggcaucccauacuguaacuacuccaaguacugguaccugaaccacaccacaaccggcaaaaccagccuacccaaguguuggcucguuuccaacggcucuuaccuaaacgaaacccacuucucagacgacaucgaacagcaagcugacaacaugauaaccgaaaugcuacagaaagaauacauggaacgccaaggcaaaacaccccuaggacucguagaccuauucgucuucuccacuuccuucuaccuaaucucgaucuuccuacaccucgucaaaauccccacccaccgacacauugucggaaaacccugcccccgcccacacagacucaaccacauggggaucugcucuugcggccuauacaaacaacccggcguccccgucaaauggaaacgcuag

SEQ ID NO: 3073 - RNA, 1476 nt, Artificial Sequence
  derived and/or modified CDS sequence (opt11) from Lassa virus__AIT17344__GPC
augggccaaaucguaaccuucuuccaagaagucccacacgucauagaagaagucaugaacaucguccuuauagcccucagcauccucgcaguccucaaaggacucuacaauuucgcaacaugcggccuugucggccucgucaccuuccuccugcucugcggccgcuccugcacuacaucccuauacaaaggcgucuacgagcuacaaacccucgaauuaaacauggaaacccuuaacaugacgaugccccucucuuguaccaaaaacaacucccaccauuacauuauggucggcaacgaaacaggccuagaacugacccuaacaaacaccucaaucauaaaccauaaauuuugcaaccucagcgacgcccacaagaaaaaccucuacaaccacgcacuaaugucgaucaucuccacauuccaccucuccauucccaacuucaaccaauacgaagccauguccugcgacuucaacggcggaaaaaucuccguccaauacaaccucucacacuccuacgccggcgacgccgccucucacugcggcacaguagccaacggcguccuccaaacauucaugcgaauggccuggggcgguucguacaucgcacuagauuccggcuacggaaaaugggacugcaucaugaccagcuaccaauaccucaucauccagaacaccaccugggaagaccacugccaauucucccgccccucgcccauuggauaccucggacuccuaucucaacgcacccgagacaucuacauaucccgccgccuccucggaaccuucacauggacccucucagacuccgagggaaaagacacacccggcggcuacugccucacucgcuggaugcuaaucgaagccgaacuaaaaugcuucggaaacaccgccgucgccaaaugcaacgagaaacacgacgaagaguucugcgacaugcuucgccuguucgacuucaacaagcaagccauccaacgacuuaaaaccgaagcccaaauguccauccaacucaucaacaaagccgucaacgcccucaucaacgaccaacucaucaugaaaaaccaccuccgagacaucaugggcauccccuacugcaauuacuccaaauacugguaccucaaucacaccacuaccggcaaaaccucccuacccaaaugcuggcucgucuccaacggcuccuaccucaacgaaacccacuucuccgaugacaucgaacaacaagcugacaacaugaucaccgaaaugcuccaaaaagaauacauggaacgccagggcaaaaccccacucggccuaguagaccucuucgucuucaguacuucauucuaccugaucuccauuuuccuucaccuugucaaaauccccacccaccgccacauugucggaaaaucuugucccaagccccaccgccucaaccacaugggcauuuguucgugcggucucuacaaacaacccggcgucccaguacgcuggaaacgguaa

SEQ ID NO: 3074 - RNA, 1476 nt, Artificial Sequence
  derived and/or modified CDS sequence (opt11) from Lassa virus__AIT17348__GPC
augggucaaaucgucacauucuuccaagaaguaccccacgucaucgaagaagugaugaacauaguccucauagcccucucaauacucgccguccucaaaggacucuacaacaucgccacauguggccucaucggccuagugaccuuccuucuacuuugcggacgcucaugcacaacaagccucuacaaaggcgucuacgaacugcaaacccucgaacuuaacauggaaacccugaacaugaccaugccccucuccugcaccaagaacaacucccaccacuacaucauggucggcaacgaaacaggccuugaacucacucucacuaacaccagcauaaucaaccacaaguucugcaaccucuccgacgcccacaagaaaaaccucuaugaccacgcccuaauguccauuaucucuacauuucaccuaucaaucccaaacuucaaccaauacgaagccauguccugcgacuucaacggcggcaaaauauccguccaauacaaccuaucgcacucauacgccggagacgcagccaaucacugcggaaccguagccaacggcguacuccaaaccuucaugcgcauggccuggggaggguccuacaucgcccuagacucaggccgcggccgcugggacugcaucaugaccuccuaccaauaccuaauaauccaaaacacuaccugggaagaccacugccaauucuccagacccuccccaaucggauaccucggccuccuaucacaacggacccgagauauuuacauaagccgccgccuucucggcaccuuuaccuggacccucuccgacucagaaggcaacgacacccccggcggcuacugccucacccgauggaugcucaucgaagccgaacuaaaaugcuucggcaacaccgccguagcaaaaugcaacgaaaaacacgacgaagaguucugcgacaugcuccgccucuuugacuucaacaagcaagccauacagcgcuuaaaagcagaagcccagaugucaauccaacucaucaacaaagcaguaaacgcccucaucaacgaccaacucaucaugaaaaaccaccuccgcgacauaaugggcauccccuacugcaacuacuccaaauacugguaccuaaaccauaccaccacaggcaaaaccagccuacccaaaugcuggcuaguuucaaacggcagcuaccucaacgaaacacacuucucugacgacauagaacagcaggcagacaacaugaucacagaaaugcuacaaaaagaauacauggaacgccagggcaaaaccccucuuggacucguugaccuauucgucuucuccaccucauucuaccucaucucgauauuccuccaccucgucaaaauacccacccaccgucacaucguuggcaaacccugccccaaaccacacagacugaaccacaugggcaucugcuccugcggccucuacaaacaacccggcguccccgucaaauggaaacgcuaa

SEQ ID NO: 3075 - RNA, 1476 nt, Artificial Sequence
  derived and/or modified CDS sequence (opt11) from Lassa virus__AIT17350__GPC
augggccaaauagucaccuucuuccaagaagucccccacgucaucgaagaagucaugaacaucguccuuaucgcccuauccauacuugcaguccucaaaggccuuuacaacguggcaacaugcggacucaucggccucguuaccuuccuccuacucugcggccgcuccugcaccaccacccucuacaaaggaguauacgaacuccaggcccucgaacucaacauggaaacccucaacaugaccaugccacucucaugcaccaaaaacaacucccaucacuacaucauggucggcaacgaaaccggccuagaacucacccucacaaacacauccaucaucgaccacaaauucugcaaccucuccgacgcccacaagaaaaaccucuacgaccacgcccucaugagcauaauauccacuuuccaccucuccauaccaaacuucaaccaauacgaagcaauguccugcgacuucaauggcggcaaaaucagcguccaauacaaucucucccacagcuacgcaggcgacgcggccaaacacugcggcacagucgccaacggaguccuccaaacuuucaugcgcauggccuggggcggaagcuacauugcacucgacuccggaagaaacggcugggacugcgucaugaccuccuaccaguaccucaucauccaaaacaccaccugggaagaccacugccaauucucacgcccguccccgaucggauaccucggacuccucucccaacgcacccgcgacaucuacaucagccgccgacuacucggcaccuucaccuggacccuaucagacuccgaaggcaaagacacccccggcggcuacugucucacacgauggaugcucauagaagcagaacucaaaugcuucggcaacaccgccguagccaaaugcaacgaaaaacacgacgaagaguucugcgacaugcuccgccucuucgacuucaacaagcaagccauccagcgcuuaaaaaccgaagcccaaaugucuauacaacuaaucaauaaggcaguuaacgcauugaucaacgaccaacuaaucaugaagaaccaccuccgagacaucaugggaaucccauacugcaacuacuccaaguacugguaccucaaccacaccgucaccggaaaaaccagccucccccgcugcuggcucgugagcaacggaucguaucuaaacgaaacccacuucuccgacgacaucgaacaacaagccgacaacaugauuacagaaaugcuccaaaaagaauacauagaacgccaaggcaaaacccccuuaggccucguagaccucuuuguuuucuccaccucauucuaccuaaucuccaucuuccuacacuuaguaaaaauccccacacaccgccacauaaucggcaaacccugccccaaaccccacagacuaaaccacaugggcaucugcuccugcggccucuacaaacaacccggcguccccguacgauggaaacgcuaa

SEQ ID NO: 3076 - RNA, 1476 nt, Artificial Sequence
  derived and/or modified CDS sequence (opt11) from Lassa virus__AIT17354__GPC
augggccaaauagucaccuucuuccaagaagucccccacgucaucgaagaagucaugaacaucguccucaucgcccuauccauccuagccguacucaaaggacucuauaacuucgccacaugcggccucgucggacucgucacauuccuccuccucugcggccgcuccugcaccacaucccuauacaaaggcgucuacgaacuacaaacccucgaacuaaacauggaaacccucaacaugaccaugccacugucuugcaccaaaaacaacucccaccacuacauuauggucggcaacgaaacaggacuggaacucacccuuacaaacaucuccauaaucaaccacaaauucugcaaucucagcgacgcacacaagaaaaaccucuacgaccacgcccuaauguccaucaucucaacuuuucaccuuuccauuccaaacuucaaccaguacgaagccaugagcugcgacuucaacggcggcaaaauauccguacaauacaaccucagccacagcuaugccggagacgccgcaaaccacugcggcacagucgcaaacggcguccuccaaacauucaugcgcauggccuggggaggauccuacaucgcccucgacuccggccacggcggcugggacugcauaaugaccagcuaccaauaccuaaucauacaaaacaccacaugggaagaccacugccaauucucccgccccucuccaauaggauaccuaggacuacucagccaacgaacccgcgacaucuacaucucccgccgucuccucggcacguucacuuggacccuauccgacuccgaaggcaaagacacacccggcggcuacugccuaaccagauggaugcuaaucgaggcagaacuaaaaugcuucggcaacaccgccguugcaaagugcaacgaaaagcacgacgaagaauuuugcgacaugcucagacuuuucgacuucaacaagcaagccauacaacgacucaaagccgaggcccagaugucaauccaacuuaucaacaaagccgucaacgcucucaucaacgaccaacugauaaugaaaaaccaccucagagacauaaugggcaucccguacugcaacuacuccaaauacugguaccuaaaccacaccacaacuggaaaaacauccuuacccaaaugcuggcuagucucaaacggcagcuaccucaacgaaacccacuucuccgacgacaucgagcaacaagccgacaacaugauaaccgaaauguuacaaaaagaguacauggaacgccaaggaaaaacuccccucggccucguagaccuauucguauucucaaccuccuucuaccuaaucagcaucuuccuccaccucgucaaaauaccuacccaccgccacauagucggcaaacccugcccccguccccaccgacucaaccacaugggcaucugcucaugcggccuuuacaaacaacccggcguccccgucaaauggaaacgcuga

SEQ ID NO: 3077 - RNA, 1476 nt, Artificial Sequence
  derived and/or modified CDS sequence (opt11) from Lassa virus__AIT17360__GPC
augggacaaaucguaaccuucuuccaagaagucccccacgucaucgaagaagucaugaacaucguccucaucgcccuaucaauacucgcgguucucaaaggccucuacaacuucgcaaccugcggccucguuggacucgucaccuuccuccuccuaugcggccgaucgugcaccaccucccucuauaagggagucuacgaacuacaaaccuuagaacucaacauggagacccucaacaugacaaugccccucuccugcaccaaaaacaacagccaccacuacaucagagucgggaacgagaccggccucgaacucacccucacaaacaccuccaucauaaaccaccgcuucugcaaucuaucagacgcccauaagaaaaaucucuacgaccacgcccuaaugucuaucauauccaccuuccaccucuccauucccaacuucaaccaguacgaagcaauguccugcgacuuuaacggcggcaaaaucucaguccaauacaaccucucacacuccuacgccggagacgccgccaaccacugcggaacagucgcaaacgggguccuccaaaccuucaugcgcauggccuggggaggauccuacaucgcacucgacagcggacacggcaaaugggacugcauuaugacuucguaccaauaccugauaauucaaaacaccaccugggacgaccauugccaauucucccgccccucccccauuggcuaccucggccuccucagccaacgcacacgugacauuuacaucucccgccgacuacucggcaccuucaccuggacccuaucggacuccgaaggcaaagacacuccgggcggauacugccucacccgguggaugcucaucgaagcagaacuuaaaugcuucggaaacaccgcaguagccaaaugcaacgaaaaacacgacgaagaguucugcgauaugcuacgccuauuugauuucaacaaacaagccauccgacgccuuaaagccgaagcccaaauguccauacaacucaucaacaaagccgucaacgcgcucauaaacgaccaacuaaucaugaaaaaccaccucagagacaucaugggcauccccuauugcaacuacuccaaauacugguaccuaaaccauaccacaacaggcaaaaccucccuccccagaugcuggcuaguauccaacggaucauaccucaacgaaacccacuucuccgacgacaucgaacaacaagccgacaacaugaucaccgaaaugcuccaaaaagaauacauggaacgucaaggcaaaacuccacuaggccucgucgaccuuuucgucuucucaaccucauucuaccucauaucuaucuuccuccaccucgucaagauccccacccaccgccacauagucggcaagucaugcccaaaaccccaccgacucaaccacaugggcaucugcuccugcggcuucuacaaacaacccggcgucccagucaaauggaaacgcuaa

SEQ ID NO: 3078 - RNA, 1476 nt, Artificial Sequence
  derived and/or modified CDS sequence (opt11) from Lassa virus__AIT17364__GPC
augggccaaaucguuaccuuuuuccaagaagucccucacgucaucgaagaagugaugaacaucguccucauagcccucucuauccuagccguccuaaaaggccucuacaacuucgcuaccugcggccuagugggccucgucaccuuccuacuccuaugcggacguucaugcacaacuucccucuauaagggcgucuacgaacugcaaacacucgaacucaauauggaaacacucaacaugaccaugccccucucaugcacgaaaaacaacucccaccacuacaucauggucggaaacgaaaccggacucgaacucacccucacuaacacauccaucaucaaucacaaguucugcaaccucuccgacgcccacaagaaaaaccuuuacgaccacgcccucauguccauaaucagcaccuuccaccucucaauaccaaacuuuaaccaauacgaggccauguccugcgacuucaacggaggaaaaaucuccguacaauacaaccucucccacuccuacgccggagacgccgccaaccacugcggaaccgucgcaaacggcguccuccaaacuuucaugcgcauggcauggggcggcagcuacaucgcccucgacaguggccgugaccgcugggacugcaucaugaccuccuaccaguaccuaaucauccaaaacaccacaugggaagaccacugccaauucucccgccccucgcccaucggcuaccugggccuucucucccagcgcacccgagacauauacaucucccgccgccuccucggcacauucaccuggacccucucagacucagaagguaaagacacccccggcggauacugccuuacccgcuggaugcucauugaagccgaacugaaaugcuucggaaacaccgccgucgccaaaugcaacgaaaaacacgacgaagaguucugcgacaugcuccgccucuucgauuucaacaaacaagcaauacaacgccucaaagccgaagcccagauguccauccaauuaaucaacaaagccgucaacgcccuuauaaacgaccaacuaaucaugaaaaaccaccuccgcgacaucaugggcauucccuacugcaacuacuccaaauacugguaccugaaccacaccaccacaggaaaaaccagccuacccaaaugcuggcuugucuccaacggauccuaccucaacgaaacccacuucuccgacgacauagaacaacaagccgacaacaugaucaccgaaaugcuccaaaaagaauacaucgaaaggcaaggcaaaacuccccucggccucgucgaccucuucgucuuuucaaccagcuuuuaccucaucucgaucuuccuccaucucguaaaaaucccaacacaccgccacaucgucggcaaacccugccccaaaccccaccggcucaaccacaugggcauaugcucaugcgggcuauacaaacaaccaggcgucuccgucaaguggaaacgcuaa

SEQ ID NO: 3079 - RNA, 1476 nt, Artificial Sequence
  derived and/or modified CDS sequence (opt11) from Lassa virus__AIT17368__GPC
augggccagauagucaccuucuuucaagaagucccccacguuaucgaagaagucaugaacauuguacucaucgcacuuagcauccuagcaguccuaaaaggacuauacaacuucgccaccuguggucucguaggucucguaaccuuccuucuccucugcggccgcucaugcacaacaucccucuacaaaggcgucuacgaacuccaaaccuuagaacucaacauggaaacccucaacaugacaaugccccuaagcugcacaaaaaacaacucccaccacuacaucauggucggaaacgaaaccggccucgaacucacacuaaccaacaccagcaucaucaaccacaaauucugcaaccucucugacgcccacaaaaaaaaccucuacgaucacgcccucauguccaucaucuccaccuuccaccucagcaucccuaacuuuaaccaauucgaagccauguccugcgacuucaacggcggcaaaauauccguccaauacaaccugagccacuccuacgccggcgacgccgcaaaucacugcggcaccgucgccaacggugugcuacagacauucaugcgcauggcuuggggcggcuccuacaucgcccucgacuccggccacuccaaaugggacugcaucaugacaagcuaccaauaccuaaucauccagaacacaacuugggacgaccacugucaauucucccgccccagccccaucggcuaccuaggacuccucagccaacgcaccagagacauauacaucucacgacgcuuacucggaaccuuuaccuggacccuaucggacuccgaaggaaaagacacacccggugguuacugucucacccgcuggaugcucaucgaagccgaacucaaauguuucggaaacacagcagucgccaaaugcaacgaaaaacacgacgaggaauuuugcgacaugcuccgccuuuucgacuucaacaaacaagcgauccaacgccucaaagcagaagcccaaauguccauccagcucaucaacaaagccgucaacgcccucaucaacgaccaacuaauaaugaaaaaccaccuccgcgacauaaugggcauccccuacugcaauuacagcaaauacugguaccucaaccacaccacuaccggaaaaaccucacuccccaaaugcuggcuaguguccaacggcuccuaccucaacgaaacacacuucuccgacgacaucgagcaacaggcugacaacaugaucaccgagaugcuucaaaaagaauacauggaaagacaaggcaaaaccccccucggccucguagaccuauucgucuuuuccaccuccuucuaccuuaucuccaucuuccuccaccuagucaaaaucccaacccaccgccacauugucggcaaaucaugccccaaaccccaccggcuaaacuacaugggcaucugcucaugcggguucuacaaacaacccggcguaccuguaaaauggaaacgcuaa

SEQ ID NO: 3080 - RNA, 1476 nt, Artificial Sequence
  derived and/or modified CDS sequence (opt11) from Lassa virus__AIT17370__GPC
augggccagaucguaacuuucuuccaggaagucccucacgucauugaagaagucaugaacaucguccucaucgcccucagcauccucgcagugcuaaaaggccuauacaacuucgcaaccugcggccucguuggacucgucaccuuccuucuccucugcggccgcagcugcaccaccagccucuauaaaggcgucuacgaacuccaaacccucgaacuaaacauggaaacccuaaacaugaccaugccccucucuugcaccaaaaacaacucccaccacuacaucauggucggcaacgaaacgggccuagaauuaacacucaccaacaccagcaucaucaaccacaaauucugcaaccuauccgacgcccacaagaaaaaccucuacgaucaugcccucaugagcaucaucucaaccuuccaccucuccauccccaauuucaaucaauacgaagccauguccugcgacuucaacggaggaaaaauuucaguacaauacaaccuaagccacuccuacgccggcgacgcugccaaccacugcggaaccguugcaaacggaguccuccaaacuuucaugcgcauggcauggggugguucauacauagcccuagacuccggacgcgaccgcugggacugcauuaugaccucauaccaauaccucaucauccaaaacacuaccugggaagaccacugccaauucucccgccccucaccaaucggcuaccucggccuccucucacaacgcacccgcgacaucuacauaagccggcgccuacucggaaccuucacauggacccucucagacagcgagggcaaagacacacccggcggcuacugccucacccgcuggaugcuaaucgaagccgaacuaaagugcuuuggcaacaccgcagucgccaaaugcaacgaaaaacacgacgaggaauuuugcgacaugcuucgccucuucgacuucaacaaacaagccauccaacgacugaaagcagaggcgcaaauguccauccaacucauuaacaaagcaguaaacgcccucauaaacgaccagcuaaucaugaaaaaccaccucagagacauaaugggcauuccauacugcaacuacagcaaauacugguaccuaaaucacacaaccaccggcaaaaccucucuccccaaaugcuggcucguuuccaacggcagcuaccucaacgaaacacacuucuccgacgauauugagcagcaagccgacaacaugaucacagaaaugcuacaaaaagaauacauggaacgccaaggaaagacaccccucggccucguagaccucuucgucuucucaaccucuuucuaccucaucucaaucuuccuccaucucgucaaaaucccaacacaccgccacaucgucggaaagcccugcccuaaaccccaccgacuuaaccacaugggcauuugcagcugcggacuguacaaacaaccaggcgucucaguaaaguggaaacgcuaa

SEQ ID NO: 3081 - RNA, 1476 nt, Artificial Sequence
  derived and/or modified CDS sequence (opt11) from Lassa virus__AIT17378__GPC
augggucaaaucgucaccuucuuccaagaaguaccccacgucaucgaagaggucaugaacaucguccucaucgcccucagcauccucgccguccugaaaggacuauacaaccucgcuacaugcggacucguuggccuagucaccuuccuccuucuaugcggacgcuccugcaccacuucacuuuacaaaggagucuacgaacuccagacacucgagcuaaacauggaaacccuaaacaugacaaugccacuauccugcaccaaaaacaacucacaccacuacaucauggucggaaacgaaacaggccuugaacugacacucacaaacacuuccaucauaaaccacaaguucugcaaccucuccgacgcccacaagaaaaaccucuaugaccacacucucauguccaucauaucgaccuuccaccucuccauacccaacuucaaccaauacgaagcuaugucaugcgacuucaacggaggaaaaaucucaguccaauauaaccucagccacuccuaugccguagacgccgcaaaccacuguggcacugucgccaacgguguccuccaaaccuucaugcgaauggcguggggcggcucauacaucgcucuagacuccggacgcuccggcugggacugcauaaugacuucauaccaguaccucgucauacaaaacaccaccugggaagaccacugccaauucucccgccccucccccauaggcuaccuaggacuccucucucaacgaacccgggacauuuacaucucccgccgucuccucggaaccuucaccuggacacuauccgauuccgaaggcaaaaacaccccaggcggcuacugccucacccgauggaugcucaucgaagccgaacuaaaaugcuucggcaacaccgcagucgccaaaugcaacgaaaaacacgacgaagaguucugcgacaugcuccgccuauucgauuucaacaaacaagccauccagcgccucaaagccgaagcccaaaugucaauccaacugaucaacaaagcaguaaaugcccuaaucaacgaccaacucauuaugaaaaaccaccuacgcgacauaaugggaaucccauacugcaacuauucgaaauacugguaccugaaccacacuacgaccggcagaacaucccucccacgcugcuggcuagucucaaauggcuccuaccucaacgaaacccacuucucagacgacaucgaacaacaagccgacaacaugauaaccgaaaugcuucaaaaagaauacauggaacgacaaggaaaaaccccucuaggacucgucgaccuauucgucuucuccacuuccuucuaccugaucuccauuuuccuccaccuaguaaaaauccccacacaccgccacaucgucggcaaauccugucccaaaccacaccgccucaaccacaugggcaucugcuccugcgguuucuacaaacaacccggcguaccagucaaauggaaacgauag

SEQ ID NO: 3082 - RNA, 1476 nt, Artificial Sequence
  derived and/or modified CDS sequence (opt11) from Lassa virus__AIT17388__GPC
augggccaaaucgucaccuucuuucaagaaguuccccacgucauagaagaagucaugaacaucguccuuaucgcacucagcauccucgccguccuaaaaggccuauacaacgucgcaaccugcggacucaucggccucgucacuuuccuccuccucugcggccgcucaugcacuaccacccuauacaaaggugucuacgaacuccaagcccuagaacucaacauggaaacccucaacaugacuaugccccuauccugcaccaaaaacaacucccaccauuacauacgagucggcaacgaaacuggccucgaacuaacacucacaaacaccuccauaauaaaucacaaauucugcaaccuauccgacgcccacaagaaaaaccucuacgaccacgcccuaauguccaucaucucaacauuccaccucagcauccccaacuucaaccaauacgaagccaugagcugcgacuucaacggcggcaucaucuccguccaauacaaccuuucacacucuuacgccggcgacgccgccaaccacugcggcaccguagccaauggcguccuccagaccuucaugcgcauggccuggggaggcagcuacauagcacucgacucaggcagaaacggcugggacugcauaaugaccuccuaccaguaccuuaucauccaaaacaccaccugggacgaucacugccaguucucccgccccucaccgaucggcuaccucgggcuccucucccaacgcacccgcgacaucuacaucucgcgccgccuacuaggcaccuuuaccuggacccuauccgacuccgaaggcaaagacacaccaggcggcuauugccucacccgauggaugcugaucgaagcagaacucaaaugcuucgguaacacagcagucgccaaaugcaacgaaaaacacgacgaagaguucugcgacaugcuccgccuauucgacuucaauaaacaagccauucaaagacuaaaaacagaagcccaaaugaauauccaacucaucaacaaagcgguuaacgcccuaaucaacgaccaacuaauaaugaaaaaccaccuccgagacaucaugggcaucccauacugcaacuacuccaaauauugguaccuaaacaacaccgccaccggcaaaacaucccucccccgcugcuggcucguaucaaacggaucauaccucaacgaaacccacuucuccgacgacaucgaacaacaagcugacaacaugauuacagaaaugcuccaaaaagaauacauggaaagacaaggaaaaaccccacucggccucgucgaccuauucgucuucucaacauccuucuaccuaaucucaaucuuccuacaccuagucaaaaucccaacccacagacacauaguaggcaaacccugccccaaaccccauagacucaaccacaucggcaucugcucaugcggccucuauaaacaacccggcgucccaguaaaauggaagcgauaa

SEQ ID NO: 3083 - RNA, 1473 nt, Artificial Sequence
  derived and/or modified CDS sequence (opt11) from Lassa virus__AIT17404__GPC
augggccaaauuaucaccuuuuuccaagaagucccccacgucaucgaagaagucaugaacauaguccucauagcccucucucuccuagccauacuaaaaggcaucuacaacgucgcaaccugcggccucuucggcuuaguauccuuccuccuccuaugcggacgcucaugcuccaccaccuacaagggcguauacgaauuacaaacccucgaauuagacauggccucacucaacaugacaaugccacucuccugcaccaagaacaacucacaccacuauaucaugguaggcaacgaaacaggccuagaacucacccuuaccaacacaucgaucaucaaccauaaauucugcaaccucucagacgcacacaagaaaaaccucuacgaccacgcccucaugucaauaaucucaaccuuccaccucuccauccccaacuucaaccaauacgaagccaugucuugugacuucaacggcggcaaaaucuccguccaauacaaccuaucucacgccuacgccgucgacgccgccaaccacugcggcacuaucgcaaacggcguccuccaaaccuucaugcgaauggcuuggggcggcuccuacauagcucucgacucaggcaaaggcuccugggacugcaucaugaccagcuaccaauaccucauaauacaaaacaccaccugggaagaccacugucaguucagcaggccaucccccaucggcuaccucggccuccucucucaacgaacacgcgacauauauaucagccgccggcuccucggcaccuuuaccuggacccuauccgacuccgaaggcaacgaaacacccgggggauacugccuaacacgcuggauguuaaucgaagccgaacuaaaaugcuucggcaacacagccguagccaaaugcaaugaaaagcacgacgaggaguucugcgacaugcuccgccucuucgacuucaacaaacaggccauacgccgccucaaaaccgaagcucaaauguccauccaacucaucaacaaagcagucaacgcccucauuaacgaccaacuaaucaugaaaaaccaccuccgcgacaucaugggcauccccuacugcaacuacuccaaauacugguaccucaaccacaccgucaccggcaaaacaucccuacccagaugcuggcucgucucaaacggcagcuaccucaacgaaacccacuucuccgacgacaucgaacaacaagccgacaacaugaucacagaacuccuccaaaaagaauacauggaccgccaaggaaaaacuccccucggccucgucgaccuauucgucuucuccaccucauucuaccuaauauccauauuccuccaucucaucaaaaucccaacccaccgccacaucaccggaaaaccaugccccaagccucaccgccucaaucacaugggcaucugcucuugcggccucuacaaacacccaggcguaccaguaaaauggaagcgauaa

SEQ ID NO: 3084 - RNA, 1473 nt, Artificial Sequence
  derived and/or modified CDS sequence (opt11) from Lassa virus__AIT17408__GPC
augggccagaucaucaccuucuuccaagaagugccacacgucauagaagaagucaugaacaucguacucaucgcccucucacuccucgccauccucaaaggcauauacaacgucgccacaugcggccuauucggccucgucucauuccuccuccuaugcggccgcuccuguucaaccacuuacaaaggcguauacgaacuccaaacacuagaacucgacauggccucccuaaacaugacaaugccccucuccugcaccaaaaacaacucacaucacuacauaauggucggcaacgaaacuggacuagaacuaacccuaaccaacaccuccauuaucaaccacaaguucugcaaccucuccgacgcccacaagaaaaaccuuuacgaucacgccuuaauguccauaauaucaaccuuccaccuaucgauacccaacuucaaccaguacgaagccauguccugcgacuucaacggaggcaaaaucuccguccaguacaaccucucccacaccuacgcaguagacgccgccaaccacugcggcaccgucgccaacggaguacuacaaacauucaugcgaauggccuggggcggcuccuauaucgcccucgacucaggaaaaggcucaugggacugcaucaugacauccuaccaauaccucauaauacaaaacacaacaugggaagaccacugccaauuuucucgacccuccccaaucggcuaccuaggccuacucucccaacgcacccgcgacaucuacaucucacgccgccuacucggaacauucaccuggacccucuccgacuccgaaggcaacgaaacccccggcggcuacugucucacccgcuggaugcuuaucgaagccgaacucaaaugcuuuggcaacaccgcaguugcaaaaugcaacgaaaaacacgacgaagaguucugcgacaugcuccgccucuucgacuucaacaaacaagccauccgccgucuaaaaacggaagcccaaaugucaauccaacucaucaacaaagccguuaacgcccuuauuaacgaccagcucaucaugaagaaccaccuccgcgacauaaugggcaucccauacugcaacuacuccaaauacugguaccuuaaccacaccgucaccggaaaaacaucccucccccgcugcuggcuaguuuccaacggcucauaccucaacgaaacccacuucucagaugacauagaacaacaagccgacaacaugaucaccgaacuccuccaaaaagaauacauggaccgccaaggcaaaaccccacuaggacuugucgaccucuucgucuucuccaccucauucuaucucauuuccaucuuucuacaucucgucaaaauccccacccaccgccacgucaucgguaaaccaugccccaaaccccaccgccuuaaucacaugggcauaugcucgugcggccucuacaaacaccccgggguccccgucaaauggaaacgcuga

SEQ ID NO: 3085 - RNA, 1473 nt, Artificial Sequence
  derived and/or modified CDS sequence (opt11) from Lassa virus__AIT17412__GPC
augggccaaauaaucacuuucuuucaagaagucccccacgucaucgaagagguuaugaacauaguccuaaucgcccucucccuccucgccauacucaaaggcauauauaacgucgcaaccugcggccuauucggccucgucuccuuccuccuccucugcggucguagcugcuccacaacauacaaaggcguauacgaacuacagacacucgagcucgacauggccucccucaacaugaccaugccacucuccuguaccaaaaacaacucccaccacuacauaaugguaggaaacgaaaccggccuggaacucacccucacaaacaccuccaucaucaaccacaaauucugcaaccucucugacgcccacaagaaaaaccuauacgaucacgcccucaugucuaucauaucaaccuuucaccucuccauaccaaacuucaaccaauacgaagccaugucaugcgacuucaacggaggaaaaaucagcguccaauauaaccuaucucacgccuacgccgucgaugccgccaaccacugcggcaccaucgccaacggcguccuccaaacauucaugcgcauggccuggggcggcagcuacaucgcccucgacuccggcaaaggcuccugggacugcaucaugaccuccuaccaauaccucaucauacaaaacaccucaugggaagaccacugccaguucucucgccccucucccaucggcuaccucggccuccucucccaacgcacccgcgacaucuacaucucccgacgacuccucggaaccuucacuuggacccuguccgacucagaaggaaacgaaacacccggcggauacugccuuacccgcuggaugcuaaucgaagcagaacuaaaaugcuucggaaacaccgccguagccaaaugcaacgagaaacacgacgaagaguucugcgacaugcuccgccuauucgacuucaacaaacaagcaauccgucgacucaaaacagaagcacaaauguccauccaacucauaaacaaagccgucaacgcacucaucaacgaccaacuuauaaugaaaaaccaccuacgcgacaucauggguauuccguacugcaacuacucaaaauacugguaccuaaaccacacuguaaccggcaaaaccucccucccacgaugcuggcucgucucaaacggcuccuaccugaacgaaacccacuucuccgacgacaucgaacaacaagccgauaacaugaucaccgaauuacuacagaaagaauacauagaucgccaaggcaagacaccccucggacuugucgaucucuucgucuucuccaccuccuucuaccucauauccaucuuccuccaccucgucaaaaucccgacacaucgucacgucauaggcaaacccugccccaaaccccacagacuaaaccacaugggaauaugcuccuguggccuauacaaacaccccggagugccagucaaguggaaacguuaa

SEQ ID NO: 3086 - RNA, 1473 nt, Artificial Sequence
  derived and/or modified CDS sequence (opt11) from Lassa virus__AIT17416__GPC
augggccaaaucauaacuuucuuccaagaagucccccacguuaucgaagaagucaugaacaucguucucauagcccucagccuacuagccauacucaaaggcaucuacaacgucgcaaccugcggccuuuucggccucguauccuuccuccuacucugcggccgcuccugcucaacuaccuacaaaggcguauacgaacuucaaacccuagagcuagacauggccucccuaaacaugaccaugccccucuccugcaccaaaaacaacucucaccacuacaucauggucggaaacgaaaccggccucgaacucacgcuaacaaacacguccauaaucaaccacaaauucugcaaccucucugacgcccaccguaaaaaccuauacgaccaugcccucaugucuauuaucuccaccuuccaccucucgauccccaauuucaaccaauacgaggccauguccugcgacuucaacggcggcaagaucuccguacaauacaaccucucccacgccuacgccgucgacgccgccaaccacugcggcaccaucgcaaacggcguacuacagacauucaugcgcauggccuggggaggauccuacaucgcacuagacuccgggaaaggcucaugggacugcaucaugacauccuaccaauaccucaucauccaaaacaccuccugggaagaccacugccaauucagccgccccucccccauaggauaccuuggccuacucucacaacgcacccgcgacaucuacaucagccgccgccuccuaggaacauucacauggacccuaucugacagcgaagguaacgaaaccccaggcggcuacugccugacacgauggaugcucaucgaagccgaacuaaaaugcuucggcaacaccgcuguagccaagugcaacgaaaaacacgacgaagaguucugcgauaugcuacgacucuucgacuucaacaaacaagccauccgccgccuuaaaacagaagcccaaaugucaauccaacucaucaacaaagccgucaacgcucuaaucaacgaccaacucauuaugaaaaaccaccuccgagacaucaugggcauacccuacugcaacuacuccaaauacugguaccuaaaucacaccgucacugguaaaaccucccucccccguugcuggcucgucucaaacggaucauaucuaaaugaaacucacuucuccgacgacauagaacagcaagccgacaacaugauaaccgaacuacuccaaaaagaauacaucgaccgccaaggcaaaacaccccucggucucguagaccucuucgucuucucaacauccuucuaccucaucucaaucuuccuucaccucgucaagauccccacccaccgccacgucaucggcaaacccugucccaaaccacaccgccuaaaccacaugggcaucuguuccugcggacucuauaagcacccaggcguccccgucaaauggaaacgcuga

SEQ ID NO: 3087 - RNA, 1473 nt, Artificial Sequence
  derived and/or modified CDS sequence (opt11) from Lassa virus__AIT17420__GPC
augggccaaauaauaaccuucuuccaagaagucccacacgucaucgaagaagucaugaacaucguccucaucgcacuaagccuccucgcaauacuaaaaggaaucuacaacgucgcaaccugcggccucuucggcuuggucucuuuccuacuccucugcggccgauccugcuccaccaccuacaagggcgucuacgaacuacaaacccucgaacuugacauggccucccucaacaugaccaugccccucucaugcacuaaaaacaacagccaccacuacaucauggucggcaacgaaaccggacucgaacucacccucacgaacacuucaauaaucaaccacaaguucugcaaucuauccgacgcacacaagaaaaaccuauacgaccacgcucucauguccauaaucuccaccuuccaccuaucaauccccaacuucaaccaauacgaggccauguccugcgauuucaacggcggcaaaauauccguccaauacaaccucucacacaccuacgccgucgacgccgcaaaccacugcgguacaauugcgaacggcgucuuacaaacauucaugcgcauggccuggggaggaucauacaucgcccucgacuccggaaaaggcucaugggacugcaucaugaccuccuaccaguaccucaucauacaaaacaccacaugggaagaucacugccaauucucacgacccucccccauaggcuaccuuggccuucuaucccaacgcacaagagacauauacaucucccgucgccuccuuggcacauucaccuggacccuuucagacuccgaaggcaacgagacccccggcggauacugucucacccgguggaugcucaucgaagccgaacucaaaugcuucggcaacaccgccgucgccaaaugcaaugagaaacacgacgaagaguucugcgauaugcuccgccuauuugacuucaacaaacaagccauccgacgccuaaaaaccgaagcccaaaugagcauccaacugaucaacaaagccgucaacgcccucauaaacgaccaacucaucaugaaaaaucaucuucgagacaucaugggcauccccuacuguaacuacuccaaauacugguaccucaaucauaccgucacaggcaaaaccucccucccccgcugcuggcuagucuccaacggcuccuaccucaacgaaacccacuucucagacgacaucgaacagcaagccgacaacaugaucaccgaacuacuccaaaaagaauacauggaccgccagggaaaaacuccccugggccuagucgaucucuucguuuucuccaccucauucuaccuaaucuccauauuccuccaccucaucaaaauaccaacccaccgccacaucacaggcaaaccaugcccaaaaccccaccgacugaaccacaugggaaucugcuccugcggccucuacaaacaccccggcguccccgucaaauggaaacguuaa

SEQ ID NO: 3088 - RNA, 1473 nt, Artificial Sequence
  derived and/or modified CDS sequence (opt11) from Lassa virus__AIT17424__GPC
augggccaaaucaucaccuucuuccaagaagucccacacgucaucgaagaagucaugaacaucguacugaucgcccucucccuccuagccauccucaaaggcauauacaacgucgcaaccugcggccucuucggccuugucucguuccuccuccuaugcggccgcucuugcucuaccacauacaaaggggucuacgaacuccaaacgcucgaacuugacaugaccaaccucaauaugaccaugccccuauccuguaccaaaaacaacucucaccauuacauuauggucggcaacgaaaccggccucgaacuaacacuuacaaacaccucaaucauaaaccacaaauucugcaaucucuccgacgcacacaagaaaaaccucuacaaccacgcacuuauguccauaauuucuaccuuccaccucuccauacccaacuucaaccaguacgaagccauguccugcgacuucaacggcgggaaaaucagcguacaauauaaccuuucucacgcuuacgccgucgacgccgcaaaccacugcggcaccaucgccaacggaguccuacaaaccuucaugcgcauggccuggggaggauccuacaucgcccucgacuccggaaaaggcuccugggacugcauuaugaccagcuaccaauaccucaucauacaaaacaccacaugggaagaccacugccaauucucacgcccauccccaauaggcuaccucggccuacucucacagcggacacgugacauauacaucucucgccgucuucucggaacguucaccuggacccucucggacucugaagggaacgagacccccggcggcuacugccucacacgcuggaugcuaauagaagcagaacuuaaaugcuucggaaauaccgccgucgccaaauguaacgaaaaacacgacgaagaguucugcgacaugcuccgccuauucgauuucaacaaacaggccauccgccgccucaaaacugaagcccaaaccaauauacaacuaaucaacaaagcagucaacgcccucaucaacgaucagcuuaucaugaaaaaccaccuacgcgacaucaugggcauacccuacugcaacuacucaaaauacugguaccucaaccacaccgucaccggcaaaacaucccucccccgcugcuggcucgucagcaacggauccuaccucaacgaaacccacuucucagacgacaucgaacaacaagccgacaacaugaucacagaacuucuccaaaaagaauacauggaccgccaaggcaaaacuccccucggacuggucgaccucuucguauucuccaccucauucuaccugauuucaaucuuccuccaccucgucaaaaucccaacccauagacacaucaucggcaaacccugcccaaaaccccaccgacuaaaccacaugggcaucugcuccugcggccuauacaaacacccagguguccccgucaaauggaaacgcuaa

SEQ ID NO: 3089 - RNA, 1473 nt, Artificial Sequence
  derived and/or modified CDS sequence (opt11) from Lassa virus__AIT17428__GPC
augggccagauaauaaccuucuuccaagaagucccccacgucaucgaagaagucaugaacauaguccuaaucgcccucucgcuccuugccauccucaagggcaucuacaacguggcaacaugcggacucuucggccuagucucuuuccuccuccucugcggccgcucaugcucaacaaccuacaaaggcgucuacgaacuccaaacccucgaacucgacauggccucccuuaacaugaccaugccccucagcuguaccaaaaacaauucccaccauuacaucauggucggcaacgaaaccggacuagaacucacgcucaccaacaccuccauuauaaaccacaaauucugcaaccucuccgacgcccacaagaaaaaccucuacgaccacgcacucaugucaauaaucucuaccuuccaccucuccauaccaaacuucaaccaauacgaagccaugucaugcgacuucaacggaggcaaaaucuccguccaauacaaccuaucccacaccuacgcagucgacgccgccaaccacugcgggacuaucgccaacggcguccuccaaaccuucaugcgaauggcguggggcggcuccuacauagcucucgacuccggaaaaggcagcugggacugcaucaugaccucauaccaauaccucaucauacaaaacaccaccugggaagaccacugccaauucucccgccccuccccaauaggcuaccuaggccuacuaucccaacguacccgagacaucuacauaucccgucgccuacucggcaccuucacauggacccucuccgacuccgaaggcaaugaaacacccggcggcuauugccucaccagauggaugcucaucgccgccgaccucaaaugcuucgggaacaccgccgucgccaaaugcaacgaaaaacacgacgaagaguucugugauaugcuucgacucuucgacuucaacaaacaagccaucgaacgccuaaaaaccgaagcccaaauguccauccaacuaauaaacaaagccgucaaugcccucauaaacgaccaacuaaucaugaagaaccaccuccgggacaucaugggaaucccauacugcaacuacucuaaauacugguaccuuaaccacaccguaaccggccgcaccucccugccacguugcuggcuuguaucaaacggcucauaccucaacgaaacccacuucucugacgacauagaacagcaagcagacaacaugaucacagaacuccugcaaaaagaauacauggaccgacaaggaaagacaccccucggccuagucgaccuuuucgucuucuccaccuccuucuaccuaauauccaucuuccuccaccuaguacguauaccaacccaucgccacgucaucgguaaacccugccccaaaccccaccgucuaaaccacaugggaauaugcuccugcgggcuauacaaacaccccggaguccccguuaaauggaaacgcuaa

SEQ ID NO: 3090 - RNA, 1473 nt, Artificial Sequence
  derived and/or modified CDS sequence (opt11) from Lassa virus__AIT17430__GPC
augggccaaaucauaacauucuuccaagaaguaccccacgucaucgaagaagucaugaacaucguccucaucgcacucucacugcucgccauccucaagggcauauacaaugucgcaaccugcggccucuucggccuagucuccuucuuacuacuauguggaagauccugcuccacgaccuacaaaggcgucuacgaauuacaaacccucgaacucgauauggccagccuaaacaugacuaugccccuaucuugcaccaaaaacaauucccaccacuacaucauggucggaaaugaaaccggccucgaacucacgcucacaaacaccucaaucaucaaccacaaauucugcaaucucuccgacgcccacaagaaaaaccuauacgaccacgcccucaugucaaucaucuccaccuuucaccucuccaucccuaacuucaaccaauacgaagccauguccugcgacuucaacggcggccgcaucuccguccaauacaaccuaucccacacauacgccgucgacgccgcaaaacacugcggcaccaucgcaaacggagucuuacaaacauucaugcguauggcauggggcggcuccuacaucgcccucgacuccgguaaaggcucaugggacugcaucaugaccucuuaccaauaccucaucauacaaaauacuacuugggaagaccacugucaauucucccgucccuccccuaucgguuacuuaggccuccucucccaacgcacccgagacaucuacaucucccgacgccuacucggcaccuucacauggacccuuucugacuccgaaggcaaugaaacaccgggcggcuacugccucacccgauggaugcucaucgaagcugaacucaaaugcuucggcaacaccgcaguugccaaaugcaacgagaaacacgacgaagaguucugcgacaugcuucgccucuucgacuucaacaaacaggccauccggcgccuaaagaccgaagcccaaauguccauccaacuaaucaacaaagcugucaacgcccucaucaacgaccaacuaaucaugaaaaaucaccuucgugacauaaugggcauaccguauugcaacuacucaaaauacugguaccucaaccacaccguuaccggaaaaacaucccucccacgcugcuggcucguuucuaacggcucauaccuaaacgaaacccacuucucugacgacaucgagcaacaagccgacaacaugauaacagaacuacuccaaaaagaauacaucgaccggcaaggaaaaacaccccugggccuugucgaccucuucgucuucaguaccuccuucuaccuaauaucaaucuucuuacaccuagucaaaaucccgacccaccgccacguaaucggcaaacccugccccaaaccccacagacucaaccacaugggaauaugcucaugcggacucuacaaacaccccggcguaccuguuaaauggaaacgcuaa

SEQ ID NO: 3091 - RNA, 1473 nt, Artificial Sequence
  derived and/or modified CDS sequence (opt11) from Lassa virus__AIT17438__GPC
augggccaaaucaucacuuucuuccaagaagucccccaugucaucgaagaagucaugaacaucguccucauagcccucucccuccucgccauacucaaaggcaucuacaacgucgcaaccugcggccucuuuggccucgucagcuuccuucuccucugcggccgcuccuguagcaccaccuacaaaggggucuacgaacuccagacccuagaacuagacauggccaaccuaaacaugaccaugcccuuauccugcaccaaaaacaacucucaccacuacauccgcgucggaaacgaaaccggccucgaacucacccuuaccaacaccuccaucauaucccacaaauuuugcaaccucuccgacgcacacaagaaaaaccucuacgaccacgcccuaauguccauaaucagcacauuccaccuaucuauccccaauuucaaccaguacgaagcaaugucaugcgacuuuaacggaggcaaaaucuccguccaauacaaccucucgcacacauaugccgucgacgccgccaaccacugcggaaccaucgccaacggcguccuccagaccuucaugcgcauggccuggggcggcuccuacauagcccuagacagcggcaaaggauccugggacugcaucaugaccuccuaucaauaccucaucauccaaaacaccaccugggaagaccacugccaauucucccgaccuucacccaucggcuaccuaggccuccucagccaacgcacccgagacaucuacaucagccgccgccuucucggcaccuucaccuggacacuuuccgacuccgagggaaaagaaacgcccggcggcuacugccucacacgguggaugcucaucgaagcagaacucaaauguuucggcaauacagcuguagccaaaugcaacgaaaaacacgacgaagaguucugcgacaugcucagacuuuucgacuucaacaaacaagccauccgccgccucaaaaccgaagcacaaaugaacauccaacuaaucaacaaggccguaaacgcucuaaucaacgaccaacucaucaugaaaaaucaucucagggacaucaugggaauccccuacugcaacuauuccaaauacugguaccuaaaccacacugucacaggcaaaaccagccucccucgcugcuggcucguuuccaacggaagcuaccuaaacgaaacccacuucuccgacgacauagaacaacaagcagacaacaugaucaccgaacuacuccaaaaagaauacauagaccgccagggcaaaaccccacucggccucgucgaccuauucgucuucucaaccucauucuaccuaaucuccaucuuccuccaccucguaaaaauccccacccaccgccacguaaucggcaaacccugccccaaaccccaucgccuaaaccaaaugggcaucugcuccugcggccuauacaagcaacccggaguccccgucaaauggaaacgcuga

SEQ ID NO: 3092 - RNA, 1473 nt, Artificial Sequence
  derived and/or modified CDS sequence (opt11) from Lassa virus__AIT17442__GPC
augggccaaaucauuaccuucuuccaagaagucccgcacgugaucgaagaaguaaugaacauaguccucaucgcacugucucuccuggcuauucucaaaggcaucuacaacgucgccacaugcggccucuucggccucguaucauuccuccuccucugcggccgcagcugcucaacaaccuacaaaggagucuacgaacuccaaacccucgaacucgacauggcuucccucaacaugaccaugccccucuccugcaccaaaaacaacucccaccacuacaucaugguagguaacgaaacagggcuggaacuuacacucaccaacaccuccauaauaaaccacaaguucugcaaucucuccgacgcccaccgcaaaaaccucuaugaccacgcucucauguccaucaucucuaccuuccaccuuagcauccccaacuucaaccaauacgaagcaauguccugcgacuucaacggcggaaagaucucgguccaguacaaccuaucccacgccuacgccgucgacgccgccaaccacugcggcaccaucgcaaacggcguccuccaaaccuucaugcgaauggccuggggcggcuccuacaucgcacucgacuccggaaaaggaucgugggacugcaucaugaccagcuaccaauaccucaucauccagaauaccuccugggaggaccacugccaguucucacgccccucacccaucggcuaccuaggccuccucucccaacgaacacgcgauaucuacaucucccgccgccuccucgggacauucaccuggacucucuccgacuccgaaggaaacgaaacucccggcggauacugccucacacgcuggaugcuaauagaagcagaacuaaaaugcuuuggcaacaccgcaguugccaaaugcaacgaaaaacacgacgaagaguucugcgacaugcuccgucuauucgauuucaacaaacaagccauccgccgccucaagaccgaagcccaaauguccauccaacucauaaacaaagcaguaaacgcacuuaucaacgaccaacucaucaugaagaaucaccuacgagacaucaugggcauccccuacuguaauuacuccaaauacugguaccucaaccacaccgucaccggaaaaaccucccuaccccgcuguuggcuagucuccaacggcuccuaccugaacgaaacccacuucuccgaugacauagaacaacaagcagacaacaugaucacagaacuccuacaaaaagaauacaucgaccgacaaggcaagacaccccucggacucgucgaccucuuugucuucucaaccuccuucuaccuaaucuccaucuuccuacaccuagucaaaauacccacccaccgccacguaaucggcaagcccugccccaaaccccaccgcaucaaccacauggguaucugcuccugcggccuauacaaacaccccggcguaccaguaaaauggaaacguuaa

SEQ ID NO: 3093 - RNA, 1473 nt, Artificial Sequence
  derived and/or modified CDS sequence (opt11) from Lassa virus__AIT17446__GPC
auggggcaaaucaucacauucuuccaagaagucccccacgucaucgaagaagucaugaacaucguccuaaucgcccucucccuccuagccauucuaaaaggcaucuacaacguagcaaccuguggccuguuuggccuaguauccuuccugcuucuaugcggacgcuccugcaguaccaccuacaaaggcguauacgaacuccaaacacuagaacucgacauggccagccucaacaugacuaugccccucuccugcaccaaaaacaacagccaccacuacaucaugguaggcaacgaaacaggccucgaauuaacccuuaccaacaccuccaucaucaaccauaaauucugcaaccucagcgacgcccacaaaaagaaccuauacgaccacgcacucaugagcaucaucagcaccuuccaccugagcauccccaacuucaaccaauacgaagccaugucuugcgacuuuaacggaggcaaaaucuccguacaauacaaccuaagccacaccuacgcagucgacgcggcaucccacugcgggaccguugccaacggaguacuccaaaccuucaugagaauggccuggggaggaagcuacauagcacucgacucaggcaaaggauccugggacugcaucaugacauccuaccaauaccucaucauccagaauaccaccugggaagaccacugccaauucucccgacccucccccaucggcuaccuaggccuccucucccaacgaacccgcgacaucuacauaucacgacgacugcucggaaccuucaccuggacccuauccgauucagaaggcaacgaaaccccaggcggauacugccucacccgguggaugcuaauagaagcugaacucaagugcuucggcaacaccgccguggcaaaaugcaacgaaaaacacgacgaagaguucugcgacaugcuccgccuauucgacuucaacaaacaagccaucagacgccuaaaaacugaagcccaaaugagcauccagcucaucaacaaagccgucaacgcgcucauaaacgaccaacucaucaugaaaaaccaccuacgcgacauaauggggaucccuuacugcaacuacuccaaguacugguaccucaaccacaccgucaccggcaaaacaucccuacccagaugcuggcucguauccaacggcagcuaccugaacgaaacccacuucucagacgacauugaacaacaagccgacaacaugauaaccgaacuccuacaaaaagaauacauggacagacaaggaaaaacaccccuuggccucguugaccuuuucguauuuuccacguccuucuaccucaucucaaucuuccuccaccucgucaaaaucccaacacaucgacacgucaucgguaaaccgugccccaaaccccaccgccucaaccacaugggaaucugcucaugcggacucuacaaacacccgggaguacccgucaaauggaaacgguaa

SEQ ID NO: 3094 - RNA, 1473 nt, Artificial Sequence
  derived and/or modified CDS sequence (opt11) from Lassa virus__AIT17450__GPC
augggccaaaucauaaccuucuuccaagaaguaccccacgucaucgaagaaguaaugaacaucguccuaaucgcccucucccuccucgccauccucaaaggcaucuacaacgucgcgaccugcggccucuucggccuagucuccuuccuccuccucugcggccgguccugcuccaccaccuacaagggagucuacgaacuacaaacgcuagaacuagacauggccucacucaacaugaccaugccccucuccugcaccaagaacaacagccaccacuacauaauggucggaaacgaaacgggacuagaacucacacucaccaacaccucgaucauaaaccacaaauucugcaaccucuccgacgcccacaagaaaaaccuauacgaccacgcucucauguccaucauauccacuuuccaucugucaauccccaacuucaaccaauaugaagcaauguccugcgacuucaacggcggcaaaauaagcguccaauacaaccuaucccacaccuacgcagucgacgccgccaaccacugcggcacaauagcaaacggaguacuccaaacauuuaugaggauggccuggggcggcucguacaucgcacuagacuccggcaaaggcuccugggacugcaucaugaccuccuaccaauaccucaucauccaaaacacaaccugggaagaccacugccaauucucacgccccucacccaucggcuaccugggccuccucucacaacgaacgagagacaucuauaucagccgcaggcuccuaggcacuuucaccuggacacucuccgacuccgaaggcaacgaaacccccggcggauacugccucacccgcuggaugcucauagaagccgaacucaaaugcuucggaaacacugcagucgccaaaugcaacgaaaaacacgacgaagaguucugcgacaugcuccgccucuucgauuucaacaaacaagccauccgccgccucaaaaccgaagcccaaauguccauacaacucauuaacaaagccguaaacgcccuuauaaacgaccaacuuaucaugaaaaaccaccuacgcgauaucaugggcauacccuauugcaacuacucuaaauauugguaccucaaccacaccguaacaggcaaaaccucccucccacgcugcuggcucguguccaacggauccuaccuaaacgaaacccacuucuccgacgacauagagcaacaagccgacaacaugaucacagaacuacuacaaaaagaauacauagacagacaaggcaaaaccccucucggccucgucgaccuauucguauucuccacaucauucuaucuaauauccauuuuccuccaccucguaaaaauuccaacccaccgccacaucaucggaaaacccugccccaaaccccaccgccucaaccacaugggcaucugcucaugcggacuuuacaagcacccaggcgucccagucaaauggaaacgcuaa

SEQ ID NO: 3095 - RNA, 1473 nt, Artificial Sequence
  derived and/or modified CDS sequence (opt11) from Lassa virus__AIT17454__GPC
augggccagaucaucacauucuuccaagaaguaccacacgucaucgaggaagucaugaacaucguccuaaucgccuucucccuacuagccaucuuaaaaggaaucuacaacgucgcaaccugcggccucuucggacuuguauccuuuuuacuccucugcggccgcuccugcuccaccacauacaaaggagucuacgaacuacaaacccucgagcucgacauggccucccuaaacaugacaaugccacucucaugcaccaaaaacaacucccaccacuacauaauggucgguaacgaaaccggccucgaacuaacccucaccaacacaucuauaaucaaccacaaguucuguaaccucucugacgcccacaaacgaaaccucuacgaccacgcccucauguccaucaucuccacauuccaccuauccauccccaacuucaaccaguacgaagccauguccugugacuucaacggcggcaaaaucucuguccaauacaaccucagccacaccuacgccguagacgccgcaggccacugcggcaccauagccaacggcgucuuacaaaccuucaugcggauggccuggggcggauccuacauagcccuagacuccggcaaaggcuccugggacugcaucaugacauccuaccaauaccuuaucauccaaaacaccaccugggaagaccacugccaauucucccgccccucccccaucggauaccuuggccuccuaucacaacgcacccgcgacaucuacauaucccgcagacuccuuggaaccuucaccuggacccucuccgacucugagggcaacgagacccccggcggcuacugccugacacgcuggaugcuuaucgaagccgaacuaaaaugcuucggaaacaccgccgucgccaagugcaacgaaaaacacgacgaagaguucugcgacaugcuccgccuauucgacuucaacaaacaagccauccgacgccucaaaaccgaagcccaaauguccauccaacucaucaauaaagcugucaacgcccucauuaacgaccaacucaucaugaaaaaccaccuucgagacauaaugggcauacccuacugcaauuacuccaaguacugguaccucaaccauacaaucacaggcaaaaccucccuacccagaugcuggcucgucucaaacggcuccuaccucaacgaaacacacuucagcgacgacaucgaacagcaagcugacaacaugaucaccgaacuucugcaaaaagaauacauggaucgucaaggcaaaacuccucucggcuuaguggaccuauucgucuucucgacaucauucuaccucaucucuaucuuccuccacuuagucaaaauccccacccaccgccacaucaucggaaaacccugucccaaaccacaccgccucaaccacauggguaucugcucaugcggacucuacaagcaccccggaguccccguacgauggaagcgcuaa

SEQ ID NO: 3096 - RNA, 1473 nt, Artificial Sequence
  derived and/or modified CDS sequence (opt11) from Lassa virus__AIT17458__GPC
auggggcaaaucaucaccuucuuccaagaaguuccccauguuaucgaagaagucaugaauaucguccucaucgcccuaucacuacucgcaauccucaagggcauauacaacgucgcuaccugcggccuauucggccucgucuccuuccuccuccuuugcggacgcuccugcucaaccaccuacaagggcguguaugaacuacaaacccucgaacucgacauggccucccucaacaugaccaugccccuauccugcaccaaaaacaacucucaccacuacaucauggucggcaacgaaaccggccucgaacucacccuaacuaauacuucaaucaucaaccacaaauucugcaaccuaucggacgcccacaagaaaaaccucuacgaccacgcccucauguccaucaucucaaccuuccaccucagcaucccuaacuucaaccaauacgaagcuauguccugcgacuucaacggcggaaaaauaucuguccaauacaaccuaucccacaccuacgccauagacgccgccaaccacugcggaaccaucgccaacggcguccuacaaacauucaugagaauggcauggggcggauccuacaucgcacucgacucaggcaaaggcuccugggacuguauuaugaccaccuaccaauaccucaucauacagaacaccacaugggaagaccacugccaauucagccguccaagcccaaucggcuaccugggccuccuaucacagcgcacccgcgacaucuacaucucacgucgcuuacucggaaccuuuaccuggacccuauccgacuccgaaggaaacgaaacucccggcggcuacugccucacacgcuggaugcuaaucgaggccgaacucaaaugcuucgguaacaccgcaguagccaaaugcaacgaaaaacacgacgaagaauuuugcgacaugcuccgccucuucgacuucaacaaacaagcaaucaggcgccucaaaacagaagcccaaauguccauccaacuaauaaacaaagcagucaacgcccucaucaacgaccaacuuaucaugaaaaaccaccuacgcgacaucaugggaauccccuacugcaacuacuccaaauauugguaccucaaccacaccgucacagguaaaaccucccucccccgauguuggcucgucuccaacggcuccuaccucaacgaaacccacuucuccgacgacaucgaacaacaagcagacaauaugauaacagaacuacugcaaaaagaauacauggaccgccaaggcaaaacaccccuaggccucguugaccucuucgucuucucaaccuccuucuaccuuaucucaauauuccuacacuuagucaaaaucccuacacaccgccacgucaucggaaaacccugccccaaaccacaucgccucaaccacaugggcaucugcucaugcggccucuacaaacacccgggcguccccgucaaauggaaacgcuaa

SEQ ID NO: 3097 - RNA, 1473 nt, Artificial Sequence
  derived and/or modified CDS sequence (opt11) from Lassa virus__AIT17462__GPC
augggccaaaucauaacauucuuccaggaagugccccacgucauagaagaggucaugaacaucguacucaucgcccuaagccuccuagccauucugaaaggcaucuacaacgucgccacaugcggacucuucggccucguauccuuccuacuccuuugcggccgcuccugcagcaccaccuacaagggcguuuaugaacuccaaacacuagaacuugacauggccucccucaacaugaccaugccacucucgugcaccaaaaacaacucacaucacuacaucauggucggcaacgaaaccggccuagaacucacccucaccaacaccagcauaaucaaccacaaauucugcaaccucuccgacgcccacaagaaaaaccucuacgaccacgcccuaauguccaucaucuccaccuuccaccuauccauccccaacuucaaccaauacgaggcaaugucaugcgacuucaacggcggcaaaaucuccguccaguacaaccugucccacgccuacgccgucgacgccgccaaccacugcggaaccaucgccaauggcguccuccaaaccuucaugagaauggcauggggcggcagcuacaucgcacuagacuccggcaaaggcuccugggacugcaucaugacuuccuaucaauaccucaucauccaaaacaccaccugggaagaccacugccaauucucccgcccuucccccaucggcuaccuaggccuccucucccaacgcacccgcgauaucuacaucagccgccgccuccucggaaccuucaccuggacccuauccgacucagaaggcaaugaaacacccggcggcuacugccucacccgcuggaugcuaaucgaagccgagcucaaaugcuucggaaacaccgccgucgccaaaugcaacgaaaaacacgacgaagaguucugcgacaugcuccgacucuucgacuucaacaaacaagcaauccgccgccucaagaccgaagcucaaauguccauccagcugaucaacaaagcagucaacgcccucaucaacgaccaacucaucaugaaaaaccaccucagagacauuaugggcauuccuuacugcaacuauuccaaauacugguaccuuaaccacaccguaaccggaaaaaccucucuuccaaaaugcuggcucgucagcaacggcuccuaccuaaacgaaacccacuuuagcgacgacaucgaacaacaggccgauaacaugaucaccgaacuucuacaaaaggaguacaucgaccgccaaggcaaaaccccacuaggacucguugaccuauucguauucucgaccucauucuaccuaaucuccauauuccuccaccucgucaaaauccccacacaccgccacguaauaggcaaacccugccccaaaccccaccgccucaaccacaugggaaucugcaguugcggccucuacaaacacccaggcgucccaguaaaauggaaacgauaa

SEQ ID NO: 3098 - RNA, 1473 nt, Artificial Sequence
  derived and/or modified CDS sequence (opt11) from Lassa virus__AIT17466__GPC
augggccaaaucaucaccuucuuccaagaagucccccaaguaauagaggaaguaaugaacaucguccucaucgcacucucccuccuagccauacuaaaaggcauauacaacgucgcaaccugcggccucuucggccuaguaucauuccugcuccucugcggccguuccugcagcaccacauauaaaggcgucuacgaacuccagacccuagagcucgacauggccucccucaacaugacgaugccccucuccugcaccaaaaauaacucccaccacuacaucauggucggcaacgaaaccgggcucgaacucacacucacaaaccaaucaaucaucaaccacaaauucugcaaccucagcgacgcccacaagaaaaaccuauacgaccacgcacuuaugagcauaaucuccaccuuccaccuauccauccccaacuuuaaccaauacgaagcaaugagcugcgacuucaacggcggcaaaaucuccguccaguauaaucucucucacacauucgcagucgaugccgccaaccacugcggcaccaucgccaacggcguacuccaaaccuucaugcggauggcuugggguggcucauacaucgcccucgacuccggccgcggauccugggacugcaucaugaccuccuaccaauaccucauaauccaaaauaccaccugggaagaccacugccaauucucccgcccguccccaaucggcuaccuuggccuccuuucccaaagaaccagagacaucuacauuucccgccgacuccucggcaccuuuaccuggacccucuccgacagcgaaggcaacgagaccccuggcggcuacugccucacucgauggauguuaaucgaagcagaauuaaaaugcuucggcaacaccgccguagccaaaugcaaugaaaaacacgacgaagaguucugcgacaugcuacgacucuucgacuuuaacaaacaagccauccgccgccuaaaaaccgaagcccagauguccauucaacuaaucaacaaagccguaaacgcccugauuaacgaccagcucaucaugaaaaaccaccuacgcgauauaaugggcauccccuacugcaacuacagcaaauacugguaccuaaaccacaccauaaccggcaaaaccucccucccccgcugcuggcuaguguccaacggauccuaccuaaacgaaacccacuuuucagacgauauagaacaacaggccgacaacaugaucaccgaacuacuucaaaaagaguacauggaccgacaaggcaaaacaccccucggccuaguggaccucuucguuuucucaaccuccuucuaccugaucucaaucuuccuccaccucgucaaaauccccacacaccgccacgucauaggaaaacccugccccaaaccccaccgccucaaccacauggguaucuguagcugcggccucuacaaacaccccggcguccccgucaaauggaaacgauaa

SEQ ID NO: 3099 - RNA, 1473 nt, Artificial Sequence
  derived and/or modified CDS sequence (opt11) from Lassa virus__AIT17470__GPC
augggccaaauaaucaccuucuuccaagaagucccccacgucaucgaagaggucaugaacauaguccucaucgcacucucacuccucgcaauacucaaaggcauauauaacgucgcuaccugcgggcuuuuuggccucgucuccuuccuccuccuauguggccguuccugcuccaccaccuacaaaggcgucuaugagcuccaaacacucgaacucgacauggccucccucaauaugacaaugccccuauccuguacaaagaacaacucccaccauuacaucauggucggaaacgaaacuggccucgagcuaacacuaaccaacacauccaucaucaaccacaaauucugcaaccucucugacgcccaucgcaaaaaccucuacgaccacgcccucaugucuaucaucuccaccuuccaccuuuccauccccaacuucaaccaauacgaagccauguccugcgacuucaacggcggcaaaauuagcguccaauacaaccucucccacacauacgccgucgacgccgccaaccacuguggcaccaucgcaaacggcguccuccaaaccuucaugagaauggccuggggcggcuccuacauagcccuagacucaggcaaaggcuccugggacuguaucaugacuuccuaccaauaccucaucauccagaacacaaccugggaagaccacugccaauucucucgccccucuccaauuggcuaccuaggccuccucucccagcguacccgcgacaucuacauuucccgccgccuccucggcaccuucaccuggacccucagcgacucagaaggcaacgagacccccgguggcuacugccuaacccgcuggaugcucaucgaagccgaacucaaauguuucgguaacaccgcugucgccaaaugcaacgaaaaacacgacgaagaguucugcgacaugcuucgccucuucgacuucaacaagcaagccauucgccgccucaaaaccgaagcacaaauguccauccaacucaucaacaaagccgucaacgcccucauaaacgaccaacuaaucaugaagaaccaccuccgagacauuaugggcauccccuacuguaacuacuccaaauacugguaccuaaaccacaccgucaccggaaaaaccucccuuccucgcugcuggcucgucagcaacggcuccuaccucaacgaaacccacuucucagacgacaucgaacaacaagccgacaacaugauaaccgaacuccuccaaaaagaguacaucgaccgccaaggcaaaacgccccucggccucgucgaccucuucgucuucuccaccuccuucuaccuaauauccaucuuccuccaccuagucaagauccccacccaccgccacguuaucggcaaacccugccccaaaccacaccgccuaaaccacaugggcaucugcucauguggcuuauacaaacaucccggaguccccguaaaauggaaacgcuag

SEQ ID NO: 3100 - RNA, 1473 nt, Artificial Sequence
  derived and/or modified CDS sequence (opt11) from Lassa virus__AIT17474__GPC
augggacaaaucauaaccuucuuucaagaagucccacacgucaucgaagaggucaugaacaucguccucaucgcccuaucccuccucgcaauccugaaaggaaucuacaacguagcaaccugcggccuauucggccuagucuccuuccugcuccucugcggccggucauguagcaccacauacaaaggcgucuacgagcuccaaacccuagaacuagacauggccucccuaaacaugacaaugccacucuccugcaccaagaacaacucucaccacuacauaaugguaggcaacgaaacgggccuagaacuaacccuuaccaauaccuccauaaucaaccacaaauucugcaaccuaucagaugcccacaagaaaaaucucuaugaccacgcccucauguccaucaucucaaccuuccaucugucaauaccaaacuucaaccaauaugaagccauguccugcgacuucaauggcggaaaaaucuccauccaauacaaccucucccacacguacgccgucgacgcagcaaaccacugcggcacuauagccaacggcguccuccaaaccuuuaugcguauggccugggguggcuccuacaucgcccucgacuccggcaaaggcuccugggacugcaucaugacaagcuaccaauaccuaaucauccagaacacaaccugggaggaccacugccaauucucacgacccucucccaucggcuaccucggccuccuaucccaacgcacacgcgacaucuacauaucccgccgccuacucgguaccuucacauggacacuaucagacuccgaaggcaacgaaaccccaggaggcuacugccucacccgcuggaugcucaucgaggcugaacucaaaugcuucgguaacacagccguugcaaaaugcaacgaaaaacacgacgaagaauuuugugacaugcuucgccucuucgacuucaacaaacaagccauccgccgccuaaaaaccgaggcccaaauguccauccaacucaucaacaaagccguuaacgcgcuuauuaacgaccaacugaucaugaaaaaccaccuccgugacaucaugggaauccccuacugcaacuacuccaaauacugguaccucaaccacacuaucacuggcaaaaccucccucccccguugcuggcucgucuccaacggcuccuaccucaacgaaacccacuucucugacgacauagaacaacaagcugacaacaugauaacagaacuccuacaaaaagaauacaucgaccgacaaggcaaaacaccccuaggccucgucgaccucuucgucuucuccaccuccuucuaccuuaucuccaucuuccuccaccuagucaaaaucccaacccaccgccacaucaccggcaaacccugucccaaaccccacagacucaaccacaugggcauaugcuccugcggauuauacaaacaccccggugucccaguccgcuggaaaagauaa

SEQ ID NO: 3101 - RNA, 1473 nt, Artificial Sequence
  derived and/or modified CDS sequence (opt11) from Lassa virus__AIT17478__GPC
augggucagaucaucaccuucuuccaagaagucccacacgucaucgaagaagucaugaacaucguccucaucgcccuaagccuccuagcaauccuaaaaggcaucuacaaugucgccacaugcggucucuucggccuaguaucauuccuccuacucugcggucgcuccugcucuacaaccuacaaaggcgucuacgaacuccaaacccucgaacucgacauggccucccucaacaugaccaugccacuauccugcaccaaaaacaacagccaccacuacaucauggucggaaacgaaaccggucucgaacucacccucaccaacacuuccaucaucaaucacaaauucugcaaccucucggacgcccacaagaaaaaucucuacgaccaugcccuaaugagcaucaucuccaccuuccaccuaucaauccccaacuucaaucaguacgaagccaugucaugcgacuucaacggcggaaaaaucagcguccaauauaaccucucccacaccuacgccguagaugccgccgaccacugcggcacaauagcaaacggcguccuccaaaccuucaugcgcauggccuggggcggcuccuacaucgcacuggacucaggaaaaggcuccugggauugcauaaugaccuccuaccaauaccuaaucauccaaaacaccacaugggaagaccacugccaguucucccgcccaucaccaaucggcuaccucggucucuuaucccaacgcacaagagacaucuacaucucccgccgccuccucggcacauucaccuggacccuguccgacucagaaggcaacgaaacccccggaggcuacugucuaacccgauggaugcucaucgaagccgaacuaaaaugcuucggcaacaccgccgucgccaaaugcaacgaaaaacacgaugaggaguucugcgacaugcucagacuauucgacuucaauaaacaagccaucucacgacuaaaaaccgaagcccagaugucaauccaacuaauaaacaaagccguuaacgcacucaucaacgaccaacuaaucaugaaaaaccaccuccgggacaucaugggcaucccauacugcaacuacuccaaauacugguaucuaaaccacaccguuaccggcaaaaccucacucccccgcugcuggcuagucuccaacggcucauaccucaacgaaacacauuucucagacgacauugaacaacaagccgacaacaugauuaccgaaaugcuccaaaaagaauacauagaccgccaaggcaaaacaccccuaggccuagucgaccuauucgucuucuccacauccuucuaccucauauccaucuuccuccaccucgucaaaauccccacacaccgccauguaaucggcaaaccuugccccaaaccacaccgccuaaaccacaugggcaucugcucaugcggacuuuacaagcaccccggaguccccgucaaauggaaacgcuaa

SEQ ID NO: 3102 - RNA, 1473 nt, Artificial Sequence
  derived and/or modified CDS sequence (opt11) from Lassa virus__AIT17482__GPC
augggucaaaucaucacguucuuccaagaggucccccacgucaucgaagaaguaaugaacaucguucuaaucgcgcucucacuccucgccauacucaaaggcauauacaacgucgcgaccugcggucucuucggccucgucuccuuccucuuacuaugcggccgcagcugcucaaccacauacaaaggcgucuacgagcuccaaacccuugaacucgacauggccucccucaacaugacaaugccccucucuugcaccaaaaacaacucccaccacuacaucaugguuggcaacgaaacaggcuuagaacucacccucacaaacaccagcaucaucaaccauaaauucugcaaccuauccgaugcccacaagaaaaaccucuacgaccacgcccuaaugucgaucaucuccacauuccaccuauccauucccaauuucaaccaauacgaagccaugucaugugacuucaacggaggcaaaaucucaguccaauacaaccucucacacgccuacgccguagacgccgccaaccacugcggcaccaucgcaaacggggucuuacaaaccuuuaugcgcauggcauggggcggcucauacauagcccuggacuccggcaaaggcuccugggacugcauaaugaccuccuaccaauaccucaucauccaaaacaucacaugggaagaccacugccaauucucacgcccgucacccauagguuaccuaggccuucucucccaacgaacccgcgacaucuacaucucacgccgccuccuaggcacauucacauggacccucucagacuccgaaggcaacgaaacccccgguggcuacugccuaacccgauggaugcucauagaggccgaacucaaaugcuucggcaauaccgccguagccaaauguaacgaaaaacacgacgaagaguucugcgacaugcuccgccuauucgacuucaacaaacaagccauacgacggcuaaaaaccgaagcacaaauguccauccaacuaaucaacaaagccgucaacgcccucaucaacgaccaacucaucaugaaaaaccaccuacgcgacaucaugggcauccccuacugcaacuauuccaaauacugguaccucaaccacaccgucaccgguaaaaccucccucccccgcugcuggcucguauccaacgguuccuaccugaacgaaacccacuucagcgacgacauagagcaacaagccgacaacaugaucacagaacuccuccaaaaagaauauauagaccgccaaggcaagacaccccucggccucguggaccuguucgucuucucaaccucauuuuaccucaucucaaucuuccuacaccuugucaaaauccccacacauagacacgucgucggcaagcccugccccaaaccccaccgacuaaaccacauggggaucugcucuugcggccuuuacaaacaccccggcguccccguaaaauggaaacgcuaa

SEQ ID NO: 3103 - RNA, 1473 nt, Artificial Sequence
  derived and/or modified CDS sequence (opt11) from Lassa virus__AIT17486__GPC
augggccagaucaucaccuucuuccaagaagucccccacgucauagaagaagucaugaacaucguccucaucgcccucucucuacucgccauacuuaaaggcaucuacaacgucgcaaccugcggccucuuuggacucguauccuuccuacuacucugcggccgauccugcucaaccacguacaaaggcgucuacgaacuccaaacacucgaacuagacauggccagccuaaacaugaccaugccccucuccugcacuaaaaacaauucccaccacuacaucaugguagguaacgaaacgggacucgaacucacccucaccaacaccuccaucaucaaccacaaauucugcaaccuguccgacgcccacaagaaaaaccuguacgaccacgcccuuaugucgaucauuuccaccuuccaccucuccauuccaaacuucaaccaguacgaagccaugucaugcgacuucaacggcggcaaaaucucaguacaauacaaccucucccacaccuacgccguagaugccgccaaccacugcggcaccauagccaacggcguccuacaaaccuucaugcgaauggccugggguggauccuauaucgcccucgacuccggcaaaggcuccugggacugcauaaugaccuccuaccaauaccucaucauccaaaacaccaccugggaagaccacugccaauucucccgccccucccccgucggauaccuaggccuccucucccagcggacccgcgacaucuacaucagccgacgacuacucggaaccuucacauggacccucagcgacucugaaggcaacgaaacacccggcggcuacugccucacccgcuggaugcucaucgaagccgagcucaaaugcuucggcaacacagccguggccaaaugcaacgaaaaacacgacgaagaguucugugauaugcuccggcuauucgacuucaacaaacaagcaauccgccgccucaaaaccgaagcucaaaugucaauccaacucauaaacaaagccgucaacgcucugauaaacgaccaacucaucaugaaaaaccaccucagggacauaaugggcaucccauauugcaacuacuccaaauacugguaccuaaaccacacuguaacaggaaaaaccucacucccacgaugcuggcucguauccaacggcucauaccucaacgaaacccauuucuccgacgacaucgaacagcaagccgacaacaugaucaccgaacuccuccaaaaagaauacaucgaccgacaaggcaaaacgccccucggccuaguagaccuauucgucuucuccaccuccuucuaccucaucucaaucuuccuccaccucgucaaaauacccacccacagacacguaaucggaaaacccugccccaaaccccacagacucaaccacaugggcaucugcucaugcggacucuacaaacaccccggcguacccguuaaauggaaacgcuaa

SEQ ID NO: 3104 - RNA, 1473 nt, Artificial Sequence
  derived and/or modified CDS sequence (opt11) from Lassa virus__AIT17490__GPC
augggacaaaucauaaccuucuuccaagaggucccccacgucaucgaagaagucaugaacaucguccucaucacccuaucucuccucgcaauccuaaaaggcaucuacaacgucgcaaccugcggccucuucggcuuagucuccuuccuacugcuaugcggacgauccuguucaaccaccuacaaaggagucuacgagcuccaaacccucgaacuagacauggccaaccuaaacaugacaaugccacucagcugcacgaagaacaacagccaccacuacaucaugguagguaacgaaaccggccucgaacuuacacuaaccaacaccagcaucaucaaccacaaguuuugcaaccucucagacgcccacaagaaaaaccucuacgaccacgccuuaaugucaaucauaagcaccuuccaccucuccauccccaacuucaaccaauacgaggccauguccugcgacuucaauggcggcaaaaucuccguccaauacaaccucucacacaccuucgcagucgacgccgccaaccacugcggcaccaucgccaacggaguccuccaaaccuucaugcgcauggccuggggcggauccuacaucgcccuagacuccggcaaagguuccugggacugcauaaugaccucauaccaguaccucaucauccaaaacaccaccugggaggaccacugccaauucucccgcccaucgcccaucggcuaccucggacuccucucacaacgcacccgcgauaucuacaucucacgacgccuccucggcaccuucaccuggacccucuccgacucggaaggcaaugaaaccccaggcggauacugccucacccgcuggaugcuaauugaagcagaacucaaauguuucggcaacaccgccgucgccaaaugcaacgaaaaacacgacgaagaguucugcgacaugcuccgccuguucgacuucaacaaacaagccauccgucggcuuaaaaccgaagcccaaauguccauucaacucaucaacaaagccguaaacgcacucauaaacgaccaacucauaaugaaaaaccaucuccgcgacaucaugggcauccccuacugcaacuacuccaaauacugguacuugaaccauacugucacaggcaaaacuucccucccccgcugcuggcucgucucuaacggaucguaccuaaacgaaacccacuucuccgacgacauagaacaacaagccgauaacaugauuacagaacucuuacaaaaagaauauauggacaggcaaggcaaaacuccccucggccucgucgaccucuucguauucuccaccuccuucuaccucaucuccaucuuccuacaccucguaaaaauacccacccaccgacacaucaucggcaaaccaugccccaaaccacacagacucaaccacaugggcaucugcuccugcggccucuacaaacaccccggcgucccagucaaauggaaacgcuaa

SEQ ID NO: 3105 - RNA, 1473 nt, Artificial Sequence
  derived and/or modified CDS sequence (opt11) from Lassa virus__AIT17494__GPC
augggccaaaucauaaccuucuuucaagaagucccccacgucaucgaggaagucaugaacaucguacucaucgcccucucccuccuagcgauccucaaaggcguauacaacgucgcuacaugcgguuuauucggccuaguaucuuuccuccuccucugcggccgcucaugcucaaccaucuacaaaggagucuacgaacuacaaacccuagaauuagacauggccucccucaacaugaccaugccccuaucaugcaccaaaaacaacucccaccacuauaucaugguaggaaacgaaaccggacuagaacucacucucaccaacaccuccaucaucaaccacaaauucugcaaucuuuccgacgcacacaaaaagaaccucuacgaccacgcccuaauguccaucaucuccacauuccaccuuuccaucccuaacuucaaccaauacgaagccaugucuugugacuucaacggcggcaaaaucucgguccaauacaaccucagccacacauacgcgguggacgcagcaaaccacugcggcaccaucgccaacggaguccuccagacauucaugcgcauggcaugggguggcuccuacaucgcccuugacuccggaaaaggcucaugggauugcaucaugacauccuaucaguaccucaucauccaaaacaccuccugggaagaccacugccaguucucccgucccuccccuaucggcuaucuaggccuccuaagccaacgcacacgugacaucuacaucuccagacgccuccucggaaccuucaccuggacgcuauccgauuccgaagguaacgaaacacccggcggcuacugccucacacgcuggaugcucaucgaagccgaacuuaaguguuucggcaacaccgccguagccaaaugcaacgaaaagcacgacgaagaguucugcgauaugcuccgccucuucgacuucaauaaacaagccauacgacgccuaaaaacagaagcacaaaugucuauccaacuaaucaacaaagccgucaacgcgcugaucaacgaccaacucaucaugaaaaaccaccuucgagacaucaugggaauccccuacugcaacuacuccaaauacugguaccucaaccacaccgucaccggcaaaacuucccucccccgaugcuggcucgucuccaacggcuccuaccuaaaugaaacacacuucagcgacgacaucgaacaacaagccgacaacaugauuaccgaacuacuacagaaagaauacaucgaccgacaaggcaaaacuccccucggccuagucgaccuauucgucuucucuaccuccuucuaccucauauccauauuccuccaccucgucaaaaucccuacccaccgccacgucaucggcaaacccugcccaaaaccucaucgccucaaccacaugggcaucugcuccugcggccucuacaaacaccccggcguccccgucaaauggaaacgcuga

SEQ ID NO: 3106 - RNA, 1473 nt, Artificial Sequence
  derived and/or modified CDS sequence (opt11) from Lassa virus__AIT17498__GPC
augggccaaaucaucaccuucuuccaagaagucccucacgucaucgaagaagucaugaacaucguccucaucgcccuaucccuucuagcuauacuaaagggcaucuacaauguagcaaccugcggacuauucggccuagucucauuccugcuccucugcggacgcucaugcuccacaaccuacaaaggagucuacgaacuucaaacccucgaacuagacauggcaucccuaaacaugaccaugccucuuuccuguaccaaaaacaacucacaccacuacauaauggucggaaacgaaacaggccuagaacucacccucaccaacaccucaaucaucaaccacaaauucugcaaccuaucagacgcccacaagaaaaaccucuacgaccacgcccucauguccaucaucucaaccuuccaccuauccauccccaacuucaaccaauaugaagccaugucaugugacuucaacggcggcaaaaucuccguccaauacaaccucucccacaccuacgccgucgacgccgccaaccacugcggcaccaucgccaacggcguccuccaaaccuuuaugcguauggcuuggggagguuccuacaucgcccucgacuccggaaaaggcaacugggacugcaucaugaccagcuaccaauaccucaucauccaaaauacuaccugggaggaccacugccaauucucccgcccaucucccaucggcuaccuagggcuccucucacaacgcacccgcgacaucuacauuucacgccgucuucucggcacauuuaccuggacucucucagauuccgaaggcaacgaaacaccaggaggcuacugccucacccgcuggaugcucauagaaaccgagcucaaaugcuucggcaacaccgcggucgccaaaugcaacgagaaacaugacgaggaguucugcgacaugcuccgccucuucgacuucaauaaacaagcgauaagccggcuccgcuccgaagcacaaauguccauccaacucauaaacaaagccgucaacgcccuaaucaaugaccaacucaucaugaaaaaccaccuacgcgacauaaugggcauccccuacugcaacuacuccaaauacugguaccucaaccauaccgucaccggcaaaaccucccucccaaaaugcuggcuagucucaaacggcucauaccugaacgaaacccacuucuccgacgacaucgaacaacaagcugacaacaugaucaccgaaaugcuccaaaaagaauauauagaucgccagggaaaaacaccccucggccucgucgaccucuucguuuucuccacauccuucuaccucauauccaucuuccuccaccuagucaagauacccacccaccgacacauaaccggcaaaccaugccccaagccccaccgccucaaccacaugggcauaugcuccugcggccucuacaaacaccccggcgucccagucaaauggaaacgcuaa

SEQ ID NO: 3107 - RNA, 1473 nt, Artificial Sequence
  derived and/or modified CDS sequence (opt11) from Lassa virus__AIT17502__GPC
auggggcaaauaaucacauucuuucaggaaaucccccacgucaucgaagaagucaugaacaucguacucauaacccucucccuccucgcaauccucaaaggcaucuacaacgucgccacaugcggccucuuuggucuaguauccuuccuccuacucugcggcaaauccugcuccacaaccuacaagggcgucuacgaacuccaaacacucgaacucgacauggccucucucaacaugaccaugccccucucaugcaccaagaacaacucacaccacuacauaaugguaggcaacgaaacaggacucgaacucacucuuaccaacaccucuaucauuaaccacaaauucugcaaccuaucagacgcccaccgcaaaaaccuauacgaccacacgcuaauguccaucaucuccaccuuccaccuauccaucccuaacuucaaccaauacgaagccauguccugcgacuucaacggcgggaaaaucuccguccaauauaaucuaucacacgccuacgcuaucgacgccgccacccacugcggcaccaucgccaacggcguccuccaaaccuucaugcgcauggcuuggggcggcuccuacaucgcccucgacuccggcaaaggcggcugggacugcauaaugaccucauaccaauaccucauuauccaaaacacuaccugggaggaccacugccaauucucccgacccucgccuaucggauaccucggccuacuaucccaacgcacccgcgacauuuacauaucacgccgacuccuaggcaccuucaccuggacccuuucagacagcgaaggcaacgaaacacccggaggcuacugccuaacccgcuggaugcuaauagaggccgaacucaaaugcuucggaaacaccgccgucgcaaaaugcaacgaaaaacacgacgaagaguucugugacaugcuccgccucuucgacuucaacaagcaagccauacggcgccucaaaaccgaagcacagauguccauacaacuaauaaacaaagccguaaacgcccucauaaacgaccaauuaaucaugcgaaaccaccuccgagacauaaugggcauccccuacugcaacuacuccaaguauugguaccuuaaccacacagucacuggcaaaaccagccucccuaaaugcuggcuuguguccaacggcucuuaccucaaugaaacacacuuuucagaugacaucgaacaacaggccgauaacaugaucacagaacuacuccaaaaagaauacauggaccgccagggaaaaacaccccucggucuagucgaccucuucguauucucuaccuccuucuaccuuaucuccaucuuccuccaccuaguaaagauacccacccaccgccacgucaucggcaaaccaugccccaaaccccaccgccugaaccacaugggaguaugcuccugcggacuauacaagcaccccggcgucccugucaaauggaaacgcuaa

SEQ ID NO: 3108 - RNA, 1473 nt, Artificial Sequence
  derived and/or modified CDS sequence (opt11) from Lassa virus__AIT17506__GPC
augggccagaucaucaccuuuuuccaagaagucccucacgucaucgaagaagucaugaacaucguccucaucgcccucagccuccucgccauacuaaaaggcaucuacaacguagcaacauguggccucuucggccucgucucauuccuccucuuaugcggcagaagcugcagcaccacauacaaaggagucuacgaacuacaaacccucgaacuugacauggcaucacuuaacaugaccaugccacucuccugcaccaaaaacaacucccaucacuacaucaugguaggaaacgaaaccggccucgaacucacacuaacaaacacaagcaucaucaaccacaaauucuguaaccuuuccgaugcacacaagaaaaaccucuacgaccacgcccugauguccaucaucuccaccuuccaccuauccaucccaaacuucaaccaguacgaagccaugucaugugacuucaacggaggcaaaaucagcguccaauacaaccucucccacgccuacgccgucgacgccgccgaacacugcggcaccaucgccaacgggguccuccaaacguucaugcguauggccuggggcggauccuacaucgcccuagacucuggcaaaggauccugggacugugucaugacaucauaccaauaucuaaucauccaaaacacaaccugggaagaccacugccaauucucgcgccccuccccgaucggcuaccuaggccuccucucacaacgaacuagggacaucuacaucucccgccgccuccucggcaccuucaccuggacacucuccgacucugaagguaacgaaacacccggcggauacugccucacccguuggaugcucaucgaagccgaacucaaaugcuucggaaacaccgccguagccaaaugcaacgaaaaacacgacgaagaguucugcgacaugcuucgacucuucgacuucaacaagcaagccaucgaacgucucaaaaccgaagcacaaauguccauacaauuaaucaacaaagcagucaacgcacucaucaacgaccaacucaucaugaaaaaccaccuccgcgacaucaugggcauacccuacugcaacuacagcaaauacugguaucucaaccacaccguaaccggaaaaaccucccucccccgcuguuggcuagucucaaacggauccuaccuaaacgaaacccacuucagcgacgauaucgaacagcaagccgauaacaugaucaccgaaaugcuucagaaggaauacaucgaccgccaaggcaaaacaccccuuggacuugucgaccucuucgucuucucuaccucauucuaccucaucucaaucuuucuccaccucgucaaaaucccaacccaccgccacguaauaggcaaacccugcccaaaaccccaccgacuaaaccacaugggcaucugcuccugcggccucuacaaacacccaggcguccccguaaaauggaagcgcuaa

SEQ ID NO: 3109 - RNA, 1473 nt, Artificial Sequence
  derived and/or modified CDS sequence (opt11) from Lassa virus__AIT17510__GPC
augggccaaaucaucaccuucuuccaagagguaccccacgucaucgaagaagucaugaacaucguacucauagcccucucccuccucgcuauccuuaaaggcaucuacaacgucgcuaccugcggacuauucgggcucgucuccuuccuacuacucugcggacgcucaugcucgaccaccuacaaaggcguauacgaacuccaaacccucgaacuagacauggccucccucaacaugaccaugccucuuucaugcaccaaaaacaacucacaccacuacauaaugguuggaaacgaaacaggccucgaacucacucucaccaauaccucaaucauaaaccacaaguuuugcaaccucuccgacgcccauaagaaaaaccucuacgaccacgcccucauguccaucaucagcaccuuccaccucucaauccccaacuucaaccaauacgaagccaugucaugcgacuucaacggcggcaaaaucucaguucaauacaaccuaucacacaccuaugccgucgacgccgcuaaccacugcggcaccauugcuaacggcguccuccaaaccuucaugcguauggcauggggcggcagcuacaucgcauuagacuccggcaaaggcuccugggacugcaucaugacgagcuaccaauaucucaucauccaaaacacaacaugggaggaccacugccaauucucccgcccuucccccauaggcuaccucggccuccucucccaacgaacaaaagacaucuacaucucacgccgucuacucggcaccuucaccuggacccucucagacuccgaaggcaacgaaacccccggcgguuacugucucacccgcuggaugcuuaucgaagccgaacucaaaugcuucggcaacaccgccgucgcaaaauguaacgaaaaacacgacgaagaguucugcgacaugcuccgccucuucgacuucaacaaacaagccauccgccgccucaaaaccgaagcacaaaugucgauccaacucaucaacaaagccgucaacgcccuaaucaacgaccaacucaucaugaaaaaccaccuccgugacaucaugggaauccccuacugcaacuacuccaaauacugguaccucaaccauacagucacgggcaaaaccucucuaccgcgcugcuggcuaguaucaaacggcuccuaccuuaacgaaacccacuucuccgacgacaucgaacaacaagcggacaacaugauuacagaacuucugcaaaaagaauacauagaccgucaaggcaaaacaccccucggccucguagaccucuucgucuucucaaccuccuucuaccucaucuccaucuuccuccaccucguaaaaauacccacccaccgacacguaauaggcaaacccugccccaaaccucaccgacuuaaccauaugggcaucugcucaugcggacuauacaagcacccuggcguccccgucaaauggaagcgcuaa

SEQ ID NO: 3110 - RNA, 1473 nt, Artificial Sequence
  derived and/or modified CDS sequence (opt11) from Lassa virus__AIT17514__GPC
augggccaaauaaucaccuucuuccaagaagucccucacguuaucgaagaagucaugaacaucguccuaaucgcccucucccuccuagccguacuuaaaggcaucuauaacgucgccacaugcggccuauucggacucguauccuuccuccuucucugcggccgcagcugcucuacuaccuacaaaggcgucuacgaacuacaaaccuuagaacuagacauggccucccucaacaugacaaugccacuuuccugcaccaaaaacaacucccaccacuacaucauggucggaaacgaaaccggacuagaacucacacuaacgaacacauccaucaucaaccacaaauucugcaaccucucagacgcccacaagaaaaaccuuuaugaccacgcccucauguccaucauaucgaccuuccaccuauccauccccaacuuuaaccaauacgaagccaugucaugcgacuucaacggcggaaaaaucuccguucaguacaaccucucccacaccuacgcugucgacgcugccaaccacugcggcacaaucgccaacggcguacuacaaacauucaugcgaauggccuggggagguuccuacaucgcccucgacuccggcaagggcucuugggacugcaucaugaccucauaccaguaccucaucauucaaaacaccaccugggaagaccacugccaauucucacgaccgucccccaucggcuaccucggccuacucucacaacgcacacgagacauauacaucucucgacgccuuuuaggcacguucaccuggacucucuccgacuccgaaggcaacgaaacccccggaggcuacugccugacacgauggaugcucauagaggcagaacuaaaaugcuucgguaacaccgccgucgccaaaugcaacgagaaacacgaugaagaguucugcgacaugcuccggcuauucgacuucaacaaacaagccauccgccgccucaaaaccgaagcccaaauguccauacaacucauaaacaaggcugucaacgcgcucauaaacgaccaacucaucaugaagaaccaccuaagagacaucaugggcauccccuacugcaacuacucaaaauacugguaccuaaaccacaccgucaccggcaaaaccucacucccccgcugcuggcucguauccaacggcucuuaccucaacgaaacacacuucucagacgauauagaacaacaagccgacaacaugaucaccgaacuccuccaaaaagaauacaucgaccgccaaggaaaaacaccccucggccucguagaccucuucguauucucaaccuccuucuaccucaucuccauuuuccuccaccuuguaaaaauccccacccacagacacgucaucggcaaaccgugcccaaaaccgcaccgccugaaccacaugggcaucugcuccugcggucucuaccgccaccccggcguccccgucaaauggaagcgauag

SEQ ID NO: 3111 - RNA, 1473 nt, Artificial Sequence
  derived and/or modified CDS sequence (opt11) from Lassa virus__AIT17518__GPC
augggccaaauaaucaccuucuuccaagaagucccccacguaaucgaagaagucaugaacauaguacucaucgcccuaagccuccucgccauacucaaaggaaucuacaacgucgcaaccugcggccucuucggccucguauccuuccuccuccucugcggcagaucaugcuccaccaccuacaaaggcguuuacgaacuccagaccuuagaauuggacauggccagccuaaacaugacaaugccccucagcugcaccaaaaacaacucccaccacuacaucaugguaggcaacgaaaccggccucgagcuaacccuaaccaacaccagcaucaucaaccacaaauucugcaaucuaagcgacgcccacaagaaaaaccucuacgaccacgcccuaauguccaucaucucaaccuuccaccuuuccauaccaaacuucaaccaauacgaagccaugucuugcgacuucaacggaggcaaaauaucgguucaauacaaccucucacacgcauacgccguagacgcugccaaccacugcggcaccaucgccaacggcguccuacaaaccuucaugcgcauggccuggggaggcuccuacaucgcccuggauuccggcaagggaucaugggacugcaucaugaccucauaccaauaccucaucauccaaaacaccacaugggaagaccacugccaauucucccgccccucacccaucggcuaccucggccuccucucccaacgaacccgcgacaucuauaucagccgacgacuccucggcaccuuuaccuggacacucucugacuccgaaggcaacgagaccccaggcggcuacugccuaacacguuggaugcuaaucgaagccgaacucaaaugcuucggcaauacggccgucgccaaaugcaacgaaaagcaugacgaagaguucugcgacaugcuccgccucuucgacuucaacaaacaagcaauccgccgccuaaaaaccgaagcgcaaaugaguauacaacucauuaacaaagccguuaacgcacucaucaacgaccaacuuaucaugaaaaaucaccuccgugacaucaugggcaucccauacugcaauuacuccaaauacugguaccuaaaccacaccguuaccggaaaaacaagccucccccgcuguuggcucgucucaaaugguagcuaccucaacgaaacccacuucagcgacgacaucgaacaacaagccgacaacaugauuaccgaacuucuccaaaaagaauacauggaccgccagggcaaaacaccccucggccugguagaccuauuuguauuuuccaccuccuucuaccugaucagcaucuuccuacaccucgucaaaauacccacccaccgacacguaauaggaaaacccugccccaagccccaucgacuaaaccacaugggaaucuguucaugcggccuauacaaacacccaggcgucccagucaaguggaaacguuaa

SEQ ID NO: 3112 - RNA, 1473 nt, Artificial Sequence
  derived and/or modified CDS sequence (opt11) from Lassa virus__AIT17524__GPC
augggacagaucaucaccuucuuucaagaaguuccacacguaaucgaagaagucaugaacaucguccucaucgcacuaucauuacuagccauccucaaaggcaucuacaacgucgcaaccugcggacuauucggucuagucuccuuccuccuucucugcgggcgcagcugcucaaccaccuacaaaggcguauacgaacuacagacccucgaacucgacauggccucccucaacaugaccaugccccuauccugcaccaaaaacaacucacaccacuacaucauggucggcaacgaaaccggacucgaacuaacauuaacuaacacgucuaucaucaaccacaaauucugcaaccucagcgacgcccacaagaaaaaccucuacgaccacgcccucaugucaaucaucucuaccuuccaccucuccaucccgaacuucaaccaauacgaagccaugagcugcgacuucaacggcggcaaaaucucaguacaauacaaccucucccacaccuacgccauagacgcagccaaccauugcggcacaauagccaacggcguccuacaaacuuucaugcgcauggccuggggcgguuccuacaucgcccucgacucaggcaaaggcuccugggacugcaucaugacauccuaccaauaccucaucauacaaaacaccacaugggaggaccacugccaauucuccagacccucccccauaggcuaccucggccuacucagccaacgcacccgagacaucuacaucucccgacgucuccucggcaccuucaccuggacacucucagacuccgaaggcaacgaaacaccuggcggcuacugccuaacacgcuggaugcuaauagaagcagaacuaaaaugcuucggaaacacagccgucgccaaaugcaacgaaaaacacgacgaagaguucugcgacaugcuccgacuauucgacuucaacaaacaagccauacgccgccucaaaaccgaagcccaaauguccauacaacuaauaaacaaagccgucaacgcccuaaucaacgaccagcucaucaugaagaaccaccuccgagauauaaugggcaucccauacugcaacuacagcaaauacugguacuuaaaccacacagucaccggcaaaacaucccuuccccgaugcuggcuagucaguaauggcuccuaccucaacgaaacccacuucucggaugacaucgaacaacaagcagacaacaugauaaccgagaugcuccaaaaagaauacauggaccgccaaggcaaaacaccccucggacucguggaccucuucgucuucagcaccucuuucuaccugaucuccaucuucuugcaccucguaaaaauacccacccaccgccacguaaucgguaaacccugcccaaaaccccaucgccucaaccacaugggaaucugcuccugcggccucuacaaacaccccggcgucccugucaaauggaagcgcuaa

SEQ ID NO: 3113 - RNA, 1473 nt, Artificial Sequence
  derived and/or modified CDS sequence (opt11) from Lassa virus__AIT17528__GPC
augggccaaaucaucacauucuuccaagaagucccacacgucaucgaagaaguaaugaacauaguccugauagcccucucccuccucgcaaugcucaaaggcaucuacaacaucgcaaccugcggccucuucggccucaucuccuuccuccuccucuguggucgauccugcuccaccaccuacaagggcgucuacgaacuccaagcccucgaacucgacauggcaaaccucaauaugaccaugccacucuccugcaccaaaaacaacucacaccacuacaucaugguuggcaacgaaacaggccucgaacucacccuaaccaacaccuccauaauuaaucacaaauucuguaaccucagcgacgcccacaagaaaaaccucuacgaccacgcacuuauguccaucaucuccacauuccaccucucgauuccaaacuucaaccaauacgaggccaugucgugcgacuuuaacgguggaaaaaucucaguacaauacaaccucucacacaccuacgccggcgacgcggccaaacacugcggaaccaucgccaacggcguacuccaaaccuucaugcgaauggccuggggcggaagcuacauagcacucgacagcggcaaaggaaacugggacugcaucaugacaucauaccaauaccuaaucauccaaaacaccaccugggaagaccacugccaauucucacguccauccccuaucggcuaccucggccuccucagccaacgaaccagagacaucuacauaagccgccgacuacuuggaaccuucaccuggacucucucagacucagaaggcaacgaaacccccggcggcuauugccucacccgcuggaugcucaucgaagcagaacuaaaaugcuucggcaacaccgcggucgccaaaugcaacgaaaaacacgacgaagaguucugcgauaugcuaagacuguucgacuucaacaaacaagccauccgucgacucaaaaccgaagcccaaauguccauccaacuuauuaacaaagccgucaacgcccuaaucaacgaccaacucaucaugaaaaaccaccuccgcgacaucaugggcauccccuacugcaacuacuccaaauacugguaccucaaccauuccgugaccggccggacaucacuaccccgcugcuggcucgucagcaacggaucguaccucaacgaaacccaauuuucagacgacaucgaacaacaggccgauaacaugaucacagaaaugcuccaaaaagaauacauagaccgccaaggaaaaacaccacucggccuaguugaccuauucguauucucaacaucauucuaccucaucucgaucuuccuacaucuaauaaaaaucccuacccaccgccacaucgucggcaagcccugccccaaaccacaccgccucaaccauaugggaaucugcucaugcggccuauacaaacacccagguauccccguaaaauggaagcgcuag

SEQ ID NO: 3114 - RNA, 1473 nt, Artificial Sequence
  derived and/or modified CDS sequence (opt11) from Lassa virus__AIT17538__GPC
augggccagauaauaaccuucuuccaagaaguaccccacguuaucgaagaagucaugaacauaguacucaucgcacucucccuccuugccaucuuaaaaggcauauacaacaucgcaaccugcggccucuucggccuaaucuccuuccuccuccuaugcggccgcuccugcuccacaaccuacaaaggcgucuacgaacuccagacccucgaacuagacauggccaaccucaauaugaccaugccccucucaugcaccaagaacaacucccaccacuacauuauggucggaaacgaaaccggccucgaacucacccucaccaacacgucuauaauuaaucacaaauucugcaaccuauccgacgcccacaagaaaaaccuauacgaccacgcccucaugagcauaauaucuaccuuccaccucucuauccccaacuuuaaccaauacgaagccaugucaugcgacuucaacgagggcaaaaucuccguccaguacaaucucagccacuccuacgccauagacgccgcaggccacugcggcacaaucgccaacggcguccuccaaacauucaugcgaauggccuggggaggcuccuacaucgcccucgauucuggaaaaggcaacugggacugcauuaugaccucauaccaauaccuuaucauccaaaacaccacaugggaagaccacugccaauucucacgacccucccccaucggauaccucggccuucucucccaacgaacacgagacauuuacaucucccgccgccuucucggcaccuuuacauggacccucuccgacuccgaaggcaacgaagcccccggcggcuacugccuaaccagauggaugcucaucgaagccgaacucaaaugcuucggcaacaccgccauagccaaaugcaacgaaaaacacgacgaagaguucugcgacaugcuacggcuauucgacuucaacaaacaagccaucaaacgccucaaagcagaagcccaaauguccauccaccucaucaacaaagccguaaacgcccucaucaacgaccaacuaaucaugaagaaccaccucagagacaucaugggcauccccuacugcaauuacagcaaauacugguaucuaaaccacaccgucacaggcaaaaccucccuccccaaaugcuggcucguuuccaacggcucauaccucaacgaaacccacuucuccgacgacaucgaacaacaagccgacaacaugaucacggaacuccuacaaaaggaauacauggaccgacaaggcaaaacaccccuaggacuuguugaccucuuugucuucuccaccuccuucuaccucaucuccaucuuccuccaccuagucaaaauccccacccacaggcacaucgucggccgccccugccccaaaccccaccgacuaaaccacaugggcauaugcucuugcggauuauacaaacaccccggcgucccagugaaauggaaacguuaa

SEQ ID NO: 3115 - RNA, 1473 nt, Artificial Sequence
  derived and/or modified CDS sequence (opt11) from Lassa virus__AIT17540__GPC
augggccaaauagucaccuucuuccaagaaguaccccacguaaucgaagaaaucaugaacaucguccucaucacccucucccuuuuagccauacucaaaggcauauacaacuucgccacguguggacucaucggccugaucacauuccucuuccuaugcggcagaucaugcuccaccauuuacaaaggcucguaccaacuccaaacccuagaacucaacauggaaacccucaacaugacaaugccccucuccugcaccaaaaauaacucccaccacuacaucagaguaggcaacgaaacaggccuagaacucacacucacaaacacaucaauaaucaaccacaaauucugcaaccucuccgaagcacacaagaaaaaccuguacgaccacgcacucaugagcaucaucuccaccuuccaccucuccaucccgaacuuuaaccaauacgaagccauguccugcgacuucaacggaggcaaaauaucuguacaauacaaucucucccacucauacgcaguugacgccgccaaccacugcggcaccgucgccaacggcguacuccaaacuuucaugagaauggccuggggcggcucuuauaucgcccuggacucgggcaggggcaacugggacugcaucaugaccucuuaccaauaccucauaauccaaaacacaacgugggaagaccacugccaguucucccgacccuccccaauuggauaccucggccuccuaagccaacgaacccgcgauaucuacaucucccgccgccugcuuggaaccuucaccuggacccucagcgacuccgaaggcaaagaaacucccggaggcuacugccucacccgcuggaugcucauagaggccgaacucaaaugcuuuggaaacacagccgucgccaaaugcaacgaaaaacacgacgaagaguucugcgacaugcuacgacucuucgacuucaacaaacaggccauccaacgccuaaaaacagaagcccaaauguccauccaacuuauaaauaaagcugucaacgcccucaucaacgaccaacucaucaugaaaaaccaccuccgcgacaucaugggcauaccauacugcaacuacuccaaguacugguaucucaaccacaccucaaccggccguaccucacuacccaaaugcuggcucgucucgaacggcuccuaccuaaacgaaacccacuucucagacgacauugaacaacaagccgacaacaugauaacagaaaugcuucaaaaagaauacaucgaccgccaaggaaaaacaccacuaggccuagucgaucucuucguauucuccacauccuucuaccuaaucuccaucuuccuacacuuagucaaaaucccaacccaucgacacaucgucgguaaauccugccccaaaccgcaccgacucaaccacaugggcaucugcagcugcggacucuacaaacagcccggcgucccagucaaauggaaacgauaa

SEQ ID NO: 3116 - RNA, 1473 nt, Artificial Sequence
  derived and/or modified CDS sequence (opt11) from Lassa virus__AIT17544__GPC
augggccaaauaauaacauucuuccaagaaguaccacacgucaucgaagaaguaaugaacaucguccucauugcccuuucccuacucgcaauccuaaaaggcaucuacaacguugccacuugcggccuuuuugggcuagucucuuuccuccuacucugcggccguucuugcucaaccacauacaaaggcguauacgaacugcaaacccucgaacucgacaugggcucgcuaaacaugacaaugccccucagcugcaccaaaaacaacucacaccacuacauuauggucggcaacgaaaccggucucgaacucacccucacuaacaccucaaucaucaaccacaaauucuguaaccuuuccgacgcccacaagaaaaaccuauacgaccacgccuuaauguccaucaucuccacuuuccacuuauccauacccaauuucaaccaauacgaagccaugucuugcgacuucaacggcggcaaaaucucaguccaguacaaccucucucacuccuacgcaguagacgcagccaaccacugcggcaccaucgccaacggcguccuccaaaccuucaugagaauggccuggggaggaucauacauagcacuggacuccggcaaaggcuccugggacuguaucaugaccuccuaccaauaccucaucauccagaacacaaccugggaagaccacugccaauucucccgccccucccccauaggcuaccuaggacuccucucacaacgcacccgcgacaucuacaucucacgacgccuucucggcaccuucaccuggacccucucggacucagaagguaacgaaaccccaggcggcuacugccuaacccgcuggaugcuuaucgaagccgaacuaaaaugcuucggcaacaccgccguugcaaaaugcaaugaaaaacacgacgaagaguucugcgacauguuacgacucuucgacuucaacaaacaagcaauccgccgccuuaaaaccgaagcucaaaugucaauccaacucaucaacaaagccgucaacgcccucaucaacgaccaacucauuaugaaaaaccaccuccgcgacauaaugggcauccccuacugcaacuacuccaaauacugguaccuaaaccacaccgucacagguaaaaccucccuaccgcgaugcuggcucgucuccaacggcuccuaccuuaacgaaacccacuucucagacgacaucgaacaacaagccgacaacaugauaaccgaacuccuucaaaaagaauauauggaccgccaagguaaaacaccccucggccuaguagaccucuucgucuucuccaccuccuucuaccucaucagcauauuccuccaccucguaaaaaucccaacacaccgccacaucauagggaaacccugccccaaaccacaccgacucaaccacaugggcauaugcucaugcggccucuauaagcaccccggaguaccagucaaauggaaacgcuaa

SEQ ID NO: 3117 - RNA, 1473 nt, Artificial Sequence
  derived and/or modified CDS sequence (opt11) from Lassa virus__AIT17548__GPC
augggccaaaucaucaccuucuuccaagaaguaccccacgucaucgaagaaguuaugaacauuguccuaaucgcauuaucccuacuugccauccucaagggcaucuacaacgucgcaaccugcggccucuucggacucgucuccuuccucuuuuuaugcggccgcuccugcuccacaaccuauaaaggaguauacgaacuacaaacccuagaacucgacauggccucacucaauaugaccaugccacuaucuugcaccaaaaacaauucccaccacuacaucauggucggcaacgaaaccggacucgaacucacccucacuaacacaucaauaaucaaccacaaauucugcaaccucucggacgcccacaaacgaaaccucuacgaccacgcacuaauguccaucaucagcaccuuccaccucuccaucccaaauuucaaucaauacgaagccaugucaugcgacuucaauggcggcaaaauauccguacaauacaaccucucccacgccuacgcaggcgacgccgccaaacacugcggcaccauagcuaacgguguccuccagaccuucaugcgaauggccuggggcggcucauacaucgcccucgacuccgguaagggauccugggacugcaucaugacuucauaccaauaccuuaucauccaaaacacaaccugggaagaccacugccaauucucacguccuucccccaucggcuaccucggacuccucucccaacgcacccgcgacaucuacauaucccggcgucugcucggcaccuucaccuggacccuauccgauuccgaaggcaacgaaaccccagguggcuacugccucacccgcuggaugcuaauagaagccgagcucaaaugcuucggcaacaccgcagucgccaaaugcaacgaaaaacacgacgaagaguucugugacaugcuacgccucuucgacuucaacaagcaagccauccgccgccuccguaccgaagcccaaauguccauccaacucaucaacaaagcagucaacgcacucaucaacgaccagcucaucaugaaaaaccaccuacgcgacaucaugggaauccccuacugcaacuacuccaaauacugguaucucaaccacaccguuaccggcaaaacaucacuccccaagugcuggcuagucagcaacggcucuuaccuaaacgaaacucacuucucagacgacaucgaacagcaagccgacaacaugauaaccgaaaugcuacagaaagaauacaucgaccgccaaggcaaaacuccccuaggccucgucgaucucuucgucuucuccaccuccuucuaccucaucucaaucuuccuccaccuuguaaaaauacccacccacagacacgucaucggaaaacccugcccaaaaccccaccgccuaaaccacaugggcaucugcuccugcggacucuacaaacaccccggcguacccguaaaauggaaacgauag

SEQ ID NO: 3118 - RNA, 1473 nt, Artificial Sequence
  derived and/or modified CDS sequence (opt11) from Lassa virus__AIT17552__GPC
augggacaaaucaucaccuucuuccaagaagucccccacguaaucgaagaagucaugaacauugugcucaucgcgcucagccuacucgccaucuuaaaagguauauacaacguagccacaugcggccuauucgggcucgucuccuuccuccuccuaugcggacgcagcugcucaaccacauacaaaggcgucuacgaacuacaaaccuuagaacuagacauggccucccuaaauaugacuaugccccucuccugcaccaaaaacaacucacaccauuacauaaugguuggcaacgaaaccggccucgaacucacccuaaccaacaccuccauaaucaaccacaaauucugcaaccucuccgacgcacacaagaaaaaccucuacgaccacgcccucaugucaauaaucuccacauuccaccucaguauucccaacuucaaccaguacgaagccaugagcugcgacuucaacggaggcaaaaucuccguacaauacaaccuaucccacgccuacgccgucaaugccgcaaaccacugcggcaccauagccaauggaguccuccaaaccuuuaugcguauggccuggggaggcuccuacauugcacucgacucaggaaaaggauccugggacugcaucaugaccuccuaccaguaccucaucauccaaaacacaaccugggaagaccacugccaauucucccguccuuccccaaucgguuacuuaggccuccucucccaaagaacccgagacauauacaucagccgccgccuccucggcaccuucaccuggacacuguccgacucagaagguaacgaaacccccggugguuacugcuuaacccgcuggaugcucaucgaagcagaacuuaaaugcuucggcaacaccgcaguagccaaaugcaacgaaaaacacgacgaagaguucugcgacaugcuacgccuauucgacuucaacaaacaagccauccggcgccucaaaaccgaagcccagaugucgauccaacuaauuaacaaagcagucaacgcgcuaauaaacgaccagcuaaucaugaaaaaccaucugcgcgacauaaugggcauaccauacugcaacuacuccaaauacugguaccuaaaccacaccguaaccggcaaaacuucccuaccccgaugcuggcucguauccaacggcuccuaccucaacgaaacacacuucuccgacgacaucgaacaacaagccgacaacaugauaaccgaacuccuacaaaaagaauacauggacagacaaggcaaaacaccccucggccuagucgaccuguucgucuucuccaccuccuucuaccuaaucuccaucuuccuacaccuagucaaaaucccaacccaccgccacguaaucgggaaaccaugccccaaaccccaccgccuaaaccacaugggcaucugcuccugcggccucuacaaacacccaggcguucccgucaaauggaagaaauaa

SEQ ID NO: 3119 - RNA, 1473 nt, Artificial Sequence
  derived and/or modified CDS sequence (opt11) from Lassa virus__AIT17556__GPC
augggccaaauaaucaccuucuuccaagaagucccacacgugaucgaagaaguaaugaacaucguccucauagcccucucccuccucgccauucucaaaggcaucuacaacguugcaaccugcggccuauucggccucguauccuuccuccuacucugcggccgcaguugcagcacaaccuacaaaggcguuuaugaacuccagacccuagaacucgacauggccucccuaaacaugacaaugccacugucaugcaccaagaacaacucccaccacuacaucaugguaggcaacgaaaccggacucgaacucacccugaccaacacuagcaucauaaaccacaaauucugcaaccucuccgacgcccacaagaaaaaucuauacgaccacgcccuaaugucgaucaucuccacauuccaccucucgauccccaacuucaaccaauacgaggcaaugucaugugacuuuaacggcggcaaaaucuccguccaauacaaucuaucccacaccuacgccguugacgcggccaaucauugcggcaccaucgcaaacggcguccuccagaccuucaugagaauggcauggggcggcuccuauaucgcgcucgacagcggccgcggcuccugggacugcaucaugaccuccuaccaauaccuaaucauccaaaacaccaccugggaagaccacugccaauuuagccgcccaucaccaaucggauaccuaggccuccuuucccaacgcacccgagacauauacaucucccgccgccuccucggaaccuucaccuggacacucuccgacucagaaggcaacgaaaccccuggcgguuacugucucacccgcuggaugcucaucgaagccgaacucaaaugcuucgguaacacagcagucgcaaaaugcaacgaaaaacaugacgaggaguucugugacaugcuccgccucuucgacuucaacaaacaagccauccgacgccucaaaaccgaagcccaaaugucaauccaacucaucaacaaagcagucaacgcccucaucaacgaccaacuuaucaugaaaaaccaccucagagauaucaugggcauccccuacugcaacuacuccaaauauugguaccucaaucacaccaucacaggcaaaaccucacucccacgcugcuggcuaguauccaacggcucauacuuaaacgaaacccacuucagcgacgacaucgaacaacaagccgacaacaugaucaccgaacuucuccaaaaagaauacaucgaccgacaaggaaagacaccccuuggccuaguagaccuauuugucuucuccaccagcuucuaccucaucuccaucuuccugcaccuugucaaaauacccacccacagacacauaacaggaaaaccaugcccaaaaccccaccgccucaaccacaugggaaucugcuccuguggacucuacaaacaccccggcguccccguccguuggaaacgauaa

SEQ ID NO: 3120 - RNA, 1473 nt, Artificial Sequence
  derived and/or modified CDS sequence (opt11) from Lassa virus__AIT17560__GPC
augggccaaaucaucacuuucuuccaagaagucccccacguaaucgaagaagucaugaacaucguccucaucgcccuaucccuccuagccguccuaaaaggcauauacaacgucgcaaccugcggucucuucggccucguuucuuuccuacuccuuugcggccgaucuugcuccaccacguacaaaggagucuaugagcuccaaacacucgaacuagacauggccucucuaaacaugacaaugccccuaucaugcaccaccaacaacucccaccacuacaucauggucggcaacgagaccggccuagaacucacccucacaaacaccuccaucaucaaccacaaauucugcaaccucuccgacgcccacaagaaaaaccuauaugaccacgcccuaaugucuauaaucucaaccuuccaucucucuaucccaaacuucaaccaauacgaagccauguccugcgacuuuaacggcggaaaaaucuccguacaguacaaccucucccacgccuacgccggugaggccgccaaccacugcggaaccaucgcuaacggcguccuacaaacauucaugcguauggccuggggcggauccuacaucgcacucgacagcggcaaaggcucuugggacugcaucaugaccuccuacaaauaccucauaauccagaacacaaccuggggcgaucacugccaguucucccgcccuucaccaaucggcuaccucggccuccuaucacaacgcacccgggacaucuacaucucacgccggcuccucgggaccuucaccuggacucucuccgacuccgaaggcaacgagacccccggcggauacugccuaacgcgcuggaugcucaucgaagccgaacucaaaugcuucggcaacaccgcagucgccaaaugcaacgagaaacacgacgaagaguucugcgacaugcuacgccuauucgacuucaauaaacaggccauccgaaaacucaaaaccgaggcccaaauguccauccaacucaucaacaaagccguuaacgcacucaucaacgaccaacucaucaugaaaaaucaccuacgcgacaucaugggaaucccuuacugcaacuacucccgcuacugguaccucaaccauaccgucaccggccgcaccucccuaccccgcugcuggcucguuucuaacggcuccuaccucaacgaaacacacuucuccgacgacaucgaacaacaagccgacaacaugaucaccgagcuacuacaaaaagaauacaucgaccgccaaggaaaaacaccccucggccuuguggaucucuucgucuucucaacaucauucuaccuaaucucaaucuuccuccaccucgucaaaauacccacccaccgccacaucaucggaaaacccugcccaaaaccccaucggcucaaucacaugggaaucuguucaugcgggcucuacaaacaccccggcguacccgucaaauggaaacgcuga

SEQ ID NO: 3121 - RNA, 1473 nt, Artificial Sequence
  derived and/or modified CDS sequence (opt11) from Lassa virus__AIT17564__GPC
augggccaaaucaucaccuucuuccaagaagucccccacgucaucgaagaagucaugaacauuguccuaaucgcccucucacuccuggccauacucaaaggaaucuacaacgucgcaacaugcggccuauuuggacuacucagcuuccuccuacuuugcggccgcuccugcuccaccaccuauaaaggagucuacgaacuccaaacacuagaacucgacauggccucccuaaacaugaccaugccccucaguugcaccaaaaacaacucccaccacuacaucauggucggcaacgaaacaggccuagaacucacccucacaaauaccuccauaaucaaccacaaauucugcaaccucuccgacgcacacaagaaagaccucuacgaccacgcccuaauguccaucauauccacauuccaucucuccauccccaacuucaaccaauacgaagcaauguccugcgacuucaacggcggcaaaauuuccguucaauacaaccucucccacgccuacgccgucgacgcagccaaacacugcggcaccauagccaacggaguacuccaaaccuucaugcgcauggcuuggggcggcuccuacaucgcccuugauucaggcaaaggcuccugggacugcauaaugaccagcuaccaauaccucaucauccaaaacaccuccugggaagaccacugccaauucucccguccaucccccaucggauaccucggucuccuuucacaacgaacacgcgacaucuacaucucccgacgucuccucggcacauucaccuggacacucucugacuccgaagguaacgaaaccccaggcggcuacugccucacccgauggaugcucaucgaagcagaacuaaaaugcuucggcaacaccgccguugcaaaaugcaacgaaaaacacgacgaagaguucugcgacaugcuccgacuauucgacuucaacaaacaagccauaaaacgccuaaagacagaagcccaaauguccauacaacuaaucaacaaagccgucaacgcacugaucaacgaccaacucaucaugaaaaaccaccuccgcgacaucaugggcauccccuacugcaacuacuccaaauacugguaccucaaccacaccgucaccggcaagaccucccuaccccggugcuggcucguuagcaacggcuccuaccugaaugaaacccacuucuccgacgacaucgaacaacaagccgacaacaugaucacugaacuacuccaaaaagaauacaucgacagacaaggcaaaacaccccuaggccuagucgaucuauucgucuucucaaccuccuucuaccucaucucaaucuuccuccaucucgucaaaauccccacccaccggcacgucaucggaaaacccugccccaaaccccaccgacucaaccacaugggcaucugcagcugcggccucuacaaacaccccggcguaccagucaaauggaaacgauaa

SEQ ID NO: 3122 - RNA, 1473 nt, Artificial Sequence
  derived and/or modified CDS sequence (opt11) from Lassa virus__AIT17572__GPC
augggccaaauuaucaccuucuuccaagagguaccacacguaauugaagaaguaaugaacaucguccucaucgcacuaucccuccucgcaauacuaaaagguauauacaacgucgccacuuguggacucuucggccuagucuccuuccuccuacuaugcggccgcucaugcagcaccaccuacaaaggcgucuacgaacuccaaacccucgaacucgacauggccaaccuaaacaugacaaugccccucuccugcaccaaaaacaacagccaccacuacauaauggucgggaacgaaaccggccuugaacucacccuaaccaacaccucaauuaucaaccacaaauucugcaaccuguccgacgcccacaagaaaaaccucuacgaccacgcccugauguccaucaucucaaccuuccaucucucaauccccaacuucaaccaauacgaagccauguccugcgacuucaacggcggcaaaaucuccguccaauacaaccucucccacaacuacgccgucgaugccgccaaccacugcggaacaaucgcaaacggcguccuacaaaccuucaugagaauggcauggggaggauccuacaucgcacucgacuccgguaaaggaaacugggacugcaucaugaccagcuaccaauaccucauaauacagaacaccaccugggaagaccacugccaauucucccgacccucccccaucggcuaccuaggccuccucucacagcgcacccgcgacaucuacaucucgcgacgccuucuuggcaccuuuaccuggacacucuccgacuccgaaggcaacgacaugcccggcggcuacugccuaacccgcuggaugcucaucgaagccgagcucaaaugcuuuggcaacaccgccgucgccaaaugcaacgaaaaacacgacgaagaguucugcgacaugcuacgccucuucgacuucaacaagcaagccauccgccgccucaaaaccgaagcccaaaugaacauccagcucaucaacaaagcagucaacgcccuaauaaacgaccaacuaaucaugaaaaaucaccuccgcgacaucaugggcauccccuacugcaacuacuccaaguacugguaccucaaccacacaguaaccggaaaaaccucacucccccgaugcuggcuagucuccaacggcagcuaccuaaacgaaacccacuucuccgacgacauagaacagcaagccgacaacaugaucacagaacuccuccagaaggaauacauggaccgccaaggaaaaacaccccucggucuagucgaccucuucgucuucucuaccuccuucuaccucauaucuauauuccuacaccucgucaagaucccaacccaccgacacauuaucggcaaaccaugccccaaaccccaccgucucaaucacauggguaucugcucaugcggacuauacaaacaccccggcguuccugucaaauggaaacgcuaa

SEQ ID NO: 3123 - RNA, 1473 nt, Artificial Sequence
  derived and/or modified CDS sequence (opt11) from Lassa virus__AIT17576__GPC
augggacaaauaaucaccuucuuccaggaagucccccacgucaucgaagaagucaugaacaucguccucauagcccucucacuccuggccauacucaagggcaucuacaacguagcaaccugcggccuauucggccucgucuccuuccuacuucuaugcggccgcuccugcagcaccaccuacaaaggcguuuacgaacuccaaacacucgaacucgacauggcaucccuaaacaugaccaugccccucuccugcaccaaaaacaacucccaccacuacaucauggucgguaacgagacaggcuuagaacucacacuuaccaacacauccaucauaaaccacaaauucugcaaccuauccgacgcccacaagaaaaaccuauacgaucacgcacucauguccaucaucuccacauuccaccucucaauccccaacuucaaccaauacgaagccauguccugcgauuucaacggcggaaaaauaucaguccaguacaaccugucacauacguacgccgucgacgccgccaaccacugcggcaccauagccaacggcguccuacagacauuuaugcguauggccuggggcggcuccuacauagcgcucgacuccggcaaaggcaacugggacugcaucaugaccucguaccaauaccucaucauccaaaacacaacaugggaagaccacugccaauucucacgcccauccccaaucgguuaccucggccugcuaucccaacgaacacgagacaucuacauaagccgacggcuccuaggcacauucaccuggacccucuccgacucagaaggcaacgaaacccccggcggauacugccuuacccgcuggaugcucaucgaagccgaacucaaaugcuucggaaacaccgccgucgccaaaugcaacgaaaaacacgacgaagaguucugcgauaugcuccgccucuucgacuuuaauaaacaagccaucucgcgccucaaaaccgaagcucaaaugucgauccagcucaucaacaaagccgucaacgcccucaucaacgaccaacucauaaugaaaaaccaccuccgcgacaucaugggcauccccuacugcaacuacucaaaguacugguaccucaaccauaccguaaccggcaaaaccucccucccacgcugcuggcucgucucaaacggcaguuaccucaacgaaacccacuucucagacgacaucgaacaacaagcugacaacaugaucacggaaaugcuccaaaaggaauacauagacagacaagguaagacaccccugggccucgucgaccucuucgucuucagcacauccuucuaccuaauuagcaucuuccuccaccucgucaaaauacccacccaccgccacaucaccggcaagccuugccccaaaccccaccgccugaaccacaugggcaucugcucuugcggccucuacaaacaccccggugucccaguaaaauggaaaagauaa

SEQ ID NO: 3124 - RNA, 1473 nt, Artificial Sequence
  derived and/or modified CDS sequence (opt11) from Lassa virus__AIT17580__GPC
augggccaaauaaucaccuucuuccaagaaguuccccacgucaucgaagaagucaugaacaucguccuuauagcacuaucccuccucgccauacucaaaggcaucuacaacguagcaaccugcggccucuucggccucgucucauuccugcuccucugcggcagaucaugcuccaccaccuacaaaggcgucuacgaacuacaaacccucgaacuagacauggccucccucaacaugacaaugccccucuccugcacuaaaaacaacucccaccacuacauaauggugggcaacgaaaccggccuugaacucacacucacaaacaccuccaucaucaaccacaaauucugcaaccucuccgacgcccacaagaaaaaccucuacgaccacgcccucaugucaauaaucuccaccuuccaccucuccauccccaacuucaaccaauacgaagccauguccugcgacuucaacggcgguaaaauaaguguucaauacaaccuaucccauacauacgcagucgacgccgccaaccacugcggcaccaucgccaacgggguccugcaaaccuucaugcgcauggccuggggaggcuccuauaucgcccucgauuccggcaaaggaagcugggacugcauaaugaccagcuaccaauaccucaucauucaaaauaccaccugggaagaccacugccaauucucacgacccucaccaaucggcuaccucggccuccucucacaacgaacccgcgacaucuacaucucaagacgccuccucggaaccuucaccuggacccuuuccgacuccgaauccaacgaaacucccggcggauacugccugacacgauggaugcuaaucgaggcagaacucaaaugcuucggcaacaccgccgucgccaagugcaaugagaaacacgacgaggaauuuugcgacaugcuucgccucuucgacuucaacaaacaagcaauccgccgccucaaagcagaggcccaaauguccauccaacucaucaacaaagccguuaacgcacucaucaacgaccagcucauaaugaagaaccaccuccgagacaucaugggcaucccauacugcaacuacucaaaauacugguaucucaaccacaccguaacaggccgaaccucccucccccgcugcuggcucgucagcaacggcuccuaccucaacgaaacccacuucuccgacgacaucgaacaacaagccgacaacaugaucaccgaacugcuccaaaaggaguauauggaccgccaaggcaaaacaccccucggccucgucgaccuauucgucuucucaaccuccuucuaccucaucucaauuuuccuccaccucgucaaaauccccacccaccgccaugucaucggcaaaccaugccccaagccccaccgccucaaccacaugggaauuugcucuugcggccuuuacaaacacccuggcguccccguaaaauggaaacgcuaa

SEQ ID NO: 3125 - RNA, 1473 nt, Artificial Sequence
  derived and/or modified CDS sequence (opt11) from Lassa virus__AIT17584__GPC
augggccagauaaucacauucuuccaagaaguaccacaggucaucgaagaagucaugaacauuguccuuaucgcccuaagccuccucgccauucucaaagguauauacaacgucgcuacaugcggccuuuucggacuugucucauuccuccuccucugcggccgcuccugcuccaccacauacaaaggcgucuacgaacuucaaacacucgaacucgacauggccucccugaacaugacaaugccccucuccugcacaaagaacaacucccaccacuacauaauggucggcaacgaaaccggccucgaacuaacccuaaccaaccaauccaucaucaaucacaaauucugcaaccucuccgacgcccacaagaaaaaccucuacgaccacgcccucaugucuaucaucuccaccuuccaccucucuauacccaacuucaaccaauacgaagccaugucuugcgacuucaacgguggcaaaauaucuguccaauacaaccucucccacuccuucgccgucgacgccgccaaccacugcggaaccaucgccaacggcguccuccaaaccuucaugcgcauggccuggggaggauccuacaucgcccucgacagcggcaaaggaagcugggacugcaucaugaccuccuaccaguaccuaauaauccaaaauaccaccugggaagaccacugccaguuuucccgaccauccccaauaggcuaccucggccuccucagccaacgcacccgcgacaucuacaucucccgacgccuccucggcaccuucaccuggacccucuccgacucugaaggaaacgaaaccccaggcggauacugccuaacccgcuggaugcucaucgaggccgaacuaaaaugcuucgggaacaccgccgucgcgaaaugcaacgaaaaacacgacgaagaguucugcgacaugcuccgccucuucgacuucaacaaacaagcaauccgacgacucaaaaccgaagcacaaaugucaauccaacucaucaacaaagccgucaacgcccuaaucaacgaccaacucaucaugaaaaaccaccuccgcgacaucaugggaauaccauacugcaacuauagcaaauacugguaccucaaccacaccaaaacaggcaagacaagccuaccccgaugcuggcuagucucaaacggcuccuaucucaacgaaacccacuucucagacgacaucgaacagcaagccgacaacaugaucaccgaacuccuccaaaaagaauacauggaccgccaaggaaaaacaccacugggccuugucgaccucuucgucuucucaaccuccuucuaccucaucucaaucuuccuccaccucguaaaaauacccacccaccgccacguaauuggcaaaccauguccaaaaccccaccgccucaaccauaugggcaucugcucaugcggccucuacaaacaccccggcgucccggucaaguggaaacgcuaa

SEQ ID NO: 3126 - RNA, 1473 nt, Artificial Sequence
  derived and/or modified CDS sequence (opt11) from Lassa virus__AIT17588__GPC
augggccaaaucaucaccuucuuccaagaaguuccacacguaaucgaagaaguaaugaacaucguacuaauugcacuaucccuacucgccauccucaaaggaaucuauaacgucgcaaccugcggacucuucggacucgucucuuuccuacuacucugcggccgcuccugcucaaccaccuacaaaggcgucuacgaacugcaaacccucgaacucgacauggccucccucaacaugacaaugccccucuccugcaccaaaaacaacucccaccacuacauaaugguuggcaacgaaaccggucuagaacucacccucaccaacacgucaaucauuaaccauaaauucugcaaccucuccgacgcccacaagaaaaaccucuaugaccacgcccuuauguccaucauaucuacuuuccaccucuccauccccaacuucaaccaguacgaagccauguccugcgacuucaacggcggcaaaauaucaguccaauacaaccuaucccacgccuacgccgucgacgcagccaaucacuguggcaccaucgcuaacgguguucuccaaaccuucaugcguauggccuggggcggcuccuacaucgcccucgacuccgguaaaggcuccugggacugcaucaugacaucauaccaauaucucaucauccaaaacacuacaugggaagaccacugccaauucagccguccuagcccaauagguuaccucggucuacucagccaacgaacccgcgacaucuacaucucgcgccgccuccucggcacauucaccuggaccuugucugacuccgaaggcaacgaaacacccgggggcuacugccuuacccgauggaugcucauagaagccgagcuuaaaugcuucggcaacaccgccgucgccaaaugcaacgaaaaacacgaugaagaguucugcgacaugcugcgacuuuucgauuucaacaaacaggcaauccgacgccucaaagccgaagcacaaauguccauacaacucauaaacaaagcagucaacgcccucauaaacgaccaacuuaucaugaaaaaccaccuacgcgauaucaugggcauccccuauuguaacuacuccaaauacugguaccuaaaccacaccgucaccggcaaaacaucucucccccgcugcuggcucgucuccaacggcuccuaccucaacgaaacccacuucagcgacgacaucgaacaacaagcagacaauaugaucaccgagcuccuccaaaaagaauacaucgaccgccaaggcaaaacaccccucggccucguagaccuauucgucuucuccacuuccuuuuaccucaucuccaucuuccuccaccucguaaaaaucccuacccaccgccacgucaucggaaaacccugcccgaaaccccaccgacucaaccauaugggcaucugcucaugcggccucuacaaacaccccggaguaccuguuaaauggaaacgguga

SEQ ID NO: 3127 - RNA, 1473 nt, Artificial Sequence
  derived and/or modified CDS sequence (opt11) from Lassa virus__AIT17592__GPC
augggccaaauaaucaccuucuuccaagaagucccacacgucaucgaggaggucaugaacaucguacucaucgcccucucacuucuagccauccuaaaaggaaucuacaacgucgcgaccugcggacuauucggccuagucuccuuccuacuacuuugcggucgaucgugcuccaccaccuacaagggcgucuacgaacuucagacccucgaacuugacauggccucccucaacaugacaaugccccucuccugcacgaaaaacaacucccaccacuauauaauggucggcaacgagaccggccucgaacuaacacucacaaacacauccaucaucaaccacaaauucugcaaccucucagacgcccacaagaaaaaccucuacgaccacacccucauguccauaaucuccaccuuccaccuuucaauccccaacuucaaccaauacgaggccaugucaugugacuucaacggcggacgcaucucaguccaauacaaccuaucacacgccuacgccgucgacgcagccaaccacugcggcaccauugcgaauggcguccuacaaaccuucaugcgcauggcauggggcggauccuacaucgcccuagacucaggcaaaggcuccugggacugcauaaugacauccuaccaauaccuuaucauccaaaacaccaccugggaagaccacugccaauuuucccgccccucucccaucggcuaccucggccuccugucucaacgcacccgcgacaucuauaucucccgacgacuccucggaacauucacuuggacccugagcgacuccgagggcaacgaaacccccggcggcuacugccuaacccgcuggaugcucaucgaagcagaacuaaaaugcuucggcaacaccgcagucgccaaaugcaaugaaaaacacgacgaagaauuuugcgacaugcuucgccucuucgacuucaacaaacaggccauccgccgccuuaaaacugaagcccaaaugucaauccaacucaucaacaaagccgucaaugcccucauaaacgaccaacucauaaugaaaaaccaccuccgcgacaucaugggcauccccuacugcaacuacuccaaauacugguacuuaaaccacaccaucaccgguaaaacaucacucccccgcugcuggcuaguauccaacggaagcuaccugaacgaaacccacuucuccgacgacaucgaacaacaagccgacaacaugaucaccgaacugcuccaaaaagaauacaucgaccgccagggaaagacaccccuuggccucguagaccucuucgucuucucaaccagcuucuaccucaucucaaucuuccuccaccucgucaaaauacccacccaccgccacgucguaggcaaacccugccccaaaccccaccgccucaaccacaugggaaucugcuccugcggccuauauaaacaccccggcguccccguaaaauggaaacgauaa

SEQ ID NO: 3128 - RNA, 1473 nt, Artificial Sequence
  derived and/or modified CDS sequence (opt11) from Lassa virus__AIT17596__GPC
augggccaaaucauaaccuucuuccaggaagucccacacguaaucgaagaagucaugaacaucguacucaucgcccuaagccucuuagcuauccuaaaaggcaucuacaacgucgcaaccugcggccuauucggacucguaucauuccuccuccucugcggccgcuccugcagcaccaccuauaaaggcgucuacgaacuacaaacccucgaacuagacauggccucccucaauaugaccaugccccucuccugcacgaaaaacaacucccaccauuacauaauggucggcaacgaaaccggccuagaacucacccucaccaacaccucuaucaucaaucacaaauucugcaaccucagcgacgcccauaagaaaaaccucuaugaccacgcccuuauguccaucaucuccaccuuccaccucuccauucccaauuucaaccaauacgaagccauguccugcgacuuuaacggcggcaaaaucuccguccaauacaaccuaucacacacauacgccgucgacgccgccaaccacugcggcaccauagccaacggcguacuacaaacauucaugcgaauggccuggggaggauccuacaucgcccucgacagcggcaaaggcucgugggacugcauaaugacguccuaccaauaccuaauaauccaaaacaccuccugggaggaccacugucaauucagccgaccaucccccaucggauaccuuggccuccucagccaacgcacccgcgauaucuacaucagccgacgccuccucggcaccuucacuuggacccucucagauuccgaagguaaugaaacccccggcggcuacugccucacccgauggaugcuuaucgaggccgaacugaaaugcuucggaaacacugcagucgcaaaaugcaacgaaaaacacgacgaagaguucugcgacaugcuacgccucuucgacuucaacaaacaagccauccgacgcuuaaaaaccgaagcacaaauguccauccaacucaucaacaaagccguaaacgcccucaucaacgaucaacuaaucaugaaaaaccaccuccgcgacaucaugggaauccccuacuguaacuacuccaaauacugguaccucaaucacacuguaaccggaaagaccuccuugccuaggugcuggcuuguuucaaacgguucauaccucaacgaaacccacuucuccgacgacaucgaacaacaagccgacaacaugaucaccgaacuccuacaaaaagaauacaucgaccgacaaggcaaaacaccccucggccuagucgaccuauucgucuucuccaccuccuucuaccuaaucuccaucuuccuccaccucgucaaaauccccacccaccgccacgucaucggcaaacccugccccaaaccccaccgccucaaccacaugggcaucugcagcugcggacucuauaaacaccccgggguaccagucaaauggaaacgcuaa

SEQ ID NO: 3129 - RNA, 1473 nt, Artificial Sequence
  derived and/or modified CDS sequence (opt11) from Lassa virus__AIT17600__GPC
augggucaaaucauaacauucuuccaagaaguaccccacgugaucgaagaaguaaugaacauaguacugauagcccucagccuccucgcuauccucaagggaaucuacaacgucgccaccuguggacucuucggacucguaucauuccuacuccucugcggccgcuccugcucaaccaccuacaaaggcgucuacgaauuacaaacccucgaacucgacauggcgucacucaacaugacuaugccacuauccugcaccaaaaacaacucccaucacuacaucauggucggcaacgaaaccggacucgaacucacacucaccaacacauccaucaucaaccacaaauucugcaaccuuuccgacgcccacaagaaaaaccucuacgaccaugcccuaaugagcaucauauccaccuuccaccucuccauccccaacuuuaaccaguacgaagcuauguccugcgacuucaacggcggaaaaaucuccguacaauacaaccucucccacgcauaugcuggcgacgccgcaaaccacugcggaaccaucgccaacggaguccuacaaaccuucaugcgcauggccuggggcggcuccuacaucgcccuagacuccggcaaaggcuccugggacugcaucaugacauccuaucaauaccuaaucauccaaaacaccacaugggaagaccacugucaauucucccgccccuccccgaucggcuaccucggacuccuaagccagcgaacccgcgacaucuacaucucccgacgacuccucgguaccuucaccuggacgcuguccgacuccgaaggcaacgaaacgcccggcggcuacugucucacccgcuggaugcuaaucgaagccgaacucaaaugcuucggcaacaccgccgucgcaaaaugcaacgaaaaacacgacgaagaguucugcgacaugcuccgccucuucgacuucaacaaacaagcuauccgccgccuaaaaacagaagcccaaaugagcauccaacucauuaacaaagccguaaaugcccucaucaacgaccaacucauaaugaaaaaccaccuacgcgacauuaugggcaucccuuacugcaacuacucaaaauacugguaccuaaaccacaccguaacugguaaaacaucccucccccgcugcuggcucgucucaaacggaagcuaccucaacgaaacucacuucuccgacgacauagaacaacaagcagacaacaugaucacagaacuccuccaaaaggaauacaucgaccgacaaggcaaaacuccccuaggccucguagaccucuucgucuucagcaccucauucuaucugauaucaaucuuccuccaccucguaaaaauaccaacacaccgucacguuaucggcaaacccugucccaaaccccaccgccuuaaccacaugggaaucugcucaugcggccucuacaaacacccaggcgucccagucaaauggaaaagauaa

SEQ ID NO: 3130 - RNA, 1473 nt, Artificial Sequence
  derived and/or modified CDS sequence (opt11) from Lassa virus__AIT17604__GPC
augggccaaauaaucaccuucuuccaagaggugccacacguaaucgaagaggucaugaacauaguacuaaucgcccucucgcuccuugccauccucaaaggcauauacaacgucgcaaccugcggccucuucggccuagucuccuuccuccuacuaugcggccgcucuugcucaaccaccuacaaaggcgucuacgaacuacaaacccuggaacucgauaugacaucccucaacaugaccaugccacucucaugcaccaaaaauaacagccaccacuacaucauggucgguaacgaaaccggccucgaacucacguuaacaaacaccucaaucauuaaccacaaauucugcaaccucucagacgcccacaagaaagaccucuacgaccacgcccucauguccaucaucuccaccuuccacuuauccauccccaacuucaaucaauacgaagccaugucaugcgacuuuaacggcggcaaaaucuccguacaauacaaccucucccacaccuacgccgucgacgccgccaaacauugcggcaccaucgccaacggaguccuacaaacuuucaugcguauggccuggggcggauccuacauugccuuggacuccggcaaaggcucaugggacugcaucaugaccuccuaccaauaccuaauaauacaaaacaccacuugggaggaccacugccaauucucacggccauccccagucggcuaccucggucuacuuucccagcgaacacgcgacauauacauaagccgccgccuccucggcacuuucacauggacccuuuccgacagcgaaggaaacgaaacccccggaggcuacugccucacccgcuggaugcucauagaagccgaacuaaaaugcuucgguaacaccgccgucgccaaaugcaacgaaaaacacgacgaagaguucugcgacaugcuacgccucuucgacuucaacaaacaagccauccgacgccucaaaacagaagcccaaaugagcauccaacucauaaacaaggccgugaacgcacuaaucaacgaccaacucauuaugaaaaaucaccuccgcgacaucaugggcaucccauacugcaacuacuccaaauacugguaccucaaccacacugucacaggcaaaaccucccuaccacgcugcuggcucguaucaaacggcucuuaccuaaacgaaacccacuucucagaugacaucgaacaacaagccgacaauaugaucaccgaacugcuacagaaagaauaccucgaccgacaaggcaaaacaccccucggccucguagaccucuucgucuucucgaccucauucuaccuaauuucaaucuuccuccaccucgugaaaauccccacccaccgacacgucaucggaaaacccugccccaaaccacaccgccucaaccacaugggcaucugcuccugcggccucuacaaacacccaggaguccccgucaaauggaaacgcuaa

SEQ ID NO: 3131 - RNA, 1473 nt, Artificial Sequence
  derived and/or modified CDS sequence (opt11) from Lassa virus__AIT17608__GPC
augggccaaauaauaaccuucuuccaagaagucccccacgucauagaagaagucaugaacaucguacuuaucgcccuaagccuacucgcaauccucaagggcaucuacaacguggcaaccuguggccucuucggccucgucuccuuccuccuccucugcggucgaucaugcucaaccaccuacaaaggagucuacgaacuccaaacccucgaacucgacauggccucccuaaacaugaccaugccccuaucuuguaccaaaaacaacucucaccacuacauaaugguuggcaacgaaaccggccuagaacucacccucaccaacaccuccaucaucaaccauaaauucugcaaccucuccgacgcccauaaacgaaaccuuuacaaccacgcgcucauguccaucaucuccaccuuccaccugucaauccccaacuucaaucaauacgaagccauguccugcgacuucaacggaggaaagaucuccguccaauacaaccuuucucacaccuacgcagucgacgcagccaaccacugcggaaccaucgcaaacggcguccuccaaaccuucaugcgcauggccuggggcggcuccuacaucgcccucgacuccggcaaagguuccugggacugcaucaugaccucauaccaauaccuuaucauacaaaacacuacaugggaagaccacugccaauucucacgaccaucucccauaggcuaccucggccuccuaucccaaagaacucgcgacaucuacaucucacgcagacuccucggaacuuucaccuggacccuaucagacuccgaaggcaacgaaacacccggcggcuacugccucacccgauggaugcucaucgaagccgaacuaaaaugcuucggcaacacugccgucgccaaaugcaacgaaaaacaugacgaagaguucugcgauaugcuccguuuauucgacuucaacaaacaagcaauccgccgccucaaaaccgaagcacaaauguccauccaacucauaaauaaagccgucaacgcccucaucaacgaccaacuaauuaugaaaaaccaccuccgcgacaucaugggaaucccauacugcaacuacuccaaguacugguaccucaaccacaccguuacaggcaagaccucccucccacgaugcuggcucgucagcaacggcuccuaccucaacgaaacacacuucuccgacgacaucgaacaacaagccgacaacaugauuaccgaacuacuccagaaggaauacaucgaccgacaaggaaaaacaccccuuggccuagucgaccucuucgucuucucaaccagcuucuaccuaaucuccaucuuccuccaccucgucaaaaucccaacccaccgucacaucaucggaaaaccaugcccaaaaccccaccgucucaaccacauggggaucugcuccugcggccucuacaaacaccccggcguccccgucaaauggcgacgcuaa

SEQ ID NO: 3132 - RNA, 1473 nt, Artificial Sequence
  derived and/or modified CDS sequence (opt11) from Lassa virus__AIT17612__GPC
augggccaaaucaucacuuucuuccaagaagucccccacgucaucgaagaaguuaugaacaucguccuaaucgcacucucccuccucgcaauccucaaaggcauauacaacgucgcaaccugcggccucuucggccucguaucauuccuccuccuaugcggcagauccugcuccaccacauacaaaggcgucuacgaacuccaaacccucgaacucgacauggccucccucaacaugaccaugccucucagcugcaccaaaaacaacucccaccacuacauccgcgucggcaacgaaacuggacuggaacuaacccucaccaacaccuccaucaucaaucacaaauucugcaaccucucagacgcccacaagaaaaaccuauacgaccacucacucauguccaucaucucaacuuuccaccucuccauccccaacuucaaccaauacgaagcuaugagcugcgacuucaacggcggcaaaaucuccguccaguacaaccucucccauaccuacgccgucgacgccgcaaaccacugcggcacaaucgcaaacggcgugcuccaaaccuucaugcgaauggccuggggcgguuccuacaucgcccuagacucuggaaaaggcaacugggacugcaucaugacaucauaccaauaccucaucauccaaaacaccacaugggaagaccacugccaauucucacgccccucccccaucggcuaccucggccuccucucccaacgcacccgcgacauauauaucucccgucgccuccuuggaacauuuaccuggacccucuccgacucugaaggaaacgaaacuccaggcggauacugccucacccgcuggaugcucaucgaagccgaacucaaaugcuucggaaauacagccgucgccaaaugcaacgaaaaacacgacgaagaguucugcgacaugcuccgucucuucgauuucaacaaacaagccauccgccgccugaaaaccgaagcccaaauguccauccagcucaucaacaaagcuguuaacgcgcucaucaacgaucaacucaucaugaaaaaccaccuacgcgacaucaugggcaucccauacugcaacuacuccaaauacugguaccucaaccauacuguuacaggcaaaacaucccuacccagaugcuggcucgucucuaacggcuccuaccuaaacgaaacacauuuuucagacgacaucgaacaacaagcagacaacaugaucacagaacuacuucaaaaagaauacauagaucgccaaggcaaaacaccccucggccucgucgaccucuucgucuucuccaccuccuucuaucucauaagcaucuuccuccaccucguaaagauacccacacaccgccacgucgucggcaagccuugccccaaaccccaccgccucaaccacaugggcauaugcucaugcggccucuacaaacaccccgggguucccgucaaauggaaacgcuaa

SEQ ID NO: 3133 - RNA, 1473 nt, Artificial Sequence
  derived and/or modified CDS sequence (opt11) from Lassa virus__AIT17616__GPC
auggggcaaaucaucaccuucuuccaagaagucccccacgucaucgaagaaguaaugaacaucguacucauagcacucucacuccuagcaauccucaaaggaaucuacaacgucgcaaccugcggccucuucggccucguauccuuccuccuccucugcggucgcuccugcuccacaacauauaaagggguauacgaacugcaaacccuagaacucgacauggccucucucaacaugaccaugccacucuccugcaccaaaaacaacucccaccacuacauaauggucggcaacgaaaccggacuagaacucacccuaaccaacacaucaaucaucaaccacaaauucugcaaucuauccgaugcccacaagaaaaaccuauacgaccacgcccucauguccaucaucuccacauuccaccuauccauccccaacuucaaccaauacgaagccauguccugugauuucaacggcggcaaaaucuccguccaauacaaccucucccacgccuacgccguagacgcggccaaccacugcggcacaaucgccaacggcguccuccaaaccuucaugcgcauggcauggggcggcucauacaucgcucuagacuccggcaaaggcuccugggacugcauuaugacaucuuaccaauaucucaucauccagaauaccacaugggaagaccacugccaguucagccgucccucccccaucggcuaccucggccuccucucccagcgcacccgagacauauacaucucccgccgccuccuaggcacuuucaccuggacacuauccgacuccgaaggcaacgaaacccccggcggauacugccucacccgcuggaugcuaaucgaagccgaacucaaaugcuucggcaacaccgccgucgccaaaugcaacgagaaacacgacgaagaguucugcgacaugcuccgccucuucgacuucaacaaacaagcaauaagacgauuaaaaacagaagcacaaauguccauccaacuaaucaacaaagcugucaacgcccuaaucaacgaccaacucauaaugaaaaaccaccuccgcgauauaaugggaaucccauacugcaacuacagcaaguauugguaccucaaccacaccguaacaggaaaaaccucgcucccucgaugcuggcucguauccaacggaucauacuugaacgaaacacacuuuucugacgacaucgaacaacaagccgacaacaugaucaccgaacuccugcaaaaggaauacaucgauagacaaggaaaaacaccccucggccuaguagaccuauucgucuucagcaccuccuucuaucuaaucuccaucuuccuccaccucguuaaaauccccacccaccggcacgucaucggcaaacccugccccaaaccccaccgccucaaccacaugggcaucugcuccugcggccuauauaaacaccccggcguccccgucaaauggaaacgauaa

SEQ ID NO: 3134 - RNA, 1473 nt, Artificial Sequence
  derived and/or modified CDS sequence (opt11) from Lassa virus__AIT17620__GPC
augggccaaaucauuaccuucuuccaagaagucccccacgucaucgaagaagucaugaacauaguacuaaucgcccucucauuacucgccauucuaaaaggcaucuauaacgucgcaaccugcggccuauucggccucgucagcuuccuacuccuaugcggcagauccugcucaaccacuuacaaaggcgucuacgaacuacaaaccuuagaacucgacauggccucacuaaacaugaccaugccccuaucuugcaccaagaacaacucacaccacuacaucauggucggcaacgaaaccggccucgaacucacccucacaaacacaagcauaaucagccacaaauucugcaaccucuccgacgcacacaagaaaaaccuauacgaccacgcccucauguccaucaucagcaccuuccaccuaucuauaccuaacuucaaccaauacgaagccauguccugcgacuucaacggcggcaaaaucucaguccaauacaaccucagccacgcauacgccauagacgccgccaaccacugcggcaccgucgccaacggaguccuccaaaccuucaugcguauggccuggggaggcagcuauaucgcccuagacuccggaaaaggauccugggacugcauaaugacauccuaccaauaccuaaucauccagaacacuacaugggaagaccacugccaauucucucgcccaagcccgaucggcuaccucggccuccuaagccagcgcacaagggacaucuacaucucgcgccgucuacuaggcaccuucaccuggacccuaagcgacuccgaaggcaacgaaacccccggcggcuacugccuuacucgcuggaugcuaauagaagccgaacucaaaugcuucggcaacaccgccguagccaaaugcaacgagaagcacgacgaagaguucugcgacaugcuacgccucuucgacuucaacaaacaagccauccgacgccuaaaagccgaagcccaaaugagcauccaacuaauaaacaaagccgucaacgcccucauaaacgaccaacuaauaaugaagaaccaccuccgcgacaucaugggcauccccuacugcaacuacucaaaauacugguaccucaaccacaccgucaccggaaaaaccucccucccacgauguuggcucguaucaaacggcuccuaccucaacgaaacccauuucucugacgauaucgaacaacaagccgacaacaugaucaccgaacuccuccaaaaagaauacauggaccgccaaggcaagacaccccucggccuagucgaccuauucgucuucagcacauccuucuaccuaaucucuaucuuccuccaccuagucaaaaucccaacccaccgacacgucaucgggaaacccugccccaaaccccaccgccucaaccacaugggcaucugcagcugcggacucuauaaacaccccggcguccccguaaaauggaaacgcuaa

SEQ ID NO: 3135 - RNA, 1473 nt, Artificial Sequence
  derived and/or modified CDS sequence (opt11) from Lassa virus__AIT17626__GPC
augggccaaaucaucaccuucuuccaagaaguaccccacgucaucgaagaagucaugaauaucguccucaucgcacucucacuacucgcgauccucaaaggcguuuacaacgucgcaaccugcggacucuucggccucgucucauuccuccuccuaugcggccgcucuugcuccaccaccuacaaaggcgucuaugaacuacaaacccucgaacuagacauggccucccucaacaugaccaugccccuauccugcaccaaaaacaauucccaccacuacauuauggucggcaacgaaacaggccucgaacucacgcuaaccaacaccuccaucauccaacacaaauucugcaaccucuccgacgcccacaagaaaaaccucuacgaucacgcacuaaugagcauuaucucaacuuuccaccucuccauccccaacuucaaccaauacgaagcaaugucaugcgacuucaacggcggcaaaauaaccguccaguacaaccucucccacuccuaugccauagacgcagccaaccauugcgguacaauugcaaacggcguccuccagacauucaugcgaauggcauggggcggcuccuacaucgcccuagacuccggcaaaggcucaugggacugcaucaugaccuccuaccaguaccucaucauccaaaacaccaccugggaagaccacugccaauucucacgccccucucccaucggcuaccucggccuccucucacaacgcacccgcgacauuuacaucucucgcagacuccucggcacauuuaccuggacccucuccgacucagaaggcaacgaaacacccggggguuacugccuaacccgcuggaugcuaaucgaggccgaacuaaaaugcuucggaaacacagccguugccaaauguaacgaaaaacacgacgaagaguucugcgacaugcuucgccuuuucgacuucaacaaacaagccauccgccgacuaaaaaccgaagcccaaaugucuauacaacucauaaauaaagccgucaacgcccuuaucaacgaccaacucaucaugaaaaaccaccuccgggacaucaugggcauccccuacugcaacuacucaaaguacugguaccucaaccacacaguaaccggccgaaccucgcuaccccgaugcuggcuaguauccaacggcuccuaccucaaugaaacucacuuuuccgacgacaucgaacaacaggccgacaacaugaucaccgaacuccuccaaaaagaauacauggaccgccaaggaaaaacaccccucggccucgucgaccuuuucguuuucagcaccucuuucuaccucauauccauuuuccuccaccucgucaaaauccccacacaccgacacaucaucggcaagcccugccccaaaccccaccgacuuaaccacaugggcgucugcucaugcggacucuacaaacacccaggcguccccgucaaauggaaacgcuag

SEQ ID NO: 3136 - RNA, 1473 nt, Artificial Sequence
  derived and/or modified CDS sequence (opt11) from Lassa virus__AIT17630__GPC
augggccaaaucaucacauucuuccaagaagucccccaugucaucgaagaagucaugaacaucguccuaaucgcucucucacuccuugccauccucaagggcaucuacaacgucgccaccuguggccuauucggccuccuguccuuucuccuccucugcggcagauccugcuccaccaccuacaaaggcgucuacgagcuccaaacccucgaacucgacauggccucccuaaacaugaccaugccucuauccugcaccaaaaacaacucccaccacuacaucaugguuggcaacgaaaccggacucgagcucacacucaccaacaccuccauaauaaaccacaaauucugcaaucucagcgacgcccacaagaaaaaccucuacgaccacgcccucauguccauaauaagcaccuuucaccucuccauacccaacuucaaccaauacgaggccauguccugcgacuuuaacggagggaaaauauccguacaauacaaccucucccacgccuacgccgucgacgccgccgagcacugcgggaccaucgccaacgguguccuccaaaccuucaugcgaauggccuggggaggcuccuacaucgcccuagacuccggcaaaggcagcugggacugcgucaugaccuccuaccaguaccuaaucauacaaaacaccucaugggaagaccauugccaguucucccgccccucaccaaucgguuaccuaggucuccucucccaacgcacccgcgacaucuacaucucccgccgucuccucggcaccuucaccuggacgcucucugacagcgagggcaacgaaacgcccggcggcuacugccucacucgcuggaugcuuauagaagccgaacuaaaaugcuucggcaacaccgccgucgccaaaugcaacgaaaaacacgacgaagaauuuugcgacaugcuacgccucuucgacuucaacaaacaagcaauccgcagacuaaaaacagaagcccaaauguccauccaacucaucaacaaagcagucaacgcccucaucaacgaccaacucaucaugaaaaaccaccuccgcgauaucaugggcaucccauacugcaacuacucaaaauauugguaccucaaccacaccgucacgggaaaaaccagccuaccccgcugcuggcucguuuccaacgguuccuaccuaaacgaaacacacuucuccgaugacaucgaacaacaagccgacaacaugaucaccgaacuccuccaaaaagaauacaucgacagacaaggaaaaaccccacucggccuagucgaccucuucgucuucuccaccucauucuaccucauaucaaucuuccuccaccuaguaaaaauaccaacccaccgccacgucaucggcaaaccgugccccaaaccccaccgccuaaaucacaugggaaucugcuccugcggucucuacaaacaccccggcguccccgucaaauggaaacgcuaa

SEQ ID NO: 3137 - RNA, 1473 nt, Artificial Sequence
  derived and/or modified CDS sequence (opt11) from Lassa virus__AIT17634__GPC
augggucaaaucaucaccuucuuccaagaagucccgcacgucauagaagaagucaugaacaucguccuaaucgcccucucgcugcucgcaauccucaagggcaucuacaacguagcaaccugcggacucuucggacuugucuccuuccuccuccuuugcggacgcagcugcuccaccaucuacaaggaugucuacgaacuacaaacccucgaacuagacauggccucccuaaacaugacaaugccacucucuugcaccaaaaacaacagccaucacuacaucauggucggcaacgaaaccggccucgaacucacccuuaccaacaccucaauaauaaaccacaaauucugcaaucuaucagacgcacacaagaaaaaccucuacgaccaugcccucauguccaucauauccaccuuccaccucuccauaccaaacuucaaccaauacgaggcaauguccugcgacuucaacggcggcaaaaucagcguccaauacaaccuuagccacaccuacgcgaucgacgccgccaaccacugcggaaccauagccaacggcguccuccaaacauucaugcgcauggccuggggcggcuccuacaucgcccuagacuccggcaaaggcucaugggacugcaucaugaccagcuaccaauaccucauaauacaaaacacaaccugggaagaccacugccaauucucccgacccucaccuaucggcuaccugggccuccucucacaacggacccgcgacauauacaucagccgccgacuucuuggcaccuucaccuggacccucucagacuccgaaggcaacgaaaccccaggcggcuacugccugacucgguggaugcucaucgaagccgaacucaaaugcuucggaaacacagccgucgcuaaaugcaacgaaaaacacgacgaagaguucugcgacaugcucaggcuauucgacuucaacaaacaggccauccgucgccucaaaaccgaagcccaaauguccauccaacucaucaacaaagccgucaacgcccuaauaaacgaccaacucauaaugaaaaaccaccucagagacauaaugggcauaccauacugcaacuacagccgcuacugguaccuaaaccacaccguaaccggccgcacuucccuaccgcgcugcuggcucgucuccaacggcuccuaccucaacgaaacccacuucucagacgacaucgaacaacaggcugacaacaugauaaccgaauuacuccaaaaagaauacauggaccgacaaggcaaaacaccccuaggccucguagaucucuucgucuucuccacuuccuucuaccucaucuccaucuuccuucaccuagucaaaauccccacgcaccgccacgucaucggaaaacccugccccaaaccacaccgccucaaccacaugggcauaugcucuugcggacucuacaaccaccccggcgucccagucaaauggaaacgcuaa

SEQ ID NO: 3138 - RNA, 1473 nt, Artificial Sequence
  derived and/or modified CDS sequence (opt11) from Lassa virus__AIT17638__GPC
augggccaaaucauaaccuucuuccaagaagucccccaugugauagaagaaguaaugaacauaguccucaucgcccucucacuccuagccauccucaaaggcaucuacaacgucgcgaccugcggacuauucggccuugucucauuccuccuccugugcggccguuccugcuccaccaccuauaaaggcguauacgaacuccaaacccuagaacuagacauggccucccucaacaugaccaugccacucuccugcaccaaaaacaacucccaccacuacaucaugguaggcaacgaaacaggacuggaacuaacccucacgaacaccuccauaaucaaccacaaauucugcaaccucucagacgcccacaagaaagaccucuacgaccacgcccuaaugucaauaauauccacuuuccaccucuccaucccaaacuucaaucaauacgaagcaaugagcugcgacuucaacggcggcaaaaucuccguacaauacaaccucucccacaccuacgccgucgacgccgccaaccacugcggaaccauagccaacgguguacuccaaacauucaugcgcauggcauggggaggcucauacaucgcccuggacuccggcaaaggcucaugggacugcaucaugacauccuaccaauaccucaucauacaaaacaccaccugggaagaccacugccaauucucccgccccucacccaucggcuaccucggucuucuaucccaacgcacccgagacaucuacaucucacgccgucuccucggcaccuucaccuggacgcucuccgacagcgaaggaaacgaaacccccggcggcuacugccucacgcgauggaugcucaucgaagccgaacucaaaugcuucgguaacaccgcagucgccaaaugcaacgaaaaacacgacgaagaguucugcgacaugcuuagacucuucgacuucaacaaacaagcgauccgccgccuaaagaccgaagcacaaauguccauccaacucaucaacaaagcugucaacgcacucaucaacgaccaacucauaaugaaaaaccaccuccgcgacaucaugggaaucccauacugcaacuauuccaaauacugguaucucaaccacaccguuacuggcaaaaccucccuuccucguugcuggcuagucucaaacggaagcuaccuuaacgaaacgcacuucagcgacgacauagaacaacaagccgauaacaugaucaccgagcuacuccaaaaggaauacauggaccgccaaggcaaaacaccccucggccucguagaccucuucgucuucucuaccuccuucuaccucaucuccauauuccuccaccucaucaaaauacccacccaccgacauaucacaggaaaacccugcccaaagccccaccgccucaaucacauggguauaugcuccuguggccuuuacaagcacccaggcguaccagucaaauggaagcgcuaa

SEQ ID NO: 3139 - RNA, 1473 nt, Artificial Sequence
  derived and/or modified CDS sequence (opt11) from Lassa virus__AIT17642__GPC
augggccaaaucaucaccuucuuccaagaaguuccccacguuaucgaagaagucaugaacaucguccucauugcccucucccuccucgccauccucaaaggagucuacaacguagccacauguggccucuucggacucguuucuuuucucuugcucugcggaagauccugcuccaccaccuacaaaggcguguacgaacuccagacauuagaacuugacauggccucccucaacaugaccaugccacuauccugcaccaaaaacaacucacaccacuacaucauggucggcaacgacaccgggcucgaacucacacuaacaaacaccucgaucauaaaccacaaauucugcaaccucuccgacgcccacaagaaaaaccucuaugaccacgcccucauguccaucaucucaacauuccaccuuuccauccccaacuucaaccaauacgaagccaugucaugcgacuucaacggcggcaaaaucuccguccaauauaaccucucccacgcauacgccguugacgcagccucgcacugcggcaccauagcaaacggcguccuccagacuuucaugcgcauggcauggggcggcucuuacauagcacuugacuccggcaaaggguccugggacugcaucaugaccuccuaccaauaccucaucauccaaaacacaaccugggaagaccacugccaauucucccgcccaagcccaaucggcuaccucggccuucucucacaacgcacccgagacauauacaucuccagacgccuccuaggcaccuucaccuggacacucuccgacuccgaaggcaacgaaacccccggcggcuacugccucacccgguggaugcucauagaagcagaacuaaaaugcuucggcaacacagccgucgcuaaaugcaacgaaaaacacgacgaagaguucugcgacaugcuccgccuauucgacuucaacaaacaagccauccgccgccugaaaaccgaagcucaaaugucaauacaacucauaaacaaagcggucaacgcccuaaucaacgaccaacucauuaugaagaaccaccuccgcgacauaaugggcaucccauacugcaacuauuccaaauacugguaccuaaaccauaccgucaccggcaaaaccucccucccacgaugcuggcucgucucuaacggcagcuaccucaacgaaacccacuucucagacgacaucgaacaacaagccgacaacaugaucaccgaacuccuacaaaaagaguacauggaucgacaaggcaaaacaccccuaggacucgucgaccucuucgucuuuuccaccagcuucuaccucaucucaaucuuccuccaccucgucaagaucccaacccaccgccacauaaucggcaaacccugcccaaaaccccaccgccuuaaccacaugggcauaugcagcuguggccuauacaaacauccaggcguccccgucaaauggaagcgcuaa

SEQ ID NO: 3140 - RNA, 1473 nt, Artificial Sequence
  derived and/or modified CDS sequence (opt11) from Lassa virus__AIT17646__GPC
augggccaaaucaucacauuuuuccaagaggucccucacguuaucgaagaagucaugaacauaguacucaucgcccucucccuccuagccauauuaaaaggcaucuacaacgucgcuacaugcggccuauuuggauuagucucuuuccuccuccuaugcggccgauccugcuccacaaccuacaagggcguauacgaacuccaaacacucgaacuggauauggcaucucuaaacaugaccaugccccucuccugcaccaaaaacaacucgcaccacuacaucaugguaggaaacgaaaccggacucgaacucacccucaccaauaccuccaucaucaaccacaaauucugcaaccucuccgacgcccacaaaaagaaccuuuacgaccacgcccucauguccaucauauccacauuccaccucucaauccccaacuucaaccaauacgaagccaugucaugcgacuucaacggcggcaaaaucuccguccaauacaaccucucacacgcauaugccgucgacgccgccucccacugcggcaccgucgcaaacggcguccuccaaaccuucaugcguauggccuggggcggcuccuacaucgcccucgauuccggcaaaggcuccugggacugcaucaugaccuccuaccaauaccuaaucauacaaaacacaaccugggaagaccauugccaauucagccgccccucuccaauaggcuaucugggccuacucucccagcgcacacgcgacaucuacauaucucgacgccuacucggcaccuucaccuggacccucuccgacuccgaaggaaacgaaacacccggaggcuacugccucacccgauggaugcugaucgaagcagaacucaaaugcuucggcaacaccgccgucgccaaauguaacgaaaaacacgacgaagaguucugcgacaugcuccgacucuucgacuucaacaaacaagccauccgccgccuaaaaacggaagcacaaauguccauccagcuaaucaacaaagccguuaacgcccuaauuaacgaccaacucaucaugaagaaccaccuccgcgacaucaugggcauucccuacugcaacuacuccaaauacugguaccuuaaccacacagucaccggaaaaaccucucucccccgauguuggcucguaagcaacggcuccuaccugaacgaaacccacuucuccgacgacaucgaacaacaagccgacaacaugaucacagaacuacuccagaaagaauacauggaccgccaaggaaagacaccccucggccucgucgaccucuucgucuucuccaccagcuucuaccuuauaucuaucuuccuccaccucguaaaaauccccacccacagacaugucauaggcaaaccaugccccaagccccaccgacucaaccacaugggcaucugcucaugcggacucuacaaacaccccggaguccccguaaaguggaaacgauaa

SEQ ID NO: 3141 - RNA, 1473 nt, Artificial Sequence
  derived and/or modified CDS sequence (opt11) from Lassa virus__AIT17650__GPC
augggccaaaucauuaccuucuuccaggaagucccccacgucauugaagaaguaaugaacaucgugcucaucgcacuuucccuccuagccauacucaaagguaucuacaacguggcaaccugcggucuauucggccucguuuccuuccuccuccucugcggucgcuccugcuccaccaccuacaaaggcgucuaugaacuccaaacccucgaacucgacauggccagccuaaauaugaccaugccccucuccugcaccaaaaacaauucccaccacuacaucauggucggcaacgaaaccggccucgaacuaacccucacaaacaucucaaucauaaaucacaaguucugcaaccucagcgacgcccacaaaaagaaccucuacgaccacgcccucaugagcaucauauccaccuuccaccucuccauacccaauuucaaccaauacgaggccauguccugcgacuucaacggaggaaaaaucuccguacaauacaaccucucccacaccuacgccgucgacgccgcuaaccacugcggcacaaucgcuaacggcguccuccaaacauucaugcgcauggcuuggggcggaucauacaucgcccucgacucaggaaaaggcagcugggacugcaucaugaccuccuaccaauaccucaucauccaaaacaccaccugggaagaccacugccaauucucccgacccuccccaaucggcuaccucggccuccucucccaacgcacccgcgacauauacaucuccagacgacuccucggcacauuuaccuggacccucagcgacucugaaggcaacgaaacccccggcggcuacugccucacccgcuggaugcugauagaagcggaacuuaagugcuuuggcaacaccgcuguagcaaaaugcaacgaaaagcacgacgaagaauuuugugacaugcuacgccuauuugacuuuaacaaacaagcaauccgccgccucaaagcagaagcccaaaugagcauccaacucauaaacaaagccguuaacgcccucaucaacgaccagcuaauaaugaagaaccaccuucgcgacauaaugggaauccccuacugcaacuacuccaaauacugguacuuaaaucacacagucacuggccgcacaucccuaccccgcugcuggcucgucuccaacggcuccuaccuuaacgaaacccacuucucagacgacaucgaacaacaagccgacaacaugauaacagaacuccuacaaaaagaauacaucgaccgccaaggaaaaacuccccuaggccuaguugaccucuucguauucagcaccagcuucuaccuaaucucaaucuuccuacaccucgucaaaauccccacacaccgucacaucaucggaaaaccaugcccuaaaccccacagauuaaaccacaugggcaucugcucaugcggucucuauaaacacccagggguccccgucaaauggaagcgauga

SEQ ID NO: 3142 - RNA, 1473 nt, Artificial Sequence
  derived and/or modified CDS sequence (opt11) from Lassa virus__AIT17658__GPC
augggccaaaucaucaccuucuuccaagaagucccccacgucaucgaggaaguaaugaacauaguccucaucgcccucucccuacuggccaucuugaaaggaguauacaacguggcaaccugcggccuauucggccuagucuccuuccuacuacuaugcggccgcucauguuccaucaccuacaaaggagucuaugaacuacaaacacuugaacucgacauggcaaaccucaacaugaccaugccccucuccugcaccaaaaacaacucccaccacuacaucauggucggcaaugaaaccggccuagaacucacccugacuaacaccagcauuaucaaccacaaauucugcaaccucucagacgcccauaagaaaaaccucuacgaccacgcccucauguccaucaucuccaccuuccaccucuccaucccgaauuucaaccaauacgaagccauguccugcgacuucaacggaggaaaaaucucaguacaauacaaccucucccacaccuacgcaggcgacgccgccgaccacugcggcacaaucgccaacggcguccuacaaaccuucaugcgcauggccuggggcggaucauacaucgcccucgacuccggcaaaggcuccugggacuguauuaugaccuccuaccaauaccuaaucauccaaaacaccacaugggaagaccacugccaauucagccgccccucccccaugggcuaccucggccuccucucccaacgcacacgagacauauauauuucucgccgacuccucggaacguucaccuggaccuuauccgacucagaagguaacgaaacccccggugguuacugccuuacucgauggaugcucaucgaagccgaacucaaaugcuucggcaacaccgccguagccaagugcaacgagaagcaugacgaggaguucugcgacaugcuccgccucuucgacuucaacaaacaagccauccgccgccuaaaaaccgaagcccaaauguccauacagcuaauaaacaaagcugucaacgcccuaaucaacgaccaacucauaaugaagaaccaccuccgugacaucaugggcauacccuauugcaacuacuccaaguauugguaccugaaccacaccaucacgggcaagaccucccuccccagaugcuggcucgucucaaacggcuccuaccucaacgaaacccacuuuuccgacgacauugaacaacaggccgacaauaugauaaccgaacuccuacaaaaggaauacauagaccgccaaggcaaaacaccccucggucuaguagaccucuucguauucucgaccuccuucuaccucaucuccauauuccuccaucucgucaaaaucccaacccaccgccacaucacgggcaaaccuugcccaaaaccccaccgccugaaccacaugggcaucugcuccuguggccucuacaaacacccaggcguacccguccgcuggaaacgcuaa

SEQ ID NO: 3143 - RNA, 1473 nt, Artificial Sequence
  derived and/or modified CDS sequence (opt11) from Lassa virus__AIT17666__GPC
augggccaaauaguaaccuucuuccaagaaguaccacaugucaucgaagaagucaugaacaucguccuaaucgcucuaucccuacucgcaauacucaagggcauauacaacgucgccacuugcggccuauucggccuugucucauuccuccuccucugcggccgcuccugcucgacaaccuacaaaggagucuacgaacuccagacccucgaacucgacauggcaucacucaacaugaccaugccccucuccugcaccaaaaacaacucccaccacuacaucaugguuggcaacgaaaccggccucgaacucacccugaccaacaccuccaucaucaaccacaaauucuguaaccucucagacgcacacaaaaagaaccucuacgaucacgcccugauguccaucaucucaacauuucaccucucaauccccaacuuuaaccaauacgaagccauguccugcgacuucaacggcggcaaaauauccguacaauauaaccucucccacaccuacgccgucgacgccgccaaccacugcggcaccauagcaaauggcgugcuccaaaccuucaugcguauggcauggggcggauccuacaucgcacucgauagcggcaaaggcuccugggacugcaucaugaccuccuaccaauaccuaaucauccaaaacaccaccugggaagaccacugccaguuuucccgccccuccccaaucggcuaccucgguuugcuaucucaacgcacacgagauauauacauaucccgccgccuucuaggcacauucacauggacccucucagacucugaaggcaacgaaacaccaggcggcuacugccucacacgcuggaugcuaauagaagccgaacuaaaaugcuucggcaacacugcagucgccaaaugcaacgaaaaacacgacgaagaauuuugcgacaugcuccgacucuucgacuucaacaaacaagccauccgacgccucaaaacugaagcccagauguccauccaacucaucaacaaagccgucaacgcccucaucaacgaccaacucaucaugaaaaaccaccucagagacauaaugggcauacccuacuguaauuacuccaaguacugguaccucaaccacacugugaccggcaaaacaucgcuaccccguugcuggcuuguauccaacggcuccuaccuaaacgaaacacacuucuccgacgacauagaacagcaagccgauaacaugaucacagaacuccuacaaaaagaauacauggaccgccaaggcaaaacaccccuaggccucgucgaccucuucguauucucaacguccuucuaccuaaucucaaucuuccuacaccucguaaaaauccccacccaccgccacaucaccggcaaaccaugccccaaaccacaccgacucaaccacaugggcaucugcuccuguggccuguacaaacaccccggagucccugucaaauggaaacgguag

SEQ ID NO: 3144 - RNA, 1473 nt, Artificial Sequence
  derived and/or modified CDS sequence (opt11) from Lassa virus__AIT17670__GPC
augggccagaucauaacauucuuccaagaaguaccccacgucaucgaagaagucaugaacaucguacucaucgcacugucccuccucgccauccuaaaaggcaucuacaacguagcaaccugcggccucuucggacucguaucauuccuccuccucugcggacgcuccugcucgaccaccuacaaaggcgucuacgaacuccaaacucuagaacucgacauggccucacuuaacaugaccaugccccucucaugcaccaaaaacaacucacaccacuacauaaugguuggaaacgaaaccggucucgaacuuacccuaaccaacaccucaauaaucaaccacaaauucugcaaucucagcgacgcacacaagaaaaaccucuacgaccacgcccucauguccaucaucuccacuuuccaccucuccauccccaacuucaaccaauacgaagccaugagcugcgauuucaacggaggcaaaauaucaguccaauauaaccuuagccacacuuaugcaguagacgccgcaaaccacugcgggaccauagccaacggcguccuccagaccuucaugcgcauggcauggggcggcuccuacaucgcccucgacuccggcaaaggcuccugggacugcaucaugacuagcuaccaauaccuuauaauccaaaacaccaccugggaagaccauugccaauucucccgcccaucccccaucggauaccuaggccuccucucacaacgcacccgcgacaucuacaucucccgacgacuccuaggaaccuucacauggacucucuccgacuccgaaggaaacgaaacccccggaggauacugccuaacacgcuggaugcucaucgaggccgaacucaaaugcuucggcaauaccgcagucgccaaaugcaacgaaaaacacgaugaagaguucugcgacaugcuucgccucuucgacuucaauaaacaagccauacgccgccuaaaagcagaggcccaaauguccauucaacucaucaauaaagccgucaacgcccuaaucaacgaccaacucaucaugaaaaaccaccuccgcgacaucaugggaauccccuacugcaacuacagcaaauacugguaccucaaucacacuguaaccggcaggacaucccucccccgaugcuggcucgucuccaacggaucauaccucaaugagacccacuucuccgacgacauagaacaacaagcggacaacaugauuacugaacuucuacaaaaagaauacaucgaccgccaaggaaaaaccccacucggccucgucgaccuauucguuuucuccacaucuuucuaccucaucagcauauuccuccaccucgucaaaauccccacacaccgacacauaaucggcaaacccuguccaaagccacaccgccucaaccacaugggcaucugcagcugcggccuauacaagcaccccggcguccccgucaaguggaagcgcuaa

SEQ ID NO: 3145 - RNA, 1473 nt, Artificial Sequence
  derived and/or modified CDS sequence (opt11) from Lassa virus__AIT17674__GPC
augggccaaaucaucaccuucuuccaagaagucccccacgucaucgaagaaguuaugaauauaguccucaucgcucucucacuccucgccauccucaaagguaucuauaacgucgcaaccugcggccucuucggccucgucucuuuccuccuacucugcggccgcagcugcucaaccacguacaaaggcgucuacgaacuccaaacacuagaacucgacaugaccaaccuaaacaugaccaugccacuaucaugcaccaaaaacaacucacaccacuacauaaugguaggaaacgaaaccggccucgaacugacccucacaaacacuucaaucaucaaccacaaauucugcaaccuauccgacgcccauaagaaaaaccucuacaaccacgcccuuaugucaaucaucagcacguuccaccuguccauccccaacuucaaccaauacgaagccauguccugcgauuucaacggaggaaaaaucucaguacaguacaaucucucacacucauacgccgucgacgccgccaaccacugcgggaccaucgcgaacggaguccuccagaccuucaugcgaauggcauggggcggcucuuacaucgcccuagacuccggcaaaggcaacugggacugcaucaugaccuccuaccaauaccucauuauacaaaacacuacaugggaagaccacugccaauucucccgaccuucccccaucggcuaccucggccuccucucacaacguacccgcgacauauacauaucccgccgccuccucggaacauuuaccuggacccuauccgacucagaaggcaacgagaccccaggcggcuacugucucacccgcuggaugcuaaucgaagcugaacuuaaaugcuucggcaacaccgcagucgccaaaugcaaugaaaaacacgacgaagaguucugcgauaugcuccgccucuucgacuucaacaagcaagcuauccgccggcucaaaaccgaagcacaagcuaacauccaacucauaaacaaagcgguuaacgcccucaucaacgaccaacucaucaugaaaaaccaccuccgugacauuaugggcaucccauacugcaacuacuccaaauacugguaccucaaccacacagucacuggcaaaaccucccuucccagaugcuggcucgugucuaacggaucauaccucaacgaaacacacuucuccgacgacauagaacaacaagccgacaacaugaucaccgaacuccuccaaaaagaauauauggaccgacagggcaaaacaccccucggccuagucgaccucuucguauucucaaccucguucuaccucaucuccaucuuucuccaccucgucaagaucccuacccaccgccacgucauaggaaaaccgugccccaaaccacaccgccuaaaccacaugggcaucugcuccugcggccucuacaaacaccccggcgucccugucaaauggaaacgcuag

SEQ ID NO: 3146 - RNA, 1473 nt, Artificial Sequence
  derived and/or modified CDS sequence (opt11) from Lassa virus__AIT17678__GPC
augggacaaauaaucacauucuuccaggaagucccccacguaaucgaagaagucaugaacaucguacucauaacacucucccuccucgccauccucaaaggcauauacaacauagcaaccugcggccucuucggccuugucuccuuccuccuacucugcggacgcagcugcuccacgaccuacaaaggaguauaugaacuccaaacccucgaacucgauaugaccucacuaaacaugacaaugccccuuuccugcaccaaaaacaacucccaccacuacaucaugguaggaaacgaaacaggccucgaacucacccucaccaacacauccaucaucaaucacaaauucugcaaccucucggacgcccauaagaaaaaccucuacgaccacgcccucauguccaucaucucaaccuuucaccucuccaucccaaauuucaaccaauacgaagcaauguccugcgacuucaacggcggaaaaaucucuguccaauacaaccuuagccacaccuaugccguagacgccgccaaccacugcggaaccaucgcaaacggcguacuacaaaccuucaugcgcauggccuggggcgguagcuacauagcacucgacuccggcaaaggcuccugggacugcauuaugacaucauaccaauaccuaaucauccaaaacaccaccugggaggaccauugccaauucucacgacccucccccaucggcuaccucggacuucugucccaaagaacacgcgacauauacauaucccgcagacuacuaggcaccuucaccuggacccucuccgacucagaaggcaacgaaacacccggaggauacugccucacucgcuggaugcuaaucgaagccgaacucaaaugcuucggaaacaccgccgucgccaaaugcaacgaaaaacacgacgaagaguucugcgacaugcuccgccuauucgacuucaauaaacaagcaauccgccgccucaaaaccgaagcccaaauguccauacaacucaucaacaaagccgucaacgcauuaaucaacgaccaacucauaaugaaaaaccaccuucgagacauaaugggcauacccuacugcaauuacuccaaauacugguaccucaaccacacagugaccggaaaaaccucacucccccgauguuggcucgucucuaacgguuccuaccuaaacgaaacacacuucuccgacgacaucgaacaacaagccgauaacaugaucacagaacuccuucaaaaagaauacaucgaccgucaaggcaaaacaccccuuggccuugucgaccucuucgucuucagcacauccuucuacuuaaucucaaucuucuuacaccuuguaaaaauccccacccaccgacacaucaucggcaaacccugcccuaaaccccaccgucucaaccacaugggcaucugcuccugcggccucuacaaacaccccggcauccccgucaaauggaagcguuaa

SEQ ID NO: 3147 - RNA, 1473 nt, Artificial Sequence
  derived and/or modified CDS sequence (opt11) from Lassa virus__AIT17686__GPC
augggccaaaucaucacauucuuccaagaagucccccacgucaucgaagaggucaugaacauaguccucauagcccucucgcuccucgccauacuaaaaggcaucuacaacgucgcaaccugcggccuuuuuggccuagucuccuuccuccuacuaugcggccgcucuugcuccacuaccuacaaaggcguauacgaacuccaaacccucgaacuagacauggccucacucaacaugacaaugccccuauccugcaccaaaaacaauucccaccauuauauaaugguagguaacgaaaccggccucgaacucacacucacuaacacuuccaucaucaaucacaaguucugcaaccucucagacgcccacaagaaaaaccuauacgaccacgccuuaauguccaucaucuccaccuuccaccucagcauccccaacuucaaccaauacgaagccauguccugcgauuucaacggcggcaaaaucucaguccaauacaaccuaucccacaccuacgccgucgacgccgccaaccacugcggcaccaucgcaaacggcguccuacaaaccuucaugcgaauggcauggggcggcucuuacauagcccucgacucccguaaaggcuccugggacugcaucaugaccuccuaccaauaccuaaucauacaaaauaccaccugggaagaccacugccaauucucacgacccucccccauaggcuaucucggccuccucucacaacgcacccgcgacaucuacauaucacgaagacuccucggcacuuucacguggacucucagcgacuccgaaggcaacgaaacaccuggcggcuacugccucacccgcuggaugcuaauagaagccgaacucaaaugcuucggcaacaccgccgucgccaaaugcaacgaaaaacacgacgaagaguucugcgauaugcuacgccuguucgacuucaacaaacaagccaucagacgccucaaaaccgaagcacaaauguccauacagcuaaucaacaaagcagucaacgcccuuaucaacgaccaacuuauaaugaaaaaccaccuccgcgacaucaugggcaucccuuacugcaacuacuccaaauauugguaucucaaccacaccguaaccggcaaaacuucccuaccccgcugcuggcuggucuccaacggcuccuaccuaaacgaaacacacuucuccgacgacaucgagcaacaagccgacaacaugaucaccgaacuucuccagaaagaauacauggaccgccaaggcaaaaccccucucggacucgucgaccuuuucguauucucgaccuccuucuaccucaucuccaucuuccuccaccucaucaaaauccccacccaccgucacguaaucggcaaaccuugccccaaaccccaucgccucaaccacauggguauuugcagcugcggccuguacaaacaccccggcgucccagucaaauggaagcgcuaa

SEQ ID NO: 3148 - RNA, 1473 nt, Artificial Sequence
  derived and/or modified CDS sequence (opt11) from Lassa virus__AIT17690__GPC
augggacaaauuaucacguucuuccaggaagucccccacgugaucgaagagguaaugaacaucguccucauagcccugucccuccucgccauucugaaaggcauuuacaacgucgcuaccugcgggcuauucggacucgucuccuuccuccuccuauguggaagauccugcuccacaaccuauaaaggcgucuacgagcuccaaacccuggaauuagacauggccucccugaacaugaccaugccccucuccugcaccaaaaacaacucacaccacuacaucauggucggcaaugaaaccggccucgaacucacucucacaaauaccuccaucauaaaccacaaauucugcaaccuauccgacgcccacaagaaaaaccucuacgaccacgcccucaugucgaucaucuccaccuuccaccucuccauccccaacuucaaccaauacgaagcaauguccugcgacuucaacggaggcaaaaucuccguccaauacaaccucucacacgcauacgccguugacgccgccucacacugcggaaccgucgccaacggaguucuacaaaccuucaugcgcauggccuggggcggcucguacaucgcacucgacucgggcaaaggguccugggacugcauaaugaccucguaccaauaucucauaauccaaaacaccacaugggaagaucacugucaauucucccgccccucaccaaucggcuaccuugggcuccucucccaacgaacacgcgacaucuacauaucgcgccgacucuuaggcaccuucaccuggacccucuccgacucugaaggcaacgaaacccccggcggcuacugccuaacccgcuggaugcucaucgaagccgagcucaaaugcuucggcaacaccgcagucgccaaaugcaacgagaaacaugacgaagaguucugcgacaugcuccgccucuucgacuucaauaaacaagccauacgccgccucaaaaccgaagcccagauguccauccaacugaucaacaaggccguaaacgcccuuaucaacgaccaacucauaaugaagaaccaccuccgugacaucaugggcauccccuacugcaacuacucgaaauacugguaccucaaccacaccgucaccggccguaccucucuaccccgcugcuggcuagucuccaacggcucauaccucaacgaaacacacuucuccgacgacaucgaacaacaagcagauaacaugaucaccgaacuucuccaaaaggaauacauggaccgccaaggaaaaacuccccucggacuugucgaccuuuucgucuucucuaccucauucuaccucaucuccaucuuccugcaccuaguaaaaaucccaacccaucgccacgucaucggcaagcccugccccaagccccaccgccucaaccacaugggcaucugcucuugcggccuauacaaacaccccggcguaccagucaaauggaaacgcuaa

SEQ ID NO: 3149 - RNA, 1473 nt, Artificial Sequence
  derived and/or modified CDS sequence (opt11) from Lassa virus__AIT17694__GPC
augggacaaaucaucacauucuuccaagaagucccacacgucauagaagaaguuaugaacaucguccucaucgcccuaucccuccucgccauccuaaaaggaaucuacaacgucgcuaccugcggccucuucggccuggucucuuuccuacuccuuugcggccgcucaugcucuacaaucuacaaaggagucuacgaacuacaaacccucgaacucgacauggccucacucaacaugaccaugccccuauccugcacgaaaaacaacucccaccacuacaucaugguagggaacgaaacaggacucgaacucacucucaccaacacauccauaaucaaccacaaauucugcaaccucuccgacgcccacaagaaaaaccuauacgaccacgcccuaaugucaaucaucuccaccuuccaccucucuaucccaaacuucaaccaguacgaagcuauguccugcgacuucaacggcggcaaaaucuccguacaauacaaccucucacacaccuacgccgucgacgccgcaaaccacugcggcaccaucgccaacggaguucuucaaaccuucaugcgcauggccuggggaggcucauacaucgcacuagacuccggcaaaggauccugggauuguaucaugaccucuuaccaauaucucauaauccaaaacaccaccugggaagaccacugccaauucucccgacccagcccuaucggauaccucggccuacucagccaacguacacgcgacaucuacaucucccgucgucuacucgggaccuucacauggacccuaucggacuccgaaggcaacgaaaccccaggaggauauugccucacccgauggaugcucaucgaggcugaacucaaaugcuucggcaacaccgccgucgccaaaugcaacgaaaaacacgacgaagaguucugcgacaugcugcgacucuucgacuucaacaaacaagccauccgacgccucaaaaccgaagcacaaaugucaauccaacucauaaacaaagcaguuaacgcacucaucaaugaccaacucaucaugaaaaaccaccuucgagacaucaugggcauaccauacugcaacuauagcaaauacugguaucuaaaucacaccgucaccggcaaaacgucacucccccguugcuggcucgucagcaauggcuccuaucuaaacgaaacacacuucuccgacgacaucgaacaacaagcugacaacaugaucacagaacuccuccaaaaagaauacaucgaccgccaaggcaaaacaccccucggacucgucgaccucuucguauucuccaccucuuucuaccuuaucucaaucuuccuccaccucgucaaaaucccuacccaccgucacgucgucggcaaaccgugccccaaaccgcaccgccuaaaucacaugggcauaugcuccugcggccuauacaaacaucccggcguuccggucaaauggaaacgcuaa

SEQ ID NO: 3150 - RNA, 1473 nt, Artificial Sequence
  derived and/or modified CDS sequence (opt11) from Lassa virus__AIT17712__GPC
augggucaaaucauaaccuucuuccaagaagucccccacgucaucgaagaagucaugaacauaguacuaaucgcccucucucuucuugcaauccucaaaggcaucuacaacguagcuaccugcggccucuucggccucgucucauuccuccuccucugcggccguuccugcuccacuacauacaaaggcgucuacgaacuacaaacccucgaacucgacauggccucccugaacaugaccaugccccucuccugcaccaagaacaauucacaccacuacaucaugguaggcaacgaaaccggccuagaacucacacucacuaacaccuccaucaucaaccacaaauucugcaaccucuccgacgcccacaagaaaaaccuauacgaccacgcccucauguccauaaucucuaccuuccacuuauccauccccaacuucaaccaauaugaggccauguccugcgacuucaacggaggcaaaaucagcguccaauacaaccugucacacaccuacgccguagacgccgcaaaccacugcgguaccauagccaacgguguacugcaaaccuucaugcgcauggccuggggcggauccuacaucgcccucgacuccggaaaaggcgccugggacugcaucaugaccuccuaccaauaccucaucauccagaacaccacgugggaagaccacugccaauucucccgacccucccccauuggcuaccucggccuccuuucacaacgcacccgcgauauauacaucucacgacgacuacucgguacuuucaccuggacccuaucagacucagaaggcaacgaaacaccuggcggcuacugccucacccgcuggaugcuaaucgaagccgaacuuaaaugcuucggaaacacagccguugccaaaugcaaugagaaacacgacgaagaguucugcgacaugcuacgucuauucgacuuuaacaaacaagccaucaugcgccuaaaaaccgaagcccaaaugucaauccaauuaaucaacaaagccgucaacgcccucauaaaugaccaacucaucaugaagaaccaccuacgugauaucaugggcauccccuacugcaacuacuccaaauacugguaccucaaccacaccgucaccggaaaaacuucacucccacgcugcuggcucguuucaaauggcuccuaccuaaacgaaacacacuucuccgacgacauagaacaacaagcagacaacaugauaaccgaaaugcuacaaaaagaauacauagaccgccaaggaaagacaccccucggucucguugaccuauucgucuucuccaccagcuucuaccucaucuccaucuuccuucaccucgucaaaauccccacccaccgccacguaaucggaaaacccugccccaaaccccaccgccuaaaccacaugggcaucuguuccugcggacucuacaaacacccaggaguacccguccgcuggaaacgcuaa

SEQ ID NO: 3151 - RNA, 1473 nt, Artificial Sequence
  derived and/or modified CDS sequence (opt11) from Lassa virus__AIT17718__GPC
augggccaaaucaucacauucuuccaagaagucccccacgucauagaagaagucaugaacaucguccucaucgcccucucccugcucgccauccucaaagggaucuacaacguugccacaugcggcuuauucggccuuguaucuuuccugcuacucugcggcagaucaugcuccaccaccuacaaaggcgucuacgaacuccaaacacucgaacuggacauggcaucccuuaacaugacaaugccucucucuugcaccaaaaacaacucccaccacuacauccgaguaggcaacgaaacaggccuagaacucacccucaccaacgccuccauaaucaaccacaaauucugcaaccucagcgacgcccacaagaaaaaucucuacgaccacgcccuaaugagcaucaucagcacauuccaccucucgaucccaaacuucaaccaauacgaagcuaugucgugugacuucaacggcggaaaaaucuccguacaauacaaccucagccacgcuuacgccaucgacgccgcgaaccacugcggcacagucgccaacggcguacuccaaaccuucaugcgcauggccuggggcggcagcuacaucgcccucgacuccggccggggaaacugggacugcaucaugaccuccuaccaauaccucaucauccaaaacacaaccugggaagaccacugccaauucucaaggcccagccccaucggauaccucggccuccugucccaacgcacucgcgacauauacaucucgagaagacuccuaggcaccuucaccuggacccucuccgacuccgaaggcaacgaaacccccggaggcuacugccuaacacgguggaugcuaaucgaagccgaacucaaaugcuucggcaacacagcggucgccaaaugcaacgaaaaacacgacgaagaguucugcgacaugcuacgccuuuucgacuucaacaaacaagcaauccgccgccucaaaaccgaagcccaaaugucaauccaacucaucaacaaagccguaaacgcacuaaucaacgaccaauuaauaaugaaaaaucaccuccgcgacaucaugggcaucccauacugcaacuauuccaaauacugguaccucaaccauacaguuacaggaaaaacaucacucccccgcugcuggcuaguaucaaacggcuccuaccucaacgaaacacacuucuccgacgacauagaacaacaagccgacaacaugauaaccgaacuccuccaaaaagaauacauggaccgccaaggcaaaaccccacuuggcuuagucgaccuauucgucuucuccacauccuucuaccucaucaguauauuucuccaccucguaaagauccccacccaccgccacguaaucggaaaacccugcccaaagccccaccgucuaaaccacaugggcauuugcuccugcggcuucuacaaacacccuggaguccccgucaaauggaaacgcuaa

SEQ ID NO: 3152 - RNA, 1473 nt, Artificial Sequence
  derived and/or modified CDS sequence (opt11) from Lassa virus__AIT17724__GPC
augggccaaaucauaaccuucuuccaagaagucccacacguaaucgaggaagucaugaauaucguccucaucgcccuaucacugcucgccauccucaaaggaaucuacaaugucgccacaugcggacuauucggccuagucucuuuccuccuccucugcggacgaucaugcuccaccacauacaaaggagucuacgaacuacaaacccucgaacuggacauggccaaccucaacaugacaaugccccuuuccugcaccaaaaacaacucucaccacuacaucauggucggaaacgaaaccggacuugaacuuacccucaccaacacauccaucaucaaccauaaauucugcaaccugucagacgcccacaagaaaaaccucuacgaccacgcacuaauguccaucaucuccacguuccaccucuccauucccaacuucaaccaauacgaagcaauguccugcgacuuuaauggcggcaaaauuuccguccaauacaaccucagccacacauacgccgucgacgccgccaaccacugcgguaccgucgccaacggcguacuacaaacauucaugcgcauggccuggggcggcuccuacauagcccuugacuccggaaaaggcucuugggacugcaucaugaccucuuaccaauaccucaucauccaaaacacaaccugggaagaccacugccaguucucacgccccucccccaucggauaccugggacuccucucccaacgcacccgugacauauacauaucacgccgccuacuuggcaccuucaccuggacccucucagacuccgagggcaacgaaacccccggcggcuauugccuaacccgcuggaugcucauagaggccgaacucaaaugcuucggcaacaccgccguagcaaaauguaacgaaaaacacgacgaagaguucugcgacaugcuccgccucuuugacuucaacaaacaagccauccgccgccucaaaaccgaagcacaaauguccauacaacugaucaacaaagccgucaacgcccucaucaacgaucaacucauaaugaaaaaccaccuccgcgauaucaugggcauccccuacugcaacuacuccaaauacugguaccuaaaccacaccguaaccggcaaaaccagccucccucgcugcuggcuagucucaaacggcuccuaucucaacgaaacccacuuuuccgacgacaucgaacagcaagccgacaauaugauaacugaacuccuacaaaaagaauacauggaccgacaaggaaaaacaccccuaggccuaguagaccuauucgucuucuccaccuccuucuaccucauaucaaucuuccuccaccuagucaaaaucccaacucaccgccacaucaugggaaaaccaugcccuaaaccccaccgacucaaccacaugggaaucugcagcugcggccucuacaagcaccccgggguucccgucaaauggaaacgauaa

SEQ ID NO: 3153 - RNA, 1473 nt, Artificial Sequence
  derived and/or modified CDS sequence (opt11) from Lassa virus__AIT17728__GPC
augggccaaaucaucaccuucuuccaagagguaccacacguuaucgaagaaguuaugaacaucguacucaucgcccucucccuccucgccauccuuaagggaauauacaacguugcaaccugcggccucuucggccuaguauccuuccuccuacucugcggccgcuccugcaguaccacguacaaaggcguauacgaacuccaaacccucgaacuagauaugggcucccucaauaugacaaugccccucucaugcaccaaaaacaacucacaccacuacauaauggucggaaacgaaaccggccucgagcucacccucaccaauaccucgaucaucaaccacaaauuuugcaaccucuccgacgcccacaagaaaaaccuauacgaccacgcccugaugagcaucauauccaccuuccaccucucuauccccaacuucaaucaauacgaagccaugagcugcgacuucaacggcggcaaaaucucaguccaauacaaccucucacacaccuacgccgucgacgcagcuaaccacugcggcaccaucgccaacggcguacugcaaacguucaugcgaauggccuggggcgguuccuacaucgcccucgacucggguaaaggcuccugggacugcauaaugaccuccuaccaauaccucauaauccaaaacaccacaugggaagaccacugccaauucucccgaccuucacccaucggcuaccucggacuccuaucucaacgaacacgcgacaucuacaucucacgccgucuacucggcaccuucacuuggacccuuuccgacucagaaggaaaugaaacaccaggaggcuacugccucacacgcuggaugcucaucgaagcagaacucaaaugcuucggcaacaccgcaguugccaaaugcaacgagaaacacgacgaagaguucugcgacaugcuccgacucuucgacuucaacaaacaagcaauccggcgacucaaaacugaagcacaaaugucaauccagcucauuaacaaagccgucaaugcccuuaucaacgaccaacucaucaugaaaaaccaccuacgcgacaucaugggcaucccuuacugcaauuacuccaaauacugguaccucaaccacaccgucaccggaaaaaccucccucccccgaugcuggcucgucucuaacggcuccuaccucaaugaaacucacuucuccgacgacaucgaacaacaggcagacaauaugauaacggaacuucuccaaaaagaauacauggaccgccaaggcaaaacaccacuaggccuagucgaccuguucgucuucuccaccuccuucuaccuaaucuccauauuccuacaccucgucaaaauaccaacccaccgacaugucaucggcaaacccugccccaaaccacaccgacucaaccacaugggcaucugcagcugcggccucuacaaacaccccggcguacccgucaaauggaaaagguaa

SEQ ID NO: 3154 - RNA, 1473 nt, Artificial Sequence
  derived and/or modified CDS sequence (opt11) from Lassa virus__AIT17732__GPC
augggccaaaucaucaccuucuuucaagaaguaccacacgucaucgaagaagucaugaacaucguccuuauagcacucucacuccuagccauacucaaaggcauuuacaacgucgcaaccugcggccuauucggccuagucuccuuccuacuccuaugcggccgcucaugcuccaccaccuacaaaggcguuuaugaacuacagacccucgagcucgacauggccucccucaacaugaccaugccccuuagcugcaccaagaauaacucccaccacuauaucauggucggcaacgaaaccggccuagaacucacacuaacaaacaccuccaucaucaaccacaaguucuguaaccucucagaugcccacaagaaaaaccucuacgaccaugcacucauguccauaaucuccaccuuccaccucucuauccccaacuucaaccaauacgaagccauguccugcgacuucaacgggggcaaaaucucuguucaauacaaccucucacacacauacgccguggacgccgccaaccacugcggcaccaucgccaacggaguccuccaaaccuucaugcgcauggccuggggcggcuccuacaucgcucucgacuccggcaaaggcucaugggacugcaucaugaccuccuaccaauaccucaucauccaaaacaccaccugggaagaccacugccaauucucccguccaucccccaucggcuacuuaggccuccugucacaacgcacccgcgacauauacaucucacgccgccuacucggaacuuucaccuggacccucuccgacucagaaggcaacgaaacccccggaggcuacugccucacccgcuggaugcucaucgaagccgaacucaaaugcuucggcaauaccgccgucgccaaaugcaacgaaaaacacgacgaagaguucugcgacaugcuccgacuauucgacuuuaacaaacaagccauccgccggcucaaaaccgaagcccaaauguccauccaacugauaaacaaagccguaaacgcucuaauaaacgaccaacuaaucaugaaaaaccaccuacgugacaucaugggaaucccauacugcaacuacucuaaauacugguaccuaaaccacaccgucaccggcaaaaccucucucccccgcugcuggcucgucucaaacggauccuaccucaaugagacacacuucagcgacgacaucgaacaacaagcagacaauaugaucaccgaacuacuccaaaaagaauacauagaccgacaaggaaaaacaccccucggccucgucgaccuauucgucuucuccaccucguucuaccucaucagcaucuuccuccaccucguaaaaauccccacacaccgacacaucgucggaaagcccugcccaaaaccacaccgccuuaaccacaugggaauaugcucaugcggccuauacaaacaccccggaguccccgucaaauggaaacgcuaa

SEQ ID NO: 3155 - RNA, 1473 nt, Artificial Sequence
  derived and/or modified CDS sequence (opt11) from Lassa virus__AIT17736__GPC
augggccaaaucgucaccuucuuccaagaagucccccacguaaucgaagaagucaugaacauaguccucaucgcccucucccuccuagccauacuuaaaggcaucuacaacgucgcaaccugcggccucuucggccuagucuccuuccuccuccuaugcggaagauccuguuccacaaccuacaaaggcguauacgaacuacaaacccucgaacucgacauggccucacucaacaugacuaugccccucuccuguaccaaaaacaacucccaccacuacaucaugguaggcaacgagacaggccucgaacucacccucacuaacaccuccaucaucaaccauaaauucuguaaccucuccgaugcccacaagaaagaccuauacgaccacgcccucauguccaucaucucgacauuccaccucuccauacccaacuucaaccaauacgaagccauguccugcgacuucaacggcggcaaaauaagcguucaauacaaccuaucccacaccuacgcagucgacgccgccaaccacugcggcaccauagcgaacggcguucuccaaaccuucaugcgaauggcauggggcggaucauacaucgcacucgacuccggcaaaggcuccugggacugcaucaugaccucauaucaauaucucaucauccaaaacacaacaugggaagaccacugccaauucagccgccccuccccaaucggcuaccucggccuccucucccaacgcacccgcgacaucuacaucucccgacgacuccuuggcaccuucacguggacccuaucagacuccgaaggcaacgagacccccggaggcuacugccucacccgcuggaugcuaaucgaagcagaacuuaaaugcuucgggaauacggccgucgccaaaugcaacgaaaaacaugaugaagaguucugugacaugcuccgacuauucgacuucaacaaacaagccaucaugcgccucaagaccgaagcucaaauguccauccaacucaucaacaaggccgucaaugcccucaucaacgaccaacuaaucaugaagaaucaccuccgcgacaucaugggaaucccguacugcaacuacuccaaauacugguaccucaaccacaccgucaccggcaaaacaucccucccacgcugcuggcucgucucaaacggauccuaccucaacgaaacccgcuuuuccgacgacaucgaacaacaagccgacaacaugaucacagaaaugcuacaaaaagaauacuuagaccgacaaggaaaaacaccccugggccucguagaucuauucgucuuuucaaccucauucuaccucaucucaauauuccuccaccuagucaaaauccccacccaucgccacaucaucggcaaacccugccccaaaccacacagacucaaccacaugggcauaugcagcugcggccucuacaaacaccccggggucccagucaaauggaagcgcuag

SEQ ID NO: 3156 - RNA, 1473 nt, Artificial Sequence
  derived and/or modified CDS sequence (opt11) from Lassa virus__AIT17744__GPC
augggccaaaucaucacuuucuuucaagaaguuccccacgucaucgaagagguuaugaacaucguccucaucgcccuaucccuccucgcaauucuaaaaggcauauauaacguagcuaccugcggacuauucggucuuaugucuuuccuccuccucugcggccgauccugcuccacgacauacaaagggguauacgaacuccaaacccucgaacuugacauggccaaccucaacaugaccaugccacuuuccugcaccaaaaacaacucacaccacuacaucauggucggcaacgaaacaggccuugaacucacacucacaaacaccucaauaauaaaccacaaauucugcaaccucuccgacgcccacaagaaaaaccucuacgaccacgcccucaugucaauaaucucuaccuuccaccucuccauucccaacuucaaccaguacgaagccaugucuugcgauuuuaacgggggcaaaauauccguccaauacaaucuuagccacgccuacgccgucgacgcugccaaccacugcggaaccauugccaacgguguccuacagaccuuuaugcgcauggccuggggcggauccuacaucgcccucgacuccggcaaaggaagcugggacugcaucaugaccagcuaccaauaccuaauaauacaaaacaccucuugggaagaccacugccaauucagccgucccucacccaucggauaccucggccuccuuucacaacgcacccgugacaucuacaucucccgccgccuccuaggaaccuucaccuggacccucuccgauucagaagguaacgagaccccaggcggcuacugccucacacgcuggaugcucauagaggcagaacucaaaugcuucggcaacaccgccgucgccaaaugcaacgaaaaacacgacgaagaguucugugacaugcuccgccucuucgacuucaacaaacaagccauccggcgccuaaaaaccgaagcacaaaugucaauccaacucaucaacaaagccgucaacgcccuaaucaacgaccagcuaaucaugaaaaaccaccuccgcgacaucaugggcauccccuacugcaacuacuccaaguacugguaccucaaccacaccgucaccggcaaaaccucacucccccgcugcuggcucgucucaaacggcagcuaccuaaacgaaacacacuucuccgacgacaucgaacaacaagccgacaacaugauaaccgaacugcuacaaaaagaauauaucgaccgccagggaaagaccccacuaggccuagucgaccucuucgucuuuuccacaucauucuaccuaaucagcaucuuccuccaccuagucaaaauccccacacaccgacacguuauuggcaaacccugccccaaaccacacagacuaaaccacaugggcaucugcuccugcgggcuauacaaacaucccggagucccagucaaauggaaaagauga

SEQ ID NO: 3157 - RNA, 1473 nt, Artificial Sequence
  derived and/or modified CDS sequence (opt11) from Lassa virus__AIT17752__GPC
augggccaaaucaucacauucuuccacgaaguaccacacguuaucgaagagguuaugaacaucguccucaucgcccuuucccuccucgcaauacucaaaggcaucuacaacgucgccacaugcggccucuucggucuaguauccuuccuccuccuuugcggcagauccugcuccacaaccuacaaaggagucuacgagcuccaaacccuagagcucgacauggccucccuaaacaugaccaugccccucuccuguaccaaaaauaacucccaccacuacaucaugguaggcaacgaaaccggccucgaacucacccucacaaacacauccaucaucaaccacaaauucugcaaccucuccgacgcccacaagaaaaaccucuacgaccacgcccucauguccaucaucuccaccuuccaccuaucaauucccaacuucaaccaauacgaagccaugagcugcgacuucaacggaggcaaaaucucaguacaauauaaccuaucacauacauacgcaauagacgccgccaaccacugcgggaccauagccaacggcguccugcagaccuuuaugcgcauggccugggguggcucauacaucgcccuagacuccgggcgcggcuccugggauugcaucaugaccagcuaucaauaccucaucauccaaaacaccacaugggaagaccauugccaguucagccgccccuccccaaucggauaccuuggccuccucucccagcgaacccgcgacaucuacaucucccgacgccuccucggcacauucaccuggacgcucuccgacucagaaggcaacgaaacccccggggguuacugccuaacccgguggaugcucaucgaagcagaacugaaaugcuucggcaacaccgcuguggccaaaugcaacgaaaaacacgacgaggaguucugcgacaugcuacgccuuuucgacuucaacaaacaagccauacgacgccucaaaaccgaagcgcaaaugucaauccaacucaucaacaaagcagucaacgcacucaucaacgaccaacuuauuaugaaaaaccaccuccgcgauauuaugggcauccccuacugcaacuacuccaaauacugguaccuaaaccacacagucaccggcaaaaccucccucccccgcugcuggcuggucuccaacgguuccuaccucaacgaaacacacuucucagacgacaucgaacaacaggccgacaacaugaucaccgaacuccuacaaaaagaauacaucgaccgccagggaaaaaccccacucggccuuguagaccucuuuguauucucuacauccuucuaccucaucuccaucuuccuccaccuaguaaaaauacccacacaccgccacgucaucggcaagcccugccccaaaccacaucgacuuaaccacaugggcaucugcucaugcggccuuuauaagcaccccggagucccagucaaauggaaacgcuaa

SEQ ID NO: 3158 - RNA, 1473 nt, Artificial Sequence
  derived and/or modified CDS sequence (opt11) from Lassa virus__AIT17756__GPC
augggacaaaucauaaccuucuuccaagaagugccccacgucaucgaggaagucaugaacaucguccuaaucgcccuuucccuccucgcgauacucaaaggcaucuacaacgucgcgaccugcggccucuucggacuuguguccuuccuccuucucugcggccgcuccugcucaaucacauacaagggcguauacgaacuacaaacccucgaacucgacauggccucccuaaacaugacuaugccccuguccugcacaaagaacaacucccaccacuauauaaugguugguaacgaaaccggccucgagcuaacccugaccaacacauccaucauaaaccacaaauucuguaaccucucugacgcccacaagaaaaaccucuacgaccacgcccuaauguccaucaucucaaccuuccaccucucaauacccaacuucaaccaauacgaagccaugagcugcgacuucaacggcgguaaaauuagcguacaguacaaccucucacacaccuacgcagucgacgccgccaaccacugcggcacaaucgccaauggcguccuacagaccuucaugcguauggccuggggcggcucauacauugccuuggacuccggccgaggcucaugggacugcaucaugaccuccuaccaauaccuaaucauacaaaacaccaccugggaagaccacugccaauucagcagacccucccccaucggcuaccucggccuccuaucccaacgcacucgagacaucuacaucucccgacgacuucucggaaccuucaccuggacccuuucagacuccgagggcaacgaaacgccagguggauacugccucacacgguggauguugauugaagcugaacuaaaaugcuuuggcaacaccgccguagccaaaugcaacgaaaaacacgacgaggaguucugcgacaugcuucgccuuuucgacuucaacaaacaagccauccgucgccucaaagccgaagcccaaauguccauccaacugaucaacaaagccgucaacgcccucaucaacgaucaacucaucaugaaaaaccaccucagagacauaaugggcauccccuacuguaacuacucaaaauacugguaccucaaccacaccgucaccggccgcaccucccucccccgcugcuggcucgucucaaacggcuccuaccuaaacgaaacccacuucuccgacgacaucgaacagcaagccgacaacaugauaaccgaacuacuacaaaaagaauacaucgaccgccaaggcaagacaccccucggccuaguggaccucuucguauucuccaccuccuucuacuuaaucuccaucuuccuccaccucgucaagauuccaacccaccgacacaucaucggcaaacccugcccaaaaccccaccgccuaaaccacaugggaauuugcuccugcggccucuacaaacacccaggaguucccgucaaauggaaacgcuaa

SEQ ID NO: 3159 - RNA, 1473 nt, Artificial Sequence
  derived and/or modified CDS sequence (opt11) from Lassa virus__AIT17758__GPC
augggccaaaucaucaccuucuuccaagaggucccccacguaauagaagaagucaugaacaucguccuaaucgcccuaagccuccucgccauccucaaaggcauauacaacgucgcaaccugcggccucuucggccuugucucguuccuacuccuuugcggacgguccugcuccaccaccuacaaaggcgucuacgaauuacaaacucucgaauuaaacauggccucccuuaacaugaccaugccccucucaugcaccaaaaacaacucacaccacuacaucauggucggaaacgaaacaggacuagaacugaccuuaacaaacaccuccauuaucaaccacaaauucugcaaccucucagacgcccacaaacgcaaccuguacgaccacgcccuuauguccaucaucuccacauuucaccuauccaucccaaacuucaaccaauacgaagccauguccugcgacuucaacggcggcaaaaucucaguccaauacaaucuaucccacaccuacgccguagacgcggcuaaacacugcggcaccauugccaacggcguccuccaaaccuucaugcgaauggccugggguggaucauacaucgcucucgacuccggaaaaggaucaugggacugcauaaugaccuccuaccaauaccucauaauccaaaacaccaccugggaagaccacugugaguucucccgaccaagcccaaucggcuaccucggucuccuaagccaacgcacucgcgacaucuacauaucccgccgacuacuuggaacauucacauggacacucuccgacagcgaagguaacgaaacccccgguggcuacugccucacccgauggaugcucaucgaagccgaacuaaaaugcuucggcaacaccgccgucgcaaaaugcaacgaaaaacacgacgaagaguucugcgacaugcuccgccucuucgacuucaacaagcaagccauccgccgccucaaggccgaagcacaaauguccauccagcuaaucaacaaagccgucaacgcacucaucaacgaccagcucaucaugaaaaaccaucuccgagacaucaugggcaucccauacugcaacuacuccaaauacugguaccucaaccacaccgucaccgggaagaccucccucccccgcugcuggcucguauccaacggcucauaccucaacgaaacccacuucuccgacgacaucgaacaacaagccgauaacaugauuaccgaacuccuccaaaaagaauacaucgaucgccaaggaaaaacaccccuaggccucguagaccucuucgucuucuccacauccuucuaccuaauauccaucuuccuccaccucgugaaaauccccacacaccgccacguaauaggcaaacccugccccaaaccccaccgccucaaccacaugggaaucugcucaugcggccucuacaaacaccccggaguacccgucaaauggaaacgauaa

SEQ ID NO: 3160 - RNA, 1473 nt, Artificial Sequence
  derived and/or modified CDS sequence (opt11) from Lassa virus__AIT17762__GPC
augggccaaaucauaacauucuuccaagaaguuccccacgucaucgaagaaguaaugaacaucguccuaaucgcccucagccuccuugcaauccucaaaggcauauacaacgucgcaaccugcggcuuauuuggccuugucuccuuccuacuccuaugcggccgcucuugcucaaccaccuacaaaggaguauacgaacuacaaacccucgaacucgacauggccucccucaacaugacaaugccacucagcugcaccaaaaacaacucccaucacuacaucauggucggcaacgagacaggccuagaacucacccuuacuaacaccucuaucauaucccacaaauucugcaaccucuccgacgcccacaagaaaaaccuauacgaucacgcccugauguccauuaucucaacauuccaccucucuaucccaaacuucaaccaguacgaagccaugucuugcgacuuuaacggcggcaaaaucuccguucaauacaaccucucccacacauacgccgucgacgccgccaaccacugcggaaccauugccaacggcguucugcaaaccuucaugcgcauggccuggggcggcuccuacauagcccucgacuccggaaaaggcuccugggacugcauuaugaccagcuaucaauaucuaaucauccagaacaccacaugggaagaucacugucaauuuucccgccccuccccaauuggcuaccuuggccuccuaucccaacgcacccgcgacauauacaucucacgccgccuccuuggaaccuucaccuggacccucucagacuccgaaggcaacgaagcccccggcggguacugccucacgcgcuggaugcucauagaagccgaacucaaaugcuucggaaacaccgccguagccaaaugcaacgaaaaacacgacgaagaguucugcgacaugcuacgccucuuugacuucaacaaacaagccauccgacgccuaaaaacagaagcccaaaugucaauacaauuaauaaacaaagcagucaacgcccucaucaacgaccaacugauaaugaaaaaccaccuccgcgacaucaugggcauccccuacugcaacuacucacgauacugguaccuuaaccacaccguaacuggaaaaacaucccuaccccgcuguuggcuaguauccaacggcucauaccucaacgaaacccacuucuccgacgacaucgaacaacaagcagacaacaugaucaccgagcuccuccaaaaagaauacauggaccgccagggcaagacaccccucggccucguugaccuauucguuuucuccaccuccuucuaccuaaucuccaucuuccuccaccuuguaaaaauccccacacaucgacacgucaucggaaaacccugccccaaaccccaccgccuuaaccacaugggcauaugcucaugcggccucuauaaacaucccggaguccccguuaaauggaaacgauaa

SEQ ID NO: 3161 - RNA, 1473 nt, Artificial Sequence
  derived and/or modified CDS sequence (opt11) from Lassa virus__AIT17770__GPC
augggacaaauagucaccuucuuccaagaagucccacacgucaucgaagaagucaugaacauaguccucauagcacuuucccuacucgcuauccucaaaggcauauacaacguagcaaccugcggccucuucggacucguuuccuuccuacugcucugcggccguuccugcuccaccaccuacaaaggcgucuacgaacuacaagcccucgaacuagacaugagcucacucaacaugaccaugccccucuccugcaccaaaaauaacucccaccacuacaucaugguaggcaacgaaacuggccuugaacucacccuaacgaacacauccauaauccaccacaaauuuugcaaccucuccgacgcccacaagaaagaucucuacgaccacgcccucauguccaucaucucaaccuuccaccucuccauccccaacuucaaccaguacgaagccauguccugcgacuucaauggcgguaaaaucuccguacaauacaaccucucacacaccuacgccguagacgccgccaaccacuguggcaccauagccaacggaguccuacaaaccuucaugcgcauggccugggguggcucauacaucgcccucgacuccggaaaaggcggcugggacugcauuaugaccucauaucaauuccucaucauacaaaacaccacaugggaagaccacugccaauucucucgcccgucaccaaucggcuaccucggccugcuaucccagcgcacacgcgacaucuacaucucacgccgccuacucggcaccuucaccuggacacuaagcgacuccgaaggcaacgaaacacccggcggauacugccucacacgcuggaugcucauagaagcugaacuaaaaugcuucggcaacaccgccgucgcaaaaugcaacgaaaaacacgacgaagaauuuugcgacaugcuucgccucuucgacuucaacaaacaagccaucaaacgccucaagaccgaagcucagauguccauccaccucaucaacaaagcugucaacgcccuuaucaacgaccaacucaucaugaaaaaccaccuccgcgacauaaugggaauccccuacuguaacuauuccaaauacugguaccuaaaccacacagugacgggcaaaaccucccucccccgcugcuggcuuguauccaauggcagcuaccuuaacgaaacccacuucucugaugacauagaacaacaagccgacaacaugaucaccgaacuccuacaaaaagaauacaucgaccgccaaggcaaaacaccccucggccuagucgaccucuucgucuucucaaccucauucuaccuaaucuccaucuuccuccaccuagugaagauaccaacccaucgccacguuaucggaaaaccaugcccaaaaccacaccgccucaaccacaugggaaucugcuccugcggacuauacaaacacccaggaguacccguucguuggaaacgcuaa

SEQ ID NO: 3162 - RNA, 1473 nt, Artificial Sequence
  derived and/or modified CDS sequence (opt11) from Lassa virus__AIT17778__GPC
augggccaaaucaucaccuucuuccaagaagucccucacgucauagaagaaguaaugaacaucguccucaucgcccucucacugcucgcaauccucaaggguaucuacaacgucgcaaccugcggccuauucggacucgucucauuccuccuccucugcggccgcuccugcucgaccacauacaaaggcguauacgaacuccaaacacucgaacuagacauggccaaccucaacaugacaaugccccucuccugcaccaaaaacaacucccaccauuacaucauggucggcaacgaaaccggccuagaacucacccucaccaacaccuccauuaucaaucacaaauucugcaaucucuccgacgcccacaagaaaaaucucuacgaccacgcccuuaugucaaucaucuccaccuuccaccucucgauccccaacuucaaccaguacgaggcaauguccugugacuucaacggagggaaaauuuccguccaauacaauuuaucacacaccuacgcacgagacgccgcuaaccacugcggaaccaucgccaacggcguccuccaaaccuucaugcgcauggccuggggcggcuccuacaucgcccucgacucaggaaaaggcagcugggacugcauaaugaccuccuaccaauaucucaucauccaaaacacaaccugggaagaccacugccaauucucccgacccucccccauuggauaccucggacuacucucacaaagaacacgagacaucuacaucucgcgccgacuccucggaaccuucacauggacccucucagacuccgaaggcaacgaaaccccaggcggcuacugccucacccgcuggaugcucauagaggcggaacuaaaaugcuucggcaacacagccguagccaaaugcaacgaaaaacacgacgaagaguucugcgacaugcuacgacucuucgauuucaacaaacaagccauccgccgacucaaaaccgaagcacaaaugaauauacaacuaaucaacaaagcaguaaacgcccuaaucaacgaccaacucauaaugaaaaaccaccuccgcgacauuaugggaaucccauacugcaacuacuccaaauauugguaccucaaccacacagucaccggaaaaacaucccuccccagaugcuggcucgucuccaacggcucauaccuaaacgaaacccacuucucagacgacaucgaacaacaagccgacaacaugauaacagaacuccuccaaaaagaauacauggaccgacaaggcaaaacaccccucggccuaguagaccucuucguauucucuaccuccuucuaccuaauaucaaucuuccuccaccucgucaaaauacccacccaccgccacguaauugggaagcccugccccaaaccccaccgacucaaccacaugggaaucugcucauguggccuuuacaaacaccccggagucccagucaaauggaaacgcuaa

SEQ ID NO: 3163 - RNA, 1473 nt, Artificial Sequence
  derived and/or modified CDS sequence (opt11) from Lassa virus__AIT17782__GPC
augggccaaaucaucaccuucuuccaggaagucccccacgucaucgaagaagucaugaacauaguccucauugcccucucccuccucgcaauccuaaaaggcaucuacaacgucgcaacuugcggccucuuuggacucgucagcuuccuccuccucugcggaagaucaugcuccacaaccuacaaaggagucuacgaacuccaaacacuagaauuagacauggccucccucaacaugacuaugccacucuccuguaccaaaaacaauucccaccauuacaucauggugggaaacgaaaccggccucgagcucacacucacaaacaccuccaucaucaaccacaaauucugcaaccuaucagacgcccacaagaaaaaccuauacgaccacgcacucauguccaucauauccacauuccaccuauccauaccaaacuucaaccaauacgaagccauguccugcgacuucaacgguggcaaaaucucaguccaauacaaccucucccacaccuacgccguagacgccgccaaccacugcggcaccaucgccaacggaguccuccaaacauucaugcgcauggccuggggaggguccuacaucgcgcucgacuccgguaaaggcagcugggacugcaucaugacauccuaccaauaccucaucauccaaaacaccaccugggaggaccacugccaauucucccgacccucacccauaggauaccuaggccuccuuucccagcgaacccgcgacaucuacauaucucgccgacuccuaggaacguucacuuggacacuauccgacucggaaggcaacgaaacaccaggcggcuacugccucacccgauggaugcucaucgaagccgaacucaaaugcuucggcaauaccgccgucgcaaaaugcaacgaaaaacacgacgaagaguucugugacaugcuacgacuguucgacuucaacaaacaagccauaaaacgacuaaaaaccgaagcccagaugagcauccaacucauaaacaaggccgucaacgcccuaaucaacgaccaacucauuaugaaaaaccaccuaagagacaucaugggcauccccuacugcaacuacucaaaguacugguaccucaaccacacugucaccggcaaaaccucccucccccgaugcuggcuuguaucgaacggcucauaccucaacgaaacccacuucuccgacgacauagaacagcaagcagacaacaugauaacagaacuccuacaaaaagaauacaucgaccgccaaggcaagacuccccuuggccucgucgaccucuucguauucuccaccuccuucuaccucaucuccauauuucuccaccuaguaaaaauccccacccaccgacacgucgucggaaagccuugccccaaaccccaccgccucaaccacaugggcaucugcuccugcggccuauacaaacaccccggcguccccgucaaauggaaacgcuaa

SEQ ID NO: 3164 - RNA, 1473 nt, Artificial Sequence
  derived and/or modified CDS sequence (opt11) from Lassa virus__AIT17786__GPC
augggccaaaucaucaccuucuuccaagaaguaccccauguaaucgaagaagucaugaacauaguccucaucgcacucucccuacucgcaauccuaaaaggaaucuauaauguagccacaugcggccucuucggccucgucuccuuccuacuccucuguggccgcucauguuccaccaccuacaaaggcgucuacgaacuccaaacucuagagcuugacauggccucacucaacaugacuaugccccucuccugcacgaaaaacaacucccaccacuacaucauggucggcaacgagaccggccuggaacucacucuaaccaacaccuccaucaucaaucacaaauucugcaaccucucagacgcacacaagaaaaaccucuacgaccacgcccuaaugucaaucaucuccaccuuucaucucuccaucccgaacuucaaccaguacgaagccauguccugcgacuucaacgguggaaaaauuuccguccaauacaaccucucccacgccuacgcgaucgacgccgccgaccacugcggcacaaucgccaacgguguccuacaaaccuucaugcgcauggcauggggaggcucauacaucgcccucgacucaggcaaaggcucaugggacugcaucaugaccucauaccaauaccucaucauccaaaacacaaccugggaagaccacugccaauucucacgcccgucaccaaucggcuaccucggacuauuaagccagcguacucgcgacaucuacauaucacgccgccuccuaggcaccuucaccuggacccuauccgacucugaaggcaacgaaacaccgggaggcuacugccucacccgauggaugcucaucgaagccgaacucaaaugcuucggcaacaccgcggucgccaaaugcaacgaaaaacacgacgaagaguucugcgauaugcucagacuguucgacuuuaacaaacaagccauccgacgccucaaaacggaagcccaaauguccauccaacugauaaacaaagccgucaacgcccuuauaaacgaccaacucaucaugaaaaaccaccuccgcgacauaauggguaucccauauugcaacuacuccaaauacugguaccuuaaccacacugucaccggcaaaaccucccuaccaagaugcuggcuagucuccaacggcucauaccucaacgaaacccacuucuccgacgacaucgaacaacaagccgacaacaugaucaccgaacucuuacaaaaagaguacauggaccggcaaggcaaaacaccccuaggccucgucgaccuauucgucuucuccaccagcuucuaccuaaucucaaucuuccuccaccuagucaaaauccccacgcaccgccacauaaccggaaaaccaugccccaaaccccaccgacucaaccacaugggaaucugcuccugcggccucuacaagcaccccggaguccccgucaaauggaaacgauaa

SEQ ID NO: 3165 - RNA, 1473 nt, Artificial Sequence
  derived and/or modified CDS sequence (opt11) from Lassa virus__AIT17790__GPC
augggacaaaucaucacauucuuccaggaaguaccucacgucaucgaagaaguaaugaacaucguucucaucgcccucucccuacuagcgauccucaagggcauuuacaacgucgccacaugcggccucuucggacucguauccuuccuccuccucugcggacguuccugcuccaccacauauaaaggcgucuacgaacuacagacccucgaacuugacauggccucacucaacaugacuaugccccucuccugcaccaaaaacaacagccaccacuacaucauggucggcaacgaaaccggacucgaacucacacuaaccaacacaucaaucauaaaccacaaauucugcaaccuaucagacgcccacaagaaaaaccuuuacgaccacgcccucauguccauaauauccacguuccaccuauccauucccaacuucaaccaauacgaggcuaugucaugcgacuucaacgggggcaaaaucagcguccaauacaaccucucacacaccuacgccguagacgccgccaaccacugcggcacaauagcaaacggaguccuccaaacauucaugcgcauggccuggggcggaagcuauaucgcccucgacucaggcaaaggcuccugggacugcaucaugaccuccuaccaguaccuuaucauccaaaacaccacuugggaggaccacugccaauucagccgccccucacccaucggcuaccucggcuuacucucccaacgcacccgcgacaucuacaucucccgccgccuacuaggcaccuucaccuggacccuaucagacucagaaggcaacgaaacccccggugguuacugccucacccgcuggaugcucauagaagcagaacuaaaaugcuucggaaacacggccgucgccaaaugcaacgaaaaacacgacgaagaguucugcgacaugcuccgacucuucgacuucaacaaacaggccauucgacgacucaaaaccgaagcacagauguccauacaacucauaaacaaagccgucaacgcccucaucaaugaccagcuaaucaugaaaaaccaccuccgcgacaucauggguaucccauacugcaacuacagcaaauacugguaccucaaccacacagucacaggcaaaaccucacucccacgaugcuggcucguuuccaacggcuccuaccucaacgaaacccauuucucugacgacaucgagcaacaagccgacaacaugaucaccgaacuccuccaaaaagaauacauggaccgccaaggcaaaacaccccugggccuagucgaccucuucguguucuccaccuccuucuaccucaucuccaucuuccuacaccucgucaaaaucccaacccaccgccacaucaccggaaaacccugccccaaaccccaccgccuuaaccacaugggaaucugcucaugcggccucuacaaacaccccggcguccccgucaaauggaaacgcuaa

SEQ ID NO: 3166 - RNA, 1473 nt, Artificial Sequence
  derived and/or modified CDS sequence (opt11) from Lassa virus__AIT17798__GPC
augggccaaaucaucaccuucuuucaggaaguaccccaugucaucgaagaagucaugaacaucguccucaucgcccucucacuccucgcuauccucaaaggaaucuacaacgucgcaaccugcggccuuuuuggccuaguaucauuccuacuccucugcggccgcucaugcuccacaaccuacaaaggcguuuacgaacuccaaacccuugaacucgacauggccucucucaacaugaccaugccccucuccugcaccaaaaacaacucacaccacuacaucaugguuggcaacgaaacuggccucgaacuaacacucaccaacacaucaaucaucaaccacaaauucugcaaccucuccgacgcccacaagaaaaaccucuacgaccacgcccucaugagcauaauuucgacauuccaccucuccauccccaacuucaaccaauacgaagccaugucaugcgacuucaacggcggcaaaaucucaguccaauacaaccuuucacacaccuaugccguagacgccgccaaccacugcggcacaaucgccaacggaguacuacaaacguuuaugcgaauggccuggggaggcuccuacaucgcccucgacuccggcaaaggcagcugggacugcauaaugaccucauaccaguaccucauaauccagaacaccacuugggaagaccacugccaauucucccgaccaucaccaaucggcuaucucggccuccucagccaacgcacccgagacaucuauaucucucgccgccuccucgguaccuucacauggacacucucugacucggaaggcaacgaaacacccggcggauacugucuaacccgauggaugcucaucgaagcagaacucaaaugcuucggcaacaccgccgucgcaaaaugcaacgaaaaacacgacgaagaguucugcgacaugcuccgccucuucgacuucaacaaacaagccaucaugcgccuuaaaaccgaagcccaaauguccauccaacucauaaacaaagcugucaacgcccucauaaacgaccaacucauaaugaaaaaccaucuccgcgacaucaugggcauccccuacugcaauuacucuaaauacugguaccuaaaccacaccguaacaggcaaaaccucccucccacgcugcuggcucgucuccaacggcagcuaccucaacgaaacccacuucagcgacgacauagaacaacaagcagacaacaugaucaccgaaaugcuccagaaggaauaccucgaccgacagggcaaaacaccccucggccucguagaccuguucgucuucuccaccuccuucuaccuuaucuccaucuuccuccaucucgucaaaauccccacccaccggcauaucaucggaaaacccugccccaaaccacacagacucaaccacauggguaucugcuccugcggccuauacaaacacccuggcguccccgucaaauggaagcgcuaa

SEQ ID NO: 3167 - RNA, 1476 nt, Artificial Sequence
  derived and/or modified CDS sequence (opt11) from Lassa virus__AIT17802__GPC
augggacaaauagucaccuucuuccaggaagucccucacgucaucgaggaagucaugaacaucguccucauagcccuaucaauccuagccgucuuaaaaggcuuauacaaccuggcaaccugcggacucguaggccucguaacauuucugcuacuauguggccguuccugcacaaccucccucuacaaaggcgucuacgagcuccaaacucuagagcucaacauggaaacccucaacaugacaaugccccucagcugcaccaaaaacaacucccaccacuacaucauggucggcaacgaaaccggacuagaacuuacacuaaccaacaccucaaucauaaaccacaaauucugcaaccuaucagacgcacacaagaaaaaccuauacaaccacgcacucauguccaucaucagcacauuccaccucagcaucccuaacuucaaccaauacgaagcaauguccugcgacuucaacggagguaaaauuagcguacaauacaaccucucacacuccuacgcaggcgacgccgccaaccacugcggcaccguagcaaacggaguccuccagaccuucaugcgcauggccuggggagguuccuacaucgcccucgacuccggacgugaccguugggacugcaucaugacauccuaccaauaccucaucauccagaacacaacaugggaagaccacugccaauucucccgccccucacccaucggcuaccuaggacuacuaucccaacgcacacgagacaucuacaucagccgacgccuccucggcacguucaccuggacacucucugacagcgaaggcaaagacacacccggcggcuacugccuaacacguuggaugcucaucgaagccgaacugaaaugcuucggaaacaccgcagucgccaaaugcaacgaaaaacacgacgaagaauuuugcgacaugcuccgacuauucgacuucaacaaacaggcaauccaacgccucaaagccgaagcccaaauguccauccaacuaaucaacaaagccgucaacgcccucaucaacgaccaacucaucaugaaaaaucaccucagagacauaaugggcauacccuacugcaacuacagcaaguacugguaccucaaccacaccacgacaggaaaaacaagccuacccaaaugcuggcucgucuccaacggcagcuaccucaacgaaacacacuucucagaugacaucgagcaacaagccgacaacaugaucaccgagaugcuucaaaaagaauacauggaacgccucggaaaaacuccccuaggccuaguugaccucuuugucuucucaaccuccuucuaccuaaucuccauauuccuccaccucgucaaaauccccacccaccgacacaucgugggacgcagcugcccaaaaccacaccgacucaaccacaugggaaucugcucaugcggacucuacaaacaacccggcguccccgucaaauggaaaagauag

SEQ ID NO: 3168 - RNA, 1476 nt, Artificial Sequence
  derived and/or modified CDS sequence (opt11) from Lassa virus__AIT17806__GPC
augggacaaauagucaccuucuuucaagaagucccacacgucaucgaagaagucaugaacaucguccucaucgcacuauccauccucgccguccucaagggccucuacaauuucgccacaugcgggcucauuggccuaguaacauuccuccuccucugcggccgcuccugcacaaccucccucuacaaaggaguauacgaacuccaaacccucgaacuaaacauggaaacccucaacaugaccaugccccuaucuugcaccaaaaacaacucccaccacuacaucaugguaggaaacgaaaccggccucgaacucacccucacaaacaccuccaucaucaaucacaaauucugcaaccuuuccgacgcccacaagaaaaaccucuacgaccacgcacucauguccaucaucucaacauuccaccucagcauccccaacuucaaccaauacgaagcaaugucaugcgacuucaacggaggcaaaaucucaguccaauacaaccuaucucacuccuacgccggcgacgcggccaaccacugcggcaccguggcaaauggcguccuucaaaccuucaugcgcauggccuggggaggauccuacaucgcccucgacuccggccgcggcaaaugggacugcaucaugaccucuuaccaguaccucaucauacaaaacacaaccugggaagaccacugccaguucucacgccccagcccaaucggcuaccucggccuacucucccaaagaacccgcgacaucuacauaucacgacgccuccuaggcacauucaccuggacccucucugacuccgaagguaaagacacccccggcggauacugccucacccgauggaugcuaauagaagccgaacuaaaaugcuucggaaacaccgccguagccaaaugcaacgaaaaacacgacgaagaguucugcgacaugcuccgccucuucgacuucaacaaacaagccauacaacggcuaaaagccgaagcccaaaugagcauacaacuuauaaacaaggcagucaacgcccuaaucaacgaccaacucauaaugaaaaaccaccuccgcgauaucaugggaauccccuacugcaacuacuccaaauacugguaccucaaccauaccaccacaggaaaaacuucccuccccaaaugcuggcucgucagcaacggcagcuaccuuaacgaaacccacuucuccgacgacaucgaacaacaagccgacaacaugaucaccgaaaugcuacaaaaagaauacauggaacgccaaggaaaaacaccccucggccucgucgaccuauucgucuucucaaccucauucuaccuaaucagcaucuuccuacaccuagucaaaauacccacucaucgccacaucgucggcaaauccugccccaaaccgcaccgccuaaaccacaugggaaucugcuccugcggacucuauaagcagcccgguguacccgucaaauggaagcguuga

SEQ ID NO: 3169 - RNA, 1476 nt, Artificial Sequence
  derived and/or modified CDS sequence (opt11) from Lassa virus__AIT17810__GPC
augggacaaaucgucaccuucuuccaagaagucccacacgucaucgaagaagucaugaacaucguacucaucgcccucuccauccucgccguacucaaaggacuauacaaccucgcaaccugcggacucgucggucuagucaccuuccuccuccucugcggccgcuccugcacaacgucacuauacaaaggcgucuacgaacuccaaacauuagagcucaacauggagacccucaacaugaccaugccccucucaugcaccaaagacaacucccaccacuacauccgcgucggcaacgaaaccggccucgaacucacccucacuaacaccucaauccucaaccacaaauucugcaaucuguccgaugcccacaaaaagaaccucuacgaccacgcccuaaugucuaucaucuccaccuuccaccucuccauccccaacuucaaccaauaugaagccaugucaugcgacuucaauggcggccggaucuccguccaauacaaccuuucccacucauacgcaggcgacgccgccaaccacugcgguaccguagccaacggaguccuccaaacauucaugcgcauggcauggggcggcuccuacauagcccuagacuccggacguggccgcugggacuguaucaugacaucguaccaauaccugaucauccaaaacaccaccugggaagaccacugucaauucucacgaccauccccuauuggauaccucggccuccucucccagcgcacccgagacaucuacaucucucgacgccuccuuggcaccuucaccuggacccucucagacuccgaaggcaaagacacccccggcggcuacugccucacccgcuggaugcucaucgaagcagagcucaagugcuucggcaacacagcagucgcuaaaugcaacgaaaagcaugacgaagaguucugcgacaugcuccgacucuucgacuucaacaaacaggccauccaacggcucaaggccgaagcccaaaugucaauccaacuaaucaacaaagcaguaaacgcccucauuaacgaccaacucaucaugaaaaaccaccuccgagacaucaugggaauacccuacugcaacuacuccaaauacugguaccucaaccacaccacaaccggcaaaacaucacucccucgaugcuggcucgucuccaacggcuccuaccucaacgaaacacacuucagcgacgacaucgaacaacaagcugacaacaugaucaccgaaaugcuccaaaaagaauauauggaacgccaaggaaaaacaccccuaggccucguggaccuauucgucuucucuaccuccuucuaccucauaucaauauuccuacaccucgucaaaauaccaacccaccgccacgucguaggcaaacccugcccaaaaccccaccgccucaaccacauggguaucugcucaugcggccucuauaagcagcccggcgugcccgucaaguggaaacgauaa

SEQ ID NO: 3170 - RNA, 1476 nt, Artificial Sequence
  derived and/or modified CDS sequence (opt11) from Lassa virus__AIT17814__GPC
augggacaaaucguaaccuucuuccaggaaguaccacacguaauagaagaagucaugaacaucguccucaucgcccuauccauccucgccguccuaaaaggacucuacaacuucgcaaccugcggucucgucggccucguaaccuucuuacuccucugcggacgcucaugcaccaccucccucuacaaaggcguauacgaacuccaaacccuagagcucaacauggagacucuaaacaugaccaugccacucucuugcaccaaaaacaacucccaccacuacauaauggucggaaacgaaacaggccucgaacucacccucaccaacacgucuaucaucgaccacaaauucugcaaccuaucagacgcccaccguaaaaaccucuacgaccacgcccucauguccaucaucuccaccuuccaccucuccaucccaaacuucaaccaguacgaagccauguccugcgacuucaacggcggaaaaauauccgugcaauauaaccucucccacagcuacgccaaggacgcagccgaccacugcggcaccguagcuaacgguguccuccagacguucaugcgaauggccuggggcggguccuacauugcacuagacuccggccggggacgcugggacugcaucaugacaagcuaccaguaccucaucauccagaacacuaccugggaagaccacugccaguucucccgacccuccccaauaggcuaccucggccuacuuucccaacggaccagagacaucuacaucucacgucgacuccuaggcaccuucaccuggacgcucagcgacuccgaaggcaaagacacacccggcgguuacugccuaacaagauggaugcucaucgaagcagaacucaaguguuucggcaacacugcaguagccaaaugcaacgaaaagcacgacgaagaguucugcgacaugcucagacucuucgacuucaacaaacaagcaauccaacgucuaaaagccgaagcccaaauguccauccaacucauaaacaaagcagucaacgcgcucauaaaugaccaauuaauaaugaaaaaccaccuccgagacaucauggggaucccauacugcaacuacagcaaauacugguaccuaaaccacacgaccaccggcaaaacaucccugcccaaaugcuggcucgucagcaacggcagcuaccucaacgaaacacacuucuccgacgacaucgaacagcaagccgacaacaugaucaccgaaaugcuccaaaaagaauacauggaacgccaagguaaaacaccccuaggacucgucgaccucuuugucuucucaaccagcuuuuaccuaaucuccauauuccuccaccucgucaaaaucccaacccaccgacacaucgucggcaagcccugcccaaaaccccaccgucucaaccauaugggaauaugcuccuguggccucuauaaacaacccggcgucccaguaaaauggaaaagauaa

SEQ ID NO: 3171 - RNA, 1476 nt, Artificial Sequence
  derived and/or modified CDS sequence (opt11) from Lassa virus__AIT17820__GPC
augggacaaaucguaaccuucuuucaagaagucccacacgucaucgaagaagugaugaacaucgugcuaaucgcccucagcauacucgccguccugaaaggcuuauacaacuucgcaacaugcggccucgucggacucgucaccuuccuccuccucugcggcagauccugcaccaccucccucuauaagggcgucuacgaacuccaaacccuagaauuaaacauggaaacucuaaacaugacaaugcccuuauccugcacaaagaacaacucccaccacuacaucauggugggaaacgagaccggucuagaacuaacccucacaaacacguccaucaucaaccacaaauucugcaaccuuucagacgcccacaagaaaaaccucuacgaccaugcacucauguccaucauuucaacauuccaccucuccauccccaacuucaaccaauaugaggccaugucaugcgacuucaacggcggaaaaauauccguccaguacaaccuaagccacuccuacgcagaagacgccgccaaccacugcggaacgguagcaaacggaguacuccaaacguucaugcgcauggccuggggagggagcuauaucgcccuugacucuggucgcggcaacugggacugcaucaugaccucauaccaauaccucaucauccaaaacacaacaugggaggaccacugccaauucucuagacccagccccaucggcuaccuaggccuccucucccaacgcacacgcgauaucuacauaucccgacgccuccucggcaccuucaccuggacccucagcgacucagaaggcaaagacacacccgggggcuacugccucaccagauggaugcucaucgaagccgaacuaaaaugcuucggaaacaccgccgucgccaaaugcaacgaaaaacacgacgaagaguucugcgacaugcuccgacucuucgacuucaacaaacaagcaauccaacgccucaaagcagaagcacaaauguccauacaacucaucaacaaagcagucaacgcccucaucaacgaccaauuaaucaugaaaaaccaccuccgagacaucaugggaaucccuuacugcaacuacuccaaauacugguaccucaaccacaccacaacaggcaaaacaucccucccaaaaugcuggcuaguaucaaacggcucuuaccuaaacgaaacacacuucuccgacgacaucgaacaacaagcagacaacaugaucaccgagaugcuucaaaaagaguacauggaacgccaaggcaaaacaccacuuggacuggucgaccuauucguguucagcaccagcuucuaccucauauccaucuuccuccaccucgucaaaauccccacacaccgccacaucgucggcaaaucaugcccaaaaccacaccgccucaaccacaugggcaucugcagcugcggacucuacaaacaaccaggcguccccguaaaauggaaacgcuag

SEQ ID NO: 3172 - RNA, 1476 nt, Artificial Sequence
  derived and/or modified CDS sequence (opt11) from Lassa virus__AIT17824__GPC
augggccaaaucgucaccuucuuccaagaaguuccccacgucauagaagagguaaugaacaucguccucaucgcacuaagcauccucgccguccucaagggacucuacaacuucgcaacaugcggccuaguaggccucgucaccuuccuucugcuuugcggccgcuccugcaccaccucaguuuacaaaggcgucuacgaacuacaaacacuggaacucaauauggaaacacuuaacaugaccaugccucucuccugcaccaaaaacaacucgcaccauuacaucauggucggcaacgaaacaggcuuagaacucacacucaccaacaccucuaucauaaaccacaaguuuugcaaccucucagacgcccacaagaaaaaccuguacgaccacgcccucaugagcauaaucuccaccuuccaccucuccauaccaaacuucaaccaauacgaagccauguccugcgacuucaacggcggaaaaaucuccguccaauacaaccuaucccacagcuaugccggggacgcagccaaccacugcggaaccgucgcaaacgguguacuacaaaccuucaugcgcauggcauggggcggaucguacaucgcacucgauuccggccacggcaaaugggacugcaucaugaccagcuaccaauaccuaauaauccaaaacaccacaugggaggaccacugccaauucucacgccccucacccaucggguaccuaggacugcucucccaacgaacccgcgacaucuacaucucccgccgccuacucggcaccuucaccuggaccuuauccgacucagaaggaaaagacaccccaggcggcuacugccucacccgcuggaugcucauagaagccgaacucaaaugcuucggcaacaccgccguagccaaaugcaacgaaaaacacgacgaagaguucugcgacaugcuccgacucuuugacuucaacaagcaagccauccaacgucuaaaagccgaagcacaaaugucaauccaauuaaucaacaaagccguaaaugcacuaauaaacgaccaauuaaucaugaagaaccaccuccgugacaucaugggcauacccuacugcaacuacuccaaauacugguaccucaaccacacaacaaccggcaaaaccucccuccccaaaugcuggcuagucuccaacggcucauaccuaaacgaaacccacuucucagacgauaucgaacaacaagccgacaacaugauaacugagaugcuccagaaagaguacauggaacgacaaggcaaaacaccccuaggccucguugaccucuucgucuucuccaccuccuucuaccuaaucuccaucuuccuccaccuagucaaaauccccacccaccgccacaucguuggaaaaagcuguccaaagccccaccgccucaaccacaugggcaucugcucaugcggccucuacaaacaacccggcguccccguccgcuggaaacgauaa

SEQ ID NO: 3173 - RNA, 1476 nt, Artificial Sequence
  derived and/or modified CDS sequence (opt11) from Lassa virus__AIT17828__GPC
augggccaaaucgucaccuucuuccaagaggucccccacguuaucgaagaaguaaugaacaucguccucauagcccucuccauccucgcuguccucaaaggccuauacaacuucgccacaugcggccucgucggccuaguaaccuuccuccuccucugcggccgcuccugcaccaccucacucuacaaaggcgauuaugaacuccaaacccucgaacucaacauggaaacacuaaacaugacaaugccccuaucgugcaccaaaaacaacucacaccacuacaucaugguaggcaaugagaccgggcucgaacucacccucacuaacaccucgaucaucaaccacaaauucugcaaccucucagacgcccacaagaaaaaccucuacgaccacgcccugauguccaucaucuccacauuccaccucuccauccccaacuucaaccaauacgaagcaauguccugcgacuucaacggugguaaaaucucuguacaauacaaccuaucucacuccuacgccggcgacgccgccaaccacugcggcacaguagccaacggcguccuccaaacauucaugcgcauggcuuggggcggcuccuacauagcccucgacuccggacgcggcaacugggacugcaucaugaccuccuaccaauaucucaucauccaaaacaccacaugggaagaccacugccaauucucacggcccuccccaauaggcuaccucggacuccucucccagcgaacccgagacaucuacaucagccgccgacuccuaggcaccuucaccuggacccucuccgacucagaaggcaaagacacacccggcggcuacugccuaaccagauggaugcucaucgaggccgaacuaaaauguuucggaaacaccgcuguagcaaaaugcaacgaaaaacacgacgaagaguucugcgacaugcuucgucuauucgacuucaacaaacaagccauccagcgucucaaagccgaagcucaaauguccauccaacucaucaacaaagccguaaacgcccucauaaacgaccaacucauaaugaaaaaccaccuccgcgacaucaugggcauccccuacugcaacuacagcaaguacugguaccuaaaccacaccaccaccggaaaaacaucccuaccaaaaugcuggcuaguauccaacggauccuaccuaaacgaaacccacuucucggacgacaucgaacaacaagcugacaacaugaucacagaaaugcuccaaaaagaauacauggaacgacaaggcaaaacaccgcucggccuagucgaccucuucgucuucagcacuuccuucuaccuaaucuccaucuuccuccaccucgucaaaauccccacacaccgccacauagucggaaaaagcugcccaaaaccccaccgccucaaccacaugggcauaugcucaugcggacucuacaaacaacccggcguccccguuaaguggaaaagauaa

SEQ ID NO: 3174 - RNA, 1473 nt, Artificial Sequence
  derived and/or modified CDS sequence (opt11) from Lassa virus__AIT17836__GPC
augggccaaaucauaaccuucuuccaagaagucccccacgucaucgaagaggucaugaacauaguccuaauagcccuaagccuccucgccauacuaaaaggcuuauacaacaucgccacaugcggcauuaucggacucgucgccuuccucuuccuaugcggcaaaagcugcucccuaacccucaaaggaggauacgaacuucaaacccucgaacuaaacauggaaacccuaaacaugacaaugccccucagcugcaccaaaaacuccucccaccacuacauccgcgucggaaacgaaacaggacuagaacuaacccucacaaacaccuccaucauaaaccacaaauucugcaaccucuccgacgcacacaagaaaaaccuauaugaccacgcccuaaugagcaucauauccacuuuccaccucuccauaccaaacuucaaccaauacgaagccauguccugcgacuucaacggcggaaaaaucuccguccaauacaaccugucccacuccuacgccggagacgcggccgagcacugcggcacagucgccaauggaguccugcaaacauucaugcgcauggcauggggcggccguuacaucgcccucgauuccgguaaaggaaacugggacugcauaaugacauccuaccaauaccucaucauccaaaacaccacaugggaagaccacugccaauucucccgcccgucaccaaucggcuaccucggccuccucucccaacgcacccgggacauauacaucagccgcagacuccucggaaccuucaccuggacacucagcgacuccgaaggcaacgaaacccccggcggcuacugccucacucguuggaugcucaucgaggccgaacucaaaugcuucggaaacaccgccguagccaaaugcaacgaaaaacacgacgaagaguucugcgacaugcuccgacuauucgacuucaacaaacaagcaauccgacgccucaaagccgaagcccagauguccauucaacucaucaacaaagccgucaacgcccucaucaacgaccaacuuaucaugaaaaaucaccuccgcgacaucaugggaauccccuauugcaacuacucaaaauacugguaccugaaccacaccucuuccggccgaacuucccuacccaaaugcuggcuaauauccaacggcaguuaccucaacgaaacccaauucagcgaugacauugaacaacaagcagacaacaugaucacagaaaugcuccaaaaagaauacaucgaacgccaaggaaaaaccccacucggccucgucgacaucuucauauucuccaccucauuuuaccucaucuccaucuuccuccaccuaaucaaaauccccacccaccgacacaucgucggaaaacccugcccaaaaccccaccgccuaaaccacaugggcgucugcuccugcggccucuacaaacaccccggcguacccaccaaauggaaacgcuag

SEQ ID NO: 3175 - RNA, 1476 nt, Artificial Sequence
  derived and/or modified CDS sequence (opt11) from Lassa virus__AIT17840__GPC
augggacaaauaguaaccuucuuccaggaagucccgcacgucaucgaggaagucaugaauaucguccucaucgcccuauccauccucgccguccuaaaaggccucuauaacuucgccaccuguggacuuguaggacucguaacauuccuccuccucugcggccgcuccugcacuaucucgcucuacaaaggcgucuacgaacuccaaacccucgaacucaacauggaaacccucaacaugaccaugccccucucaugcaccaaaaacaacucccaccacuacaucauggucggcaacgagacgggucucgaacucacacuuaccaacaccucaaucaucaaccauaaguucugcaaccucucugaugcccacaaaaagaaccuauacgaccacgcacuaaugucaaucaucuccaccuuccaccucucaauucccaacuucaaucaauacgaagccauguccugcgacuucaauggcggaaaaaucagcguacaauacaaccuaucacacuccuacgcaggggacgccgcgaaccacugcggcaccgucgcaaacggcguucuccaaacauucaugcgcauggcauggggaggcucauacaucgcgcucgacagcggccgagaccgcugggauugcaucaugacauccuaccaguaccuaaucauacaaaacaccaccugggaagaccacugccaauucucucgccccuccccaaucggcuaccuaggacuccucucccaaagaacacgcgacauauauaucucccgccgacuccucggcaccuucacauggacccucuccgacuccgaaggaaaagacaccccaggcggcuacugccucaccagauggaugcugaucgaagccgaacuaaaaugcuucggaaacacagccgucgccaaaugcaacgaaaaacacgacgaagaguucugcgacaugcuacgccuuuuugacuucaacaaacaagccauucaacgccucaaggccgaagcucaaauguccauccagcucaucaacaaagccguuaacgcccugauaaacgaccaacucaucaugaaaaaucaccuccgugacauaaugggaaucccauacugcaacuacuccaaauacugguaccuaaaccacaccacaaccggcaaaaccucacuccccaaaugcuggcucgucucaaacggcuccuaccuaaacgaaacccacuucagugacgacauagaacagcaagccgacaacaugaucacggaaaugcuccaaaaagaguacauggaacgacaaggcaaaaccccacuuggccuugucgaccuauucgucuucucuaccuccuucuaccucauaucaaucuuucuccaccucgucaaaauccccacccaccgccacauagucggcaaaccaugccccaaaccucaccgccuuaaccacaugggcaucugcucaugcggccucuacaagcagccaggcgucccagucaaauggaaacgauag

SEQ ID NO: 3176 - RNA, 1476 nt, Artificial Sequence
  derived and/or modified CDS sequence (opt11) from Lassa virus__AIT17844__GPC
augggccaaaucguaaccuucuuccaagaggucccacacgucaucgaggaagucaugaacauaguccucauagcccucucgauccuagcaguacuaaaaggucucuauaacuucgcuaccugcggccucguaggccucgucaccuuccuccuccucugcggccgcuccugcaccaucucccucuacaaaggcgucuaugaacuccaaacacuagagcugaacauggaaacccucaauaugaccaugccccucuccugcaccaaaaacaacucccaccacuacauaauggucggcaacgaaaccggacucgaacucacacuaaccaacaccuccauaaucaaccacaaauucugcaaccuaucugacgcacacaagaaaaaccucuacgaccacgcccuaauguccaucaucuccacuuuccaccucagcaucccuaacuucaaccaguacgaagccauguccugcgacuucaacggaggcaaaauaucaguacaauacaaccucucacacagcuaugccggcgacgcagccaaccacugcggaaccguagcuaacggcguccuccaaacauucaugcgcauggccuggggaggauccuauaucgcccucgacagcggccgcgaucgcugggacugcauaaugaccucauaccaauaccucauaauacaaaacaccaccugggaggaccacugccaauucucacgcccuucccccaucgguuaccuaggccuccuuucccaaagaacccgcgacaucuacaucuccaggcgccuccucggaacuuucaccuggacccuuagcgacucagaaggcaaagacacgcccggaggcuacugccuuacccgcuggaugcucauugaagcggaacucaaaugcuucggaaacaccgccgucgccaaaugcaaugaaaaacacgacgaagaguucugcgacaugcuccgacuauuugacuucaacaaacaagccauccagcgccuuaaagccgaagcccaaauguccauccaacucaucaaccgcgccguaaacgcucugaucaacgaccaacucaucaugaaaaaccaccuccgcgacaucaugggcauccccuacugcaacuacuccaaauauugguaccugaaccacaccaccacaggaaaaaccuccuuacccaaaugcuggcucgucuccaacggcuccuaccuuaacgaaacacacuucuccgaugacaucgaacaacaagcagacaacaugaucaccgaaaugcuccaaaaagaauauauggaacgccaggguaaaacuccccuaggccucgucgaccuauuugucuucuccaccuccuucuaucuuaucuccaucuuucuacaccucgucaaaauccccacccaccgccacaucgucggcaaaccuugcccgaaaccccaccgccucaaccacaugggcaucugcucauguggccucuauaaacagcccggcguccccgucaaauggaaaagauaa

SEQ ID NO: 3177 - RNA, 1473 nt, Artificial Sequence
  derived and/or modified CDS sequence (opt11) from Lassa virus__AMR44577__GPC
augggccaaaucaucaccuucuuccaagaggucccccacgucaucgaagaaguaaugaauauaguccucaucgcccucagccuacucgccauccucaaaggugucuacaacgucgcaacuugcggaaucaucggccuaguaacauuucuguuccucugcggccgauccugcucccuaaucuacaaagggagcuacgaacuccaaacccuugaacucaacauggaaacccuuaacaugaccaugccccuauccugcaccaagaacuccucccaccacuacauacgcguuggcaacgaaaccggacucgaauuaacccugaccaacacaucaaucaucaaccauaaauucugcaaccuuuccgaugcccacaaacgaaaccucuacgaccacgcccuaauguccauacuauccaccuuccaccucucaauaccaaacuucaaccaauacgaagccauguccugcgacuucaacggcggcaaaaucucaguacaauacaaccuaucccacgcauacgcagucgacgcggcagagcacugcggcaccguagccaacggcguccuccaaacauucaugcgcauggccuggggaggcucauacauagccuuagacuccggccgcggcaacugggacugcaucaugacauccuaccaauacuuaauaauccaaaacaccaccugggaagaccacugccaauuuucacgucccagcccaaucggcuaucuuggccuccucagccaacgcaccagagacauauacaucucccgacgccuccucggcaccuucacauggacccucucagacuccgaaggcaacgaaacgcccggcggcuacugccucacccgcuggaugcucauagaagccgaacucaaaugcuucggcaacacagccgucgccaaaugcaacgaaaaacacgacgaggaguucugcgacaugcuccgccuuuucgauuucaacaaacaagcaauccaacgccucaaauccgaagcccaaauguccauacaacucaucaacaaagccgucaacgcucucaucaacgaccaacuuauaaugaaaaaccaccuacgcgacaugaugggcaucccuuacugcaauuacuccaaauacugguaccucaaccacaccagcucaggacgcaccucacuccccaaaugcuggcucguuuccaacggcuccuaccucaacgaaacccauuucuccgacgacauagaacaacaagccgacaacaugaucaccgagaugcuccaaaaagaauacauagaccgacaaggaaaaacuccccucggccuuguagaccucuucgucuucuccaccuccuucuaccucaucucuaucuuccuccaucuuauaaaaauccccacacaccgccacauagucggaaaacccugccccaaaccccaccgccucaaccacaugggaaucugcagcugcggccucuacaaacaacccggaguacccacccgauggaaacgcuga

SEQ ID NO: 3178 - RNA, 1476 nt, Artificial Sequence
  derived and/or modified CDS sequence (opt11) from Lassa virus__ANH09722__GPC
augggacaaaucgucaccuucuuccaagaagucccccacgucauagaggaaguaaugaacauaguacucaucgcacuuagcauacuagccguccucaaaggacuuuacaacgucgcaaccugcggacuaauaggccuugucacauuccuacuucugugcggccgcuccugcaccaccacccuuuacaaaggcguuuacgaacuccaagcgcucgaacucaacauggaaacccucaacaugacaaugccccuaucaugcaccaaaaacaacucacaccacuacauccgugucggcaacgaaaccggccucgaacucacacuaaccaacaccucccucaucaaccacaaauucugcaaccuuuccgacgcacacaagaaaaaccuuuacgaccacgccuuaaugagcauaauaucaaccuuccaccucuccauacccaacuucaaccaauacgaagccauguccugcgacuuuaacgacgguaaaaucuccguccaauacaaccucucacacaccuaugccggcgacaccgccaaccacugcggcacugucgccaacggaguccuccaaacauucaugcgcauggcauggggcggcuccuacaucgcccucgacagcggacgaggaggcugggacugcaucaugacauccuaccaauaccuaauaauucaaaacacaaccugggaagaucacugccaauucucucgcccuucacccaucggcuaccucggccuacucucacaacgcacccgagacaucuacauuagccgccgacuccucggcaccuucaccuggacacuaucugacuccgaaggcaaagacacacccggcggauacugccuuacccgcuggaugcucauagaagccgaacucaaaugcuucggcaacacagcuguugccaaaugcaacgaaaaacacgacgaagaguucugcgacaugcucagacucuucgacuucaacaaacaagcuauccaacgacuaaaagcagaagcccaaaugucaauucaacuuaucaacaaagcaguaaacgcccuaaucaacgaccagcuaauaaugaagaaccaccuucgagacaucaugggcauccccuacuguaacuacuccaaauacugguaucuuaaccacaccgucaccggcaaaaccucucuaccaaaaugcuggcuagucuccaauggcuccuaccucaacgaaacacacuucagcgacgacaucgaacaacaagccgacaauaugaucaccgaaaugcugcaaaaggaauacauggagcgacaaggcaaaacaccccucggccucgucgaccucuucguauucuccaccuccuucuaccucaucucaaucuuccuccaccucgucaagauccccacccaccggcacgucgucggaaaacccugcccaaaaccccaccgccucaaccacaugggcaucugcucuugcggcuucuacaaacagcccggcguacccguccgcuggaaaagguaa

SEQ ID NO: 3179 - RNA, 1476 nt, Artificial Sequence
  derived and/or modified CDS sequence (opt11) from Lassa virus__ANH09724__GPC
augggccaaauagucaccuucuuccaagaagucccccacguaaucgaagaaguaaugaacaucguccucaucgcccuguccauccuagcuguccucaaaggccuauacaacgucgccacuugcggccucauuggccucguaaccuuccugcuccucugcggaagaucaugcacuacaacucucuacaaaggcgucuacgaacuacaagcacuggaacucaacauggaaacccucaacaugaccaugccccucuccuguacaaagaacgacucccaccacuacaucaugguaggaaaugaaaccggccucgaacucacccugaccaacaccucaauaauaucacacaaauucugcaaccucuccgacgcccacaaacaaaaccucuacgaccacgcacuaaugucaauaaucucaaccuuccacuuaagcauccccaacuucaaccaauacgaagccauguccugugacuucaacggcgguaaaaucuccguacaauacaaccucucccacaccuacgcaggcgacgccgcaaaccacugcggcaccgucgccaauggcguccuucaaacauucaugagaauggcauggggaggcagcuacauagcacucgacaguggccgcggcggcugggacugcaucaugaccagcuaccaguaccugaucauacaaaacaccacuugggaagaccacugccaauucagccgacccucacccaucggauaccuaggccugcucucacaaagaacccgcgauauuuacaucagccgccgccuacuaggaaccuucacauggacccuuagcgacagcgagggcaaagacacccccggcggauacugccucacccgauggaugcucauugaagccgaacuaaaaugcuucggaaacaccgccgucgccaaaugcaacgaaaaacacgacgaagaguucugcgacaugcuccgccuauucgacuucaacaaacaagccauccagcgccucaaagccgaagcacaaauguccauccaacucaucaacaaagcagucaacgcucuaaucaacgaccaacuaaucaugaagaaccaccuccgugacaucaugggcauacccuacugcaacuacuccaaauacugguaccucaaccacaccgucaccggcaaaacaucccuccccaagugcuggcuaguauccaacggcucuuaccuaaacgaaacccacuucucggacgacaucgaacaacaagccgacaacaugaucaccgaaaugcuccaaaaagaauacauggaacgccaaggcaaaacuccccucggucucgucgaccucuucgucuucuccaccaguuucuaccucaucucaauauuucuccaccucgucaaaaucccaacacaccgacacgucgucggaaaacccugccccaagccccaucgacucaaccacaugggcaucugcucaugcggcuucuacggccaacccggcguccccguccgauggaaacgauaa

SEQ ID NO: 3180 - RNA, 1476 nt, Artificial Sequence
  derived and/or modified CDS sequence (opt11) from Lassa virus__ANH09728__GPC
augggccaaauagucaccuucuuccaagaagucccccacguaaucgaagaaguuaugaacaucguccucaucgcccucuccguacucgccguccucaaaggacuauacaaugucgcgaccugcggccucaucggacucguuaccuuccuccucuuaugcggccgcuccugcacaaccacccucuacaaaggcgucuacgaacuccaagcccucgaacucaacaugggcacccucaacaugaccaugccacucuccugcacuaagaacaacucacaccacuacauaauggugggcaaugaaaccgggcucgaacugacacucacaaauacuuccaucaucaaccacaaguucugcaaucucucggacgcacacaagaaagaccucuacgaucacgcacucauguccaucaucucaacuuuccaccucuccguacccaacuucaaccaauaugaagcaauguccugcgacuucaacggcgggaaaauaagcguccaauacaaccucucccacgccuacgccggagauaccgccaaucacugcggaaccgucgcaaauggcguacuacaaaccuucaugcguauggccuggggaggcuccuacauagcucucgacuccgggcgcggcggcugggacugcaucaugaccuccuaccaauaccucaucauccaaaacaccacuugggaggaccacugccaauucucccgccccucaccaaucggauaccucggccuacucucgcagcgcacgagagacauauacauaucccgccgacuacuaggcaccuucaccuggacccucuccgacagcgaaggcgaauacacccccggcggauacugccucacccgcuggaugcuaaucgaagcugaacuaaaaugcuucggcaacaccgccgucgccaaaugcaaugaaaagcacgacgaagaguucugcgacauguugcggcuauucgacuucaacaaacaagcaauccaacgccucaaagccgaagcccaaaugucuauccagcucaucaacaaagccgucaacgcccucauaaacgaucaacucauaaugaaaaaccaccuccgagacaucaugggaaucccauacugcaacuacuccaaguauugguaccuaaaccacaccguaacaggaaaaaccucacucccaaaaugcuggcucgucuccaauggcuccuaccuuaacgaaacccacuucucggaugacaucgaacagcaagccgacaacaugaucacagaaaugcuccaaaaagaauacauggaacgacaaggaaaaacgccccugggccuggucgaccuauucgucuucuccaccagcuucuaccucauaucuaucuuccuccaccucgucaaaauacccacacaucgccacgucgucggcaaacccugcccaaaaccccaccgccucaaccacaugggcauaugcuccugcggcuucuacaaacaacccggcguccccgucagauggaaacgcuaa

SEQ ID NO: 3181 - RNA, 1476 nt, Artificial Sequence
  derived and/or modified CDS sequence (opt11) from Lassa virus__ANH09730__GPC
augggucaaauagucaccuucuuccaagaagucccccacgucaucgaagagguuaugaacaucguccucaucgcacucuccguccuagcgguccucaagggccuuuacaacguagcaaccugcggccuaauaggccucguaaccuuccuacuacucugcggccgcuccugcacaaccacccuauacaaaggcguauacgaacuccaagcccuagaacucaacauggagacccuuaacaugaccaugccacuaucaugcaccaaaaauaacucccaccacuacaucauggucggaaacgaaaccggccuagagcucacccuaaccaacaccuccaucauaaaccacaaauucugcaaccuaucugacgcccacaagaaaaaccucuacgaccacgcccuuauguccaucauuucgaccuuccaccuuuccauccccaacuucaaccaguaugaagccauguccugcgacuucaaccaaggcaaaaucagcguccaauacaaccucucacacgccuaugccggagacgccgccaaccacuguggcaccgucgccaacggcguacuccaaaccuucaugcgaauggccuggggcggcagcuauaucgcccucgacagcggacgcggcggcugggacugcauaaugaccuccuaccaauaccucauaauccaaaacacaaccugggaaaaccacugccaauucucccgccccagccccaucggcuaccuuggccuccucucccaacgcaccagggacaucuacaucucccgucgccuccucggcaccuuuaccuggacacucuccgacuccgaaggcaagggcaccccaggaggcuacugccucacccgcuggaugcucaucgaagccgaacucaaaugcuucggaaacacagccgucgcaaaaugcaacgaaaaacacgacgaggaguucugcgacaugcuacgacucuuugacuucaacaaacaagccauacaacguuucaaagccgaagcccaaaugucaauacaacuaaucaauaaagccgucaacgcacucauaaacgaccaacucauaaugaaaaaccaccuuagagacaucaugggcauccccuacugcaacuacucaaaauacugguaccucaaccacaccgucaccggcaaaacaucccucccuaaaugcuggcucgucucaaacggauccuaccucaacgaaacacacuucucagacgacaucgaacaacaagccgacaacaugaucaccgaaaugcuccaaaaagaauacauggaacgccaaggacgcacuccccucggccuagucgaucucuucgucuucagcaccuccuucuaccucaucuccaucuuucuccaccucguaaaaauccccacccaccgacacgucguaggcaaacccugccccaaaccacaccgacuaaaccacaugggcaucugcuccugcggguucuacaaacaacccggcgucccgguccgauggaaacgcuag

SEQ ID NO: 3182 - RNA, 1476 nt, Artificial Sequence
  derived and/or modified CDS sequence (opt11) from Lassa virus__ANH09732__GPC
auggggcaaaucgucaccuucuuccaagaagucccccacgucauagaggaaguaaugaacauaguccuaaucgcccucuccauccuagccguccucaaaggcgucuacaacguagcaaccugcggacuaauaggccucgucaccuuccucuuacuuuccggccgauccugcaccaccaccaucuauaaaggcgucuacgaacuacaagcccucgagcucaacauggaaacccuuaacaugacuaugccccucucaugcaccaaaaacaauagccaccacuacaucauggucggcaacgaaaccggccuagagcucacccucacaaacaccagcauaaucaaccacaaauucugcaaccuauccgacgcccacaagaaaaaccuauacgaccacgcccucaugagcaucauauccaccuuccaccuaagcauccccaacuucaaccaauacgaagccauguccugcgacuucaacggcggcaaaauauccguacaauauaaccucucacacaccuacgccggagacgcugccaaccacugcggcaccguagccaauggcguucuccaaaccuucaugcgcauggccuggggcggcagcuacaucgcccucgacuccggccacggaggcugggacugcaucaugaccuccuaccaauaccuaaucauacaaaacacgacuugggagaaccacugucaguucucacgcccaucccccaucggauaccucggccuccuaucacaacgaaccagagacaucuacaucagccggcgccuacuugguacauucaccuggacccuaagcgacucagaagggaaagacacacccggcggauacugccuuacccgcuggaugcuaaucgaagccgaacucaaauguuucggcaacaccgcagucgcaaaaugcaacgaaaaacacgacgaagaguucugcgacaugcuccgccucuucgacuucaacaaacaagccauccaacgccucaaagcagaagcccaaauguccauacaacucaucaacaaggcugucaacgcccucaucaacgaccaacuaauuaugaaaaaccaccucagagacaucaugggcauaccauacugcaacuacagcaaauacugguaccucaaccacaccgucaccggcaaaaccagccuccccaaaugcuggcuggucucaaacggcucauaccucaacgagacucacuucucagacgacaucgaacaacaagcagacaacaugaucaccgaaaugcuccaaaaagaauacauggaacgacaaggcaaaacaccccuaggccucguagaccuauucgucuucuccaccagcuucuaccuaaucucaaucuuccuccaccucguuaaaauccccacccaccgccacaucgucggaaaacccugcccaaaaccacaccgccucaaccacaugggaauaugcuccugcggguucuacaaacagccaggagucccaguccgcuggaaaagguaa

SEQ ID NO: 3183 - RNA, 1473 nt, Artificial Sequence
  derived and/or modified CDS sequence (opt11) from Lassa virus__ANH09738__GPC
augggccaaauaguaacauuuuuccaagaagucccccacgucaucgaagaaauaaugaacaucguccucaucacccugucucuccuagccauccucaagggucucuacaacuucgcgaccugcggccuuaucggccucaucacuuuccucuuccugugcggccgauccugcagcaugauuuacaaaggauccuaccaacuagaaacgcucgaacucaacauggaaacccucaacaugaccaugccacuauccuguaccaaaaacaacucccaccacuacauccgcgucggcaaugaaaccggccucgaauuaacacucaccaacaccuccaucauaaaccacaaauucugcaaccuuuccgacgcccacaaacgcaaccucuacgaccacucccucaugucaaucaucucaaccuuccaccuuuccaucccaaacuucaaccaauacgaagccauguccugcgacuucaacggaggcaaaauaucgauccaauacaaccucucccacaccuacgccggcgacgcagcuaaacacugcggcaccgucgccaacggcguccuccaaaccuucaugcguauggcauggggcggcucauacaucgcccuagacucaggccgaggaaacugggacugcaucaugaccagcuaccaauaccuaaucauccaaaacaccaccugggaagaccacugccaauucucccgccccucccccaucggcuaccucggacuccucucacaacgcacccgcgacauauacauuucccgccggcuacuaggaacauucaccuggacccucuccgacucagaaggcaaagaaacccccggcggcuacugccucacacgcuggaugcucaucgaagccgaacucaaaugcuucggcaacaccgccgucgcaaaaugcaacgaaaaacacgacgaagaguucugcgauaugcuccgccucuucgacuucaacaaacaagccauccaacgucucaaaaccgaagcccaaaugucaauccaacucauuaacaaagccgucaacgcucuaauaaacgaccaacucauaaugaaaaaccaucugcgcgacaucaugggcauucccuacugcaacuacuccaaauacugguaccuuaaccacaccuccaccggccgcaccucccucccgaaguguuggcucguauccaacggauccuaccuuaacgaaacucacuucuccgaugacaucgaacaacaggcagauaacaugauaaccgaaaugcuucaaaaagaauacaucgaccgacaaggcaaaacuccccucggccucgucgauguauucauguucucuaccucauuuuaccuuauauccaucuuccuccaccuugucaaaauccccacccaccgccacaucgucggcaaauccugccccaaaccacaccgccucaaccacaugggcaucugcuccugcggacucuacaagcagccaggcguucccguccgcuggaagcgcuaa

SEQ ID NO: 3184 - RNA, 1473 nt, Artificial Sequence
  derived and/or modified CDS sequence (opt11) from Lassa virus__ANH09740__GPC
augggccaaaucgucacauucuuccaagaagucccccacguaaucgaagaagucaugaacaucguccucaucgcccucucccuccuagccauccucaaaggccuauacaacuucgccacaugcgguguaauaggccugauaaccuuccuacuccuaugcggccgcuccugcuccgccaccuacaagggacaauaugaacuccaaacccuagaacucaacauggaaucacucaacaugaccaugccacuaucaugcaccaaaaacaacagccaccacuacauccgcgcuggaaacaacaccggccuggaacucacccuaacaaacacaagcaucauuucgcacaaauucugcaaccucucagaugcccacaaaaagaaccuauacgaccacacccuuauguccaucauaaccaccuuccaccucucaauccccaacuucaaccaauacgaagcgaugucuugcgacuucaacggcggcaaaaucucaauccaauacaaccucucccacuccuacgcuggcgacgccgcacaacacuguggaacagucgccaacggcguacuacaaacauucaugcgaauggccuggggcggcuccuaucuugcccuugacuccggacguagaggcugggacugcaucaucucauccuaccaauaccuuaucauacaaaacaccaccugggacgaccacugccaauucucccgacccucccccaucggcuaucucggcuucguuagccagaaaacccgugacauauacaucucccgcagacuccuaggcaccuucaccuggacccuauccgacucggaaggccacgacaugccuggcgguuacugccucacacgcuggaugcucaucgaggccgaccucaaaugcuucggcaacaccgcagucgccaaaugcaacgagaaacacgacgaagaguucugcgacauguggcgacucuucgacuucaacaaacaagccauacaacgccucaaagccgaagcccaaaugaacauucaacuaauaaacaaagccgucaacgcacucaucaacgaccaacuaaugaugaaaaaccaccuccgcgauauuaugggcaucccauacugcaacuacaguaaauuuugguaccucaacaacaccaccacaggccggaccucccuccccagaugcuggcuaauauccaacgggucuuaccucaacgaaacccauuucucagacgacaucgaacaacaagcagauaauaugauaaccgaaaugcuccaaaaagaauacauggaccgccaaggcaaaacuccccucgggcuuguggaccucuuugucuucuccaccuccuucuaccucaucaccauauuccuucaccucgucaagauacccacacaccgacacaucguaggcaaaccaugccccaaaccgcaccgccucaaccacaugggcaucugcucaugcggacucuacaaacaacccggcguccccguccgcuggaaacgcuaa

SEQ ID NO: 3185 - RNA, 1473 nt, Artificial Sequence
  derived and/or modified CDS sequence (opt11) from Lassa virus__CAA36645__GPC
augggccaaaucgucaccuucuuccaagaaguaccccacguaaucgaagaaguaaugaacaucguacuaauagcccuguccauacuugcaauccucaaaggccucuacaacguagcaaccugcggccucaucgggcucgucacauuccuccuacuguccggccgcagcugcucacucaucuauaaaggcaccuacgaacuccaaacacuagaacucaacauggaaacauuaaacaugaccaugccccuaucuugcaccaaaaacaacucccaccauuacauccgcgucggcaacgaaaccggccuagaacuaacacucaccaacaccuccauucucaaccacaaguucugcaaccucagcgacgcccacaaaagaaaccuauacgaccacucccucaugucaaucaucuccacauuccaccucuccauccccaacuucaaccaguacgaagccauguccugcgacuucaacggcggaaaaaucaccguacaauacaaccucucacacuccuucgcagucgacgccgcaggccacugcggaacccuagcaaacggcguccuccagaccuucaugcgaauggccuggggcggcucguacaucgcacucgacuccggccguggcaacugggacugcaucaugaccucauaccaguaccugaucauacaaaacaccacaugggacgaccacugucaauucucccgccccucacccaucggauacuuaggccuccugucacaaagaacccgcgacaucuacaucuccagacgacuucucggcacuuucaccuggacccucucagacucagaaggaaacgaaacccccgggggcuacugccucacacgauggaugcuaaucgaagccgaacucaaaugcuucggaaacaccgccguagccaaaugcaacgaaaaacacgacgaagaguucugcgacaugcuccgccucuucgacuucaacaagcaagccauccgccgccucaaaaccgaagcccagaugucaauucaacucaucaacaaagccguaaacgcacucaucaaugaccaacugaucaugaagaaccaccuaagagacaucaugggaauccccuacugcaacuacucccgauacugguaccucaaccacaccuccaccggaaaaaccucccugccccgaugcuggcucaucagcaacggcuccuaccugaacgaaaccaaguucuccgacgacaucgaacagcaagcagacaacaugaucaccgaaaugcuccaaaaagaauacaucgaccgucagggcaaaaccccucucggccuuguagaccucuucgucuucucaaccuccuucuaccucauaucaauauuccuacaccucguaaaaaucccuacccaccgacacaucguaggcaaacccugccccaaaccacaccgccuaaaccacaugggcaucuguuccuguggacuauacaaacaacccggcguucccgucagauggaaacguuaa

SEQ ID NO: 3186 - RNA, 1476 nt, Artificial Sequence
  derived and/or modified CDS sequence (opt11) from Lassa virus__NP_694870__GPC
augggccaaauagucaccuucuuccaagaagucccccacguaaucgaagaaguaaugaacaucguccucaucgcacucucaguccucgccguccucaaaggccucuacaacuuugccacaugcggccuagucggacucgucaccuuccuccuccuuugcggccgcuccugcacuaccagccuuuacaaaggcgucuacgaacuccaaacccuugaacucaacauggagacccucaacaugaccaugcccuuauccugcaccaaaaacaacucacaccacuacauaauggucggcaacgaaaccggcuuagaacuaacccucaccaacaccuccauaaucaaccacaaauucugcaaccucagcgacgcccacaagaaaaaccuauacgaccacgcccucaugucaaucauauccaccuuccaccucucuauacccaacuucaaccaauacgaagcaauguccugcgacuucaacggcgguaaaauauccguucaauacaaccugucucacuccuacgccggcgacgccgccaaccacuguggcaccgucgcuaacggcguacuacaaacauucaugcgaauggccuggggcggcagcuacaucgcccucgacucagggagaggaaacugggacugcaucaugaccucuuaccaauaccucaucauacaaaacaccaccugggaagaccacugccaauucagccgaccaucccccaucggcuaccuaggccuacuaucacaacguacccgcgacaucuauauaagccgccgccuacucggcaccuucaccuggacacucuccgacuccgaagguaaagacacccccggaggcuacugccuaacccgcuggaugcuaaucgaagccgaacuuaaaugcuucggcaacaccgcggucgccaaaugcaacgaaaagcacgacgaagaguucugcgacaugcucaggcucuuugacuucaacaaacaagccauccaacgccucaaagcagaagcccaaauguccauccaacucauaaacaaagccgucaaugcccucauuaacgaccaacucauuaugaaaaaccaccuacgagacaucauggguauccccuacugcaacuacagcaaauacugguaccucaaccauacaacuaccggccgcacuagccugcccaagugcuggcucguauccaauggcuccuaccucaacgaaacccacuucuccgacgacauugaacaacaagccgacaacaugaucaccgaaaugcuucaaaaggaauacauggaacggcaaggaaaaacuccccucggccucgucgaccucuucgucuucagcacauccuucuaccucauauccaucuuccuccaccuagucaaaauccccacacacagacacauagucggaaaauccugccccaaaccccacagacucaaccacaugggcaucuguuccugcggucucuacaaacaaccuggcguacccgucaaauggaagcgcuaa

SEQ ID NO: 3187 - RNA, 1713 nt, Artificial Sequence
  derived and/or modified CDS sequence (opt11) from Lassa virus__AAA46284__NP
augagcgccagcaaagaaguccgcuccugccuguggacacaaucccuccggagagaacuuucaggguacugcucaaacaucaaacuacaagucguaaaggacgcccaagcccuucuccacggccucgacuucucagaggucagcaacguacaacgccucaugagaaaacagaagcgcgacgacggcgaccucaaaagacuccgcgaucucaaccaagcagucaacaaucuagucgaacucaagagcacacaacaaaaaucagugcugcgagucggcacacucucauccgacgaccuccuaauccucgccgcagaccucgaaaaacucaaaucgaaaguaacccggacagagcgcccacuuuccagcggagucuacaugggcaaccugagcucacaacaacucgaccaacgacgcgcacuacugaacaugaucggaaugacgggcguguccggcggcggcaaaggagcaucaaacggaaucgugcgcguaugggauguuaagaacgcagaacuacucaacaaccaauucggcaccaugcccucccucacccucgcaugccuuaccaaacaaggccaaguggacuugaacgacgcaguacaagcgcucaccgaccucgggcuaaucuacaccgccaaauaccccaacuccucagaccuagaccgccuaucccaaucacaccccauacuaaacaugaucgauaccaagaagucaagccucaacauauccggcuacaacuucucccucggggcagccgucaaagcaggcgcaugcaugcuagacggcggcaacaugcuagaaacaaucaaaguaagcccccagaccauggacggaauccuaaaaucgauccucaaagucaagaaaucuuuaggcauguucguauccgacacccccggcgaacgcaaccccuacgaaaacauccuauacaaaaucugcuuaucaggcgacggcuggagcuacaucgccagcagaaccuccauagucggcagagccugggagaacacaguagucgaccuagaacaagacaacaaaccacagaaaauaggcaacggaggcagcaacaaaucgcuccaaagcgcaggguucgccgcaggccuaaucuacagccaacuaaugacacuaaaagacuuuaaaugcuucaaccucaucccaaacgccaagaccuggauggacaucgaagggcgcccagaagacccagucgaaaucgcacucuaucaacccagcagcggaugcuacguccacuucuuccgcgaacccacagaccugaaacaauucaaacaagacgccaaauacucgcacggacgagacgucaccgaccuauucgccgcacaacccggacucaccagcgcagucauagaagcacucccgcgcaauaugguaaucaccugucaaggcucugaagacauccgaaaacuccucgaaucccagggacgccgcgauaucaaacuaaucgacaucacacucuccaaagccgacagccgaaaauucgaaaacgccguaugggaccaauucaaagaccucugccauaugcacacuggcguggucgucgagaaaaagaaacgaggaggaaaagaggagaucacaccccacugcgcccucauggacugcaucauguucgacgccgcagucucuggaggacucgaugccaaaguacuccgaguaguccucccacgagacauggucuuccgcaccagcacacccaaagucgugcucuaa

SEQ ID NO: 3188 - RNA, 1710 nt, Artificial Sequence
  derived and/or modified CDS sequence (opt11) from Lassa virus__AAF86704__NP
augucagccucaaaagaagucaaauccuuccuuuggacccaaagccugcgccgcgagcuaagcggcuacugcagcaacaucaaacuccaggucgucaaggacgcccaagcucuccuacacggccuagacuucagcgaagucaacaacguacaacgcuuaaugcgcaaacaaaagcgcgacgacggagaccucaaacgccuacgagaccugaaccaagcuguuaacaaccucguagaacucaaauccacccaacaaaagagcauccugcgcgucgguacccuaacgucagacgaucuccuaacccuagccgccgaccucgaaaaacucaaaucaaaagugauccgaaccgagcgaccacucucgagcggcgucuacaugggaaaccucucaacccaacagcucgaacaacgacgugcccuccugaacaugauaggaauggucggcggcgcucaaggcacacagccgggccgcgacggcguaguccgcgucugggacgucaaaaacccagaccuucucaacaaccaauucggcaccaugcccucauuaacucucgcgugccucaccaaacaaggccaaguagaccucaacgaugccguccucgcacucaccgaccucggacucaucuacaccgcaaaauaucccaacucaucagaccuggaccgacucucacaaucacaccccauacucaacauggucgauaccaagaaaucaucccucaacaucuccggauacaacuucagccucggagccgccgucaaagccggagcaugcaugcucgacggaggaaacaugcuagagaccaucaaagucacuccucaaaccauggacggcauacucaaaucuauacugaaagucaaaagaagccucggcauguucguaucagacacacccggcgaacgaaaucccuacgagaacauccuguacaaaaucugccuauccggcgacggauggcccuacaucgccucccgcacauccaucguaggacgagcaugggaaaacaccaccguagaccuagaauccgacgguaaaccccaaaaaguaggaaccgcagggucgaacaaaucacuacaauccgcgggcuucccaacuggacucaccuacucccaacucaugacccuaaaagacuccaugaugcaacucgauccaagcgccaaaaccuggauagacauagaaggacgccccgaagaccccgucgaaauagcccucuaccaacccaugucaggaugcuacauacacuucuuccgcgaacccacagaccuaaaacaguucaaacaagacgcaaaauauucacaugggaucgacgucgccgaccuauuccccgcacaacccggccuuaccucugcgguaaucgaagcccuccccagaaacaugguacuaaccugccaaggaagcgacgauauaaagaaacuccuagacagccaaggccgaagagacaucaaacuuaucgacaucucccucaguaaagucgacucccggaaauucgagaacgccguuugggaccaaugcaaagaccucugccacaugcacaccggaguagucguagagaaaaagaaacgaggaggaaaagaagaaaucacaccacacugcgcccucauggacugcauaauguucgacgcggccgucuccggcggccucaacauacccguccuccgcgcugucuuaccucgcgauaugguauuccggacauccagccccaaagucguccucuaa

SEQ ID NO: 3189 - RNA, 1710 nt, Artificial Sequence
  derived and/or modified CDS sequence (opt11) from Lassa virus__AAO59513__NP
augucagccagcaaagaagucaaaucauuccuauggacccaaucacuacgccgagagcuauccggcuacuguuccaacaucaaacuacaggucguaaaagacgcccaagcacuucuucacggacuagacuucuccgaaguaucaaauguccaaaggcuuaugcgaaaagaaagacgugacgauuccgaccucaaacgccucagagaccucaaucaggccguaaacaaccuaguagaacuaaaaucaacacaacaaaaauccguccuacgaguaggcacccucaccucagacgaccuacucguccuagccgccgaccucgagaaacuccgcuccaaaguaacccgcacagaacgcccccuguccgccggcguguacaugggcaaccucuccucucaacaacucgaccaacgccgcgcacuccuauccaugauagggaugaauggauccaaucagggcgcccgggcaggacgcgacggcgucgucagagucugggacgucaaaaacgcagaacuccucaacaaccaauucggcaccaugcccucccuaacccuagccugccucaccaaacaaggccaagucgaccuaaacgacgccguacaagcccugaccgaccucggccuaauauacaccgcaaaauacccaaacaccagcgaccucgauagacucacccaaagccaccccauacuaaacaugauugacaccaagaaaucaucgcucaacgucuccggguacaacuucagccucggagccgccgugaaagccggugcaugcaugcuagacggaggaaacaugcuggaaacaauaaaagucagcccccaaaccauggacggcauccucaaaagcauacuaaaagucaaaaaggcacuagggauguucaucuccgacacccccggcgaacgaaacccguacgaaaacauccuauacaaaaucugccucagcggggacggguggcccuacaucgccagccgcaccucaaucacaggccgcgcaugggaaaacaccgucgucgaccucgaauccgacgaaaagccccaaaaagccggcaguaacaauucaaauaaaucccuccaauccgccggcuucaccgccggccucacauauucccaacuaaugacccuaaaagacgccaugcuccaacucgacccaaacgccaagacauggauggacaucgaaggaagaccagaagacccagucgaaauagcccucuaccaaccgucaucaggaugcuacauccacuucuuucgcgaaccaacagaccucaaacaauucaaacaagaugccaaauacagccacggaaucgacaucacggaucucuucgccgcccaaccaggccuaaccucagccgugaucgacgcccuacccagaaacaugguaaucacgugccaaggcagcgacgacauacggaagcuacuagaaucccaaggcagaaaggacaucaaacucauagacauagcccucaacaaagccgacucccgaaaauacgagaacgccgucugggaccaauacaaagaccucugccauaugcacacuggcgucguagucgaaaagaaaaagcgaggcggaaaagaagaaaucacaccccacugcgcccucauggacugcaucauguucgacgccgccgucuccggcggacucaagacccuaguacucagggcaguccuaccccgcgacaugguauuccgaaccuccacuccccgcgucguccucuaa

SEQ ID NO: 3190 - RNA, 1710 nt, Artificial Sequence
  derived and/or modified CDS sequence (opt11) from Lassa virus__AAT48999__NP
augagcgucagcaaagaaauaaaaucauuccuauggacccagucacuccgccgagaacuauccggcuacugcuccaacauaaaacuccaaguagucaaagacgcacaagcccuacuccacggccuagacuucagcgaagucuccaacguccagcgccuaaugcgcaaacaacgaagggacgauaacgaccuaaaaagacuacgagaccuaaaucaggccgucaacaaccucgucgaacuaaaaagcacgcaacaaaaauccguccugcgaguaggcacccuaacgagcgaugaccugcuaauacucgccgcagaccuagaaaaacuaaaaucaaaagucacaagaaccgaacgcccccugucagccggcgucuacauggggaaccuaagcucacaacagcucgaccaacgacgagcccuccuaaacaugaucggcaugagcggaggcaaccaaggagcccaaaccgggcgggacggagucgugcgaaucugggacgucaaaaacgccgaacugcuaaacaaccaauucggcaccaugcccucacuaacgcucgcgugccugacaaaacaagggcaaguagaccucaacgacgucguacaagcccuaaccgaccuaggccugauauauacagccaaauacccaaauaccagcgaccuagacagacuaacacaaucacacccaauacuaaauaugauagacaccaagaaaucaucacuaaacauaagcggcuacaacuucucacucggcgccgcaguaaaagccggcgccugcaugcuagacggaggaaauauguuagaaaccaucaaaguauccccacaaaccauggacggcauacuaaaaucaauacugaaaguaaagaaagcccucggcauguucauuuccgacacgccgggagaacgcaacccauacgaaaacauccucuacaaaaucugccuaagcggcgacggcuggcccuacaucgccuccagaaccagcaucaccggccgcgccugggaaaacaccgucgucgaucucgagagcggcgaaaaaccccagaaaauaggguccaacaacagcaacaaaugccuccaaucugcaggcuucaccgcaggucugagcuacagccaacucaugacccuaaaagacgcaaugcuccaacuagacccaaaugccaaaaccuggauggacaucgaaggccgacccgaagacccagucgaaaucgcccuauaccaaccgagcucagggugcuacauacauuucuuccgcgaaccaacagaccucaaacaauucaaacaagacgccaaauacagccacggaaucgacgugaccgacuuauucgccgcccaacccggacuaacauccgcagucaucgaagcccuuccccgcaacauggucaugaccugccagggcucagacgacauacgcaaacuccuagaaagccaaggacgcaaagacaucaaacuaaucgacaucgcccucuccaaaacggacucacgaaaauacgaaaacgccgucugggaccaguauaaagaccuuugccacaugcacaccggcgugguugucgagaaaaagaagaaaggcggcaaagaagaaauaacaccccacugcgcacuuauggacugcaucauguuugacgccgccguaagcggcggccugaacacaagcguacuccgagcuguccucccacgcgauauggucuuccgaaccucaacuccuaaaguuguccuuuaa

SEQ ID NO: 3191 - RNA, 1710 nt, Artificial Sequence
  derived and/or modified CDS sequence (opt11) from Lassa virus__AAT49007__NP
augucagucucaaaagaaaucaaaucauuccuauggacacagucccuaagacgagaacuguccggcuacugcagcaacauuaaacuacaaguagucaaagacgcacaagcccuacuccacggccuagacuucagcgaaguaagcaacguccaacgccuaaugcgcaaacaacggcgcgacgacaacgaccuaaaacgcuugcgcgaccucaaccaggccguaaacaaucuagucgaacucaagucaacacaacaaaaauccguccuacgagucggcacccucaccucggacgaccugcugauccuagcagcugaccuggaaaaacuuaaaagcaaagugacacgaaccgaaagaccacuauccgccggcaucuacaugggaaaccucucaucccaacagcucgaccaacgacgcgcucuccucaacaugaucgggaugucaggcggaaaccaaggagcacaaaccggccgcgacggcguaguccgcauaugggacgucaaaaaugccgaacuacucaacaaccaauuuggcaccaugcccucccucacccucgcaugccucaccaagcaaggccaagucgaccucaacgacgugguccaagcccuaacagaccucggacucauauacaccgccaaauaucccaacacguccgaccuagaccgacuaacccaaucccaccccauccuaaacaugaucgacaccaagaaaagcucccucaacaucuccggcuacaacuucucacuaggugcagccgucaaagcaggagccugcaugcuagacggcggcaacaugcucgaaaccaucaaagugucuccgcaaacaauggacggaauccuuaaaagcauacucaaaguuaagaaagcucuaggcauguucauuucagacacccccggcgaacgcaacccauacgaaaacauccucuacaaaaucugucuauccggagacggguggcccuauauagccucacgaaccuccauaaccggacgagccugggaaaacaccguagucgaccuagaaucaggcgaaaaaccacagaaaauaggaagcaacaacagcaauaaaucccuccaauccgccggcuucaccgccggccugacguacucacaacuaaugacccuaaaagaugcaaugcuccaacuagacccaaacgccaaaacauggauggacaucgaaggccgcccagaagacccugucgaaauagcccucuaccaaccuucaagcggaugcuacauccacuucuucagagaacccaccgaccucaaacaauucaaacaagacgccaaauauucccacgggaucgacgucacagaccuauucgcagcacaaccaggacuuaccagcgccgucaucgaggcccuaccacgcaacaugguaaugacaugccaaggcagcgaugacaucaggaaacuccucgaaucccaggguaggaaagacaucaaacuaaucgauaucgcccuauccaaaaccgacagcagaaaauacgaaaacgccguaugggaccaauacaaagaccuaugccacaugcacacaggcguuguaguggaaaagaaaaagaaaggaggaaaagaagagaucacaccacacugcgcccucauggacugcauaauguucgacgccgcugccucaggcggacuaaacacacucguacugcgugcaguacucccucgcgacaugguauuccgcaccucaacccccaaagucguccucuaa

SEQ ID NO: 3192 - RNA, 1710 nt, Artificial Sequence
  derived and/or modified CDS sequence (opt11) from Lassa virus__AAT49009__NP
augagcgcauccaaagaagucaaaucauuccucuggacccaaucucuccgccgcgaacucagcggguacugcagcaacauaaaacuccaggucguaaaagacgcccaagcccuacuacacggccuagacuucucugaaguuuccaacguacaaagacucaugagaaaacaacgccgagacgacggcgaccuuaaacgccuuagagaucucaaccaggccgucaacaaccucgucgaacucaaauccacucagcaaaaaucaguccuacgcgucggcacacucaauucagacgaccuacucgugcucgcagccgaccucgaaaaacucaaauccaaaguaaucaggaccgaaaggccacucuccucaggaaucuacaugggaaaccucucaucacaacaacucgaucaacgccgggcacuccuuaacaugauaggcaugaccggcgggaaccgcggcggaggcacuagcuccgacggcaucguacgagucugggacgucaaaaacgccgaauugcuuaacaaccaauucggcacaaugccaucacuaacccucgcaugccuaacuaaacaaggccaaguggaccucaacgacgccguccaagcccuaaccgaccuuggccucaucuacacagccaaauaccccaacuccucagaccucgaccgacuagcacaaucccacccaauccucaacaugauagacaccaagaaauccucccucaacauaagcgguuauaacuucucccuaggugcagccgucaaagccggagccugcaugcucgacggcggcaacaugcucgaaaccaucaaagucucuccucaaacuaucgacggcauacuaaaaacaauccuaaaagucaagaaaagccucgguauguucaucuccgacguacccggcgagcgcaacccauacgaaaacauccuauacaaaauaugccuaagcggcgacggcuggcccuacauagcaucccgcaccucaaucgucggcagagccugggaaaacaccguaguagacuuagagagcgauaacaaaccccagaaaacaggaaacggagguuccaacaaaucccuccaaagcgcaggcuuugccgcaggccucaccuacagccaacuaaugacacucaaagacucaaugcuacaacucgaccccaacagcaaaaccuggauggacaucgaaggcaggcccgaagaccccgucgaaaucgcacucuaccaacccaacucaggaugcuacauccacuucuuccgagaacccaccgaucucaaacaauucaaacaagacgcgaaauacucccacggaauagacgucacagaccuauucgccgcacaaccgggacucaccuccgcagucaucgaggcccuaccaagaaacaugguaauuaccugccaagggucagaagacauccgcaaacuccuagaaucccaaggccgacgggacaucaaacuaaucgacaucagucuaaacaaagcagacucccguaaauucgagaacgccguaugggaccaauucaaagaccuaugccacaugcacacaggcgucgucgucgaaaagaagaaacgaggcggcaaagaagaaaucacaccacacugcgcccugauggacugcauaauguucgacgcagcagucagcgguggccuagaugccaaaguccuccgcgcaguccugccacgagacaugguauuccgaacaucaacucccaaagucguacuguaa

SEQ ID NO: 3193 - RNA, 1710 nt, Artificial Sequence
  derived and/or modified CDS sequence (opt11) from Lassa virus__ADI39452__NP
augagcgucagcaaagaagucaaauccuuccucuggacccaaucccuccggcgcgaauuaucaggcuacugcucaaacauaaaacuacaagucgucaaagacgcacaagcacuccuacacggccuagacuucucagaagucaguaacguccaacgcuuaaugcgaaaacagcgucgcgacgacaacgaucucaaacgccuacgcgaccuaaaccaagcugucaacaaccucguggaacuaaaaucaacccaacaaaaguccgugcuccgcguaggaacccuaaccuccgacgaccuccucauccuagccgcagaccucgaaaaacucaaaaccaaagugacgcgcaccgaaagaccccucuccgccggcgucuacaugggaaaccucagcucacaacaacuagaacaaagacgagcacuacuaaacaugaucggcaugaacggaggcaaccaaggcguacaagcaggccgcgacggagucgugcgcguaugggaugugaaaaacgccgaacugcucaacaaccaauucggcaccaugcccagccucacccuagcgugccuaaccaaacaaggacaagucgaccucaacgaugccguacaagcacuaacggaccucggccuaaucuacacagccaaauaccccaacacaucagaccucgaccgccuugcccaaucccacccaauccuaaacaugauagacaccaagaaaaguucauuaaacauaucaggauacaacuucucccucggggccgcaguaaaagccggagcaugcaugcuagacggcggcaacaugcucgaaaccauaaaagucucaccccaaaccauggacggaauccucaaaucaauccuaaaagucaaacgcacacugggcauguucgugucggacaccccuggagaacgaaacccguacgaaaacauccucuacaaaauaugccuauccggcgauggauggcccuacauagcgagcaggaccucaaucaccggccgagccugggagaacaccauaguugaccuagaaagcgacggcaaaccccaaaaagugggaaacaacggaagcaacaaaagccuccagucagccggcuucacagcuggccucaccuacagccagcuaaugacccucaaagacgccaugcuccaacuugacccaaacgccaaaacauggauggauaucgaaggccgccccgaagaccccguagaaguagcccucuaucaaccaagcuccggcugcuacauucacuucuuccgcgaaccaaccgaccucaaacaauucaaacaagacgcaaaauacagccacggaauagacgugaccgaccucuucgcagcgcaaccaggccucaccuccgccguaaucgaagcccuaccaagaaacauggucauaaccugccaaggaagcgaggacguccgaaagcuacuagaaagccaaggccgcaaagacaucaaacuaaucgacaucgcccuaagcaaagcggacucccgaaaauacgaaaacgccgucugggaucaauacaaggaccuaugccacaugcacacgggcgucgucgucgagaaaaagaaacgcggaggcaaagaagaaaugacaccccacugcgcccuaauggacuguaucauguucgacgccgccguaagcggcggacuaagcacccaagucuuaagagcaguccucccaagggacaugguauucaggaccuccaccccaaaagucguacucuga

SEQ ID NO: 3194 - RNA, 1710 nt, Artificial Sequence
  derived and/or modified CDS sequence (opt11) from Lassa virus__ADU56611__NP
auguccgcuuccaaagaagucaaauccuucuuauggacccaaucccugcgcagagaacucuccggcuacugcuccaacaucaaacuccaaguaguaaaagacgcccaagcacuccuccacggccuagauuucuccgaagucagcaauguacaacgacucaugcgcaaacaaaagagagacgacggugaccucaaaagacuccgcgaucucaaccaagccgucaacaaccuagucgaacuaaaaagcacccaacaaaagucaguacuacgcgucgggacccuaaccuccgacgaccuccuaacccucgcagccgaucucgaaaaacugaaauccaaagucaucagaaccgagcgcccccucucauccggcguauacaugggaaaccuuagcacccagcaauuagaacaacgaaaagcccuacucagcaugaucggaaugguuggcggagcccaaggaacacagccgggacgagacggaguaguaagaguaugggacgucaaaaaccccgaccuucucaacaaccaauuuggaacaaugccaucccuaacccuagccugccuaacaaaacaaggacaaguagaccugaacgacgcaguccucgcacuaacggaccucggccuaauauacaccgcaaaauacccuaacagcuccgaccuagaucgccugucccaaagccacccaauacucaacauggucgacaccaagaaauccucucucaacaucagcggcuacaacuucucacuaggcgcagcaguaaaagcaggcgcaugcaugcucgacggcggcaacaugcuagaaaccaucaaagucacuccccaaaccauggaugggauccuaaaaagcauacucaaaguuaaacgcucacucggaauguucgucagcgacacccccggcgaacgcaaccccuaugaaaacauccucuacaaaaucugccucuccggcgacggcuggcccuacaucgcgucccgaaccucaaucgucggccgcgccugggaaaacacgacagucgaccucgaauccgacggcaaaccgcaaaaaguaggcaccgccggauccaacaaaucacuacaaucagcaggcuuccccacgggucuaaccuacucacaacuaaugacccucaaagacuccaugaugcagcucgacccauccgccaagaccuggauagacaucgaaggccgacccgaagaccccgucgaaaucgcccucuaccaacccauguccggcugcuacauacacuucuuccgcgaacccacagaccucaaacaauucaaacaagacgccaaauacagccacggcaucgacgucacagaccuuuucucagcccaaccaggccucacauccgcagucaucgaagcccucccucgcaacaugguccuaaccugccaaggcagcgacgacaucaagaaacuccuagacucacaaggacgaagggacauuaaacuaaucgacaucucccucaacaaagccgacucacgaagauucgaaaacgccguaugggaccagugcaaagaccucugccacaugcacaccggagucgucguggagaaaaagaaacgcggcggcaaagaagaaaucacgccccacugugcccucauggacugcaucauguucgacgcagccgucucaggcggccucaacauccccauccuccgagccguucucccccgcgacauggucuuccgcaccuccagcccaaaagugguccucuaa

SEQ ID NO: 3195 - RNA, 1710 nt, Artificial Sequence
  derived and/or modified CDS sequence (opt11) from Lassa virus__ADU56615__NP
augucugccuccaaagaaguaaaauccuuccuauggacccagucccuccgccgcgaacucucaggauacugcucaaauaucaaacuacaaguagucaaagacgcacaagcccuacuucacggccuagacuucucagaaguuaguaacguacaacgacucaugcgaaaacagaaacgggacgacagugaccuuaaaaggcucagagaccucaaccaagccguaaacaaccucgucgaacucaaaucaacccaacagaaaagcguccuccguauuggaacccugagcagcgacgaccuccuaauccuagccgccgaccucgagaaacuaaaaucuaaaguaguacggaccgaacgcccccucucuagcggcaucuacaugggcaaccucuccucgcaacaacucgaccaacgcaaagcccuacuaaauaugaucggcaugacaggaggcaacggcggcagaaacgcaacaagugacggcaucguacgaguaugggacgucaaaaacgcagaacuccuaaacaaccaauucggcaccaugcccucacucacccucgccugccucacaaaacaaggccaggucgaccuaaacgaugcaguacaagcucucacagaccucggccuaauauacacagcaaaauaccccaacuccuccgaccucgaccgccucgcccaaucacacccaauccucaacaugaucgacaccaagaaauccagccucaacauauccggcuacaauuucucccucggcgccgccgucaaagcaggcgccugcaugcuagacggcggaaacaugcuugaaacaaucaaaguaucgccccaaacaauggacggcauccucaaaucaauacucaaagucaaacgaucccuaggaauguucauaagcgacacccccggggaacgaaaccccuacgaaaacauccucuacaaaauaugccuaagcggagauggcuggcccuacauagcaagcagaacaucaauagucggccgagcaugggaaaacacagucguagaccuagaaacggacaacaaaccacagaaaaccggaaacggcggauccaacaaaucacuccaaagcgccggcuucgcagcgggccuaaccuacagccaacuaaugacccuaaaagacucaaugcuccaacuugacccgaacgcgaaaaccuggauggacauagaagggcgccccgaagacccagucgaaaucgcccuauaccaacccguaagcggauguuacauccacuucuuccgcgagcccaccgaccucaaacaauuuaaacaagacgcaaaauauucacacggcaucgacguaacagaccuauucgcggcccaacccggccuaacaagcgccguaaucgaagcacuuccccgcaauauggucauaaccugccagggaagcgaagacauccgcaaacuccucgaaucacaaggccgccgcgacaucaaacugaucgacaucagccucucaaaaguagacucacgaaaauucgaaaacgccgucugggaccaauucaaggaccugugccacaugcacaccggcauaguugucgagaaaaagaaacgaggcgguaaagaagaaauaacuccccacugcgcccucauggacugcaucauguucgacgcagccgucuccggaggcguagacgcaaaaguccuccgcgcaguccugccccgagacaugguauuucgcaccuccacaccgaaagugguacuauaa

SEQ ID NO: 3196 - RNA, 1710 nt, Artificial Sequence
  derived and/or modified CDS sequence (opt11) from Lassa virus__ADU56619__NP
augagcgccucaaaagaagugaaaucauuccucuggacccaaucacucagacgcgaacuaucaggauacugcucgaacauaaaacuacaaguagucaaagacgcacaagcccuccuacacggacucgacuucuccgaagucagcaacguccaaagacuuaugcgaaaacaaaaacgcgacgacggugaccuaaaacgccuacgcgaccuaaaccaagcagugaacaaucucguagaacucaaauccacccaacagaaaagcgugcuacgcguaggaacucucuccuccgaugaccugcucguacucgccgcagaccuagaaaaacucaaaucaaaagucguccgaacagaaagaccacuuagcucaggaaucuacaugggaaaccucagcucccaacaacuagaccaacgcaaagcccuccuaaacaugaucgguaugaccggaggcaacggcggacgaaacaccaccucagacggaauaguccgcgucugggacgucaaaaacgcagaacuccuaaacaaccaauucggcaccaugcccucccuaacccucgcgugccuaaccaaacaaggccagguugaccugaacgacgccguccaagcgcucaccgaccuaggacuaaucuacacagcaaaauauccaaacuccucagaccuagaccgacuagcacaaucgcacccuauacuaaacaugauagacacaaagaaauccucccuaaacauaagcggauacaacuucucccuaggcgccgcggucaaagccggcgcaugcaugcuugacggcggcaacaugcucgaaaccauuaaagucucuccacaaaccauggacgggauauuaaaaagcauccucaaagucaaacgcagucuaggcauguucaucagcgacacaccaggcgagcguaaucccuacgaaaacauccuauacaaaauaugccucuccggggacggcuggcccuacaucgcuucaaggaccucuauagucggacgcgccugggaaaacaccguaguagaccucgaaagcgauaacaaaccccagaaaacuggcaauggcgggucaaauaaaucccuccaauccgccggcuucgccgcaggccucaccuacagccaacuuaugacccugaaagacagcaugcuccaacucgaccccaacgccaaaaccuggauggacaucgaaggucgccccgaggacccgguggagaucgcccuauaccaaccaagcagcggaugcuacauacacuucuucagagagccuacagaccuaaaacaauucaaacaagacgcaaaauacagccacggcauagacgucacagaccuauucgccgcccaaccgggccuaacaucagcagucaucgaagcccugccccgaaacauggucaucaccugucaaggcagcgaagacauacgaaaacuccuggaaucacaaggacgcagagacaucaaacugauagauaucucacuaagcaaaguagacucaagaaaauucgagaacgcaguaugggaccaauucaaagaccucugccacaugcacaccgguaucgucguggaaaagaagaaacggggcggaaaagaagaaauaacuccccacugcgcccucauggacugcauaauguucgacgcagccgucuccggcggcgucgacgcaaaaguacucagagccguacucccccgugacaugguuuuccgaaccuccacccccaaaguaguacucuaa

SEQ ID NO: 3197 - RNA, 1710 nt, Artificial Sequence
  derived and/or modified CDS sequence (opt11) from Lassa virus__ADU56623__NP
auguccgccuccaaagaagucaaauccuuccuuuggacccaaucacuccgacgcgaacucucaggauacugcucaaacaucaaacuacaagucguaaaagacgcgcaggcccuccuccacggccucgacuucucagaggucagcaacguccaaagacuuaugcgaaaacagaaaagggacgacucagaccucaaacgccuaagggaccucaaucaagcagucaacaaccucgucgaacucaaaagcacccaacaaaaaucaauacuccgagucggaacacuaaccucagacgaccuccucacucuagcugccgaucuagaaaaacuuaaauccaaagucauucgaaccgaacgaccacucuccucgggcgucuacaugggaaaccuauccacccaacaacucgaacaaagacgagcacuccucaaccuaauaggcaugguugguggcgcacaaggcacacaaccuggacgcgacggagucguccgcgucugggacgucaaaaaucccgaccuacuaaacaaccaauucggaaccaugccuucccucacccucgcuugccucaccaaacaaggucaaguagaccucaacgacgccguacucgcucucaccgaccucggccucauauacacagccaaauacccgaacuccuccgaccuggaccgccucucccaaucccaccccaucuuaaacaugguagacaccaagaaaucaucccuaaacauaagcggauucaacuucucucuaggagccgccguaaaagcaggagcauguaugcuagacggcggaaacaugcucgaaaccaucaaagucacaccacaaaccauggacggaauccucaaaucgauccucaaagucaagaaaucccucggaauguucgucucagauaccccaggcgagcggaaccccuacgaaaacauacuauacaaaaucugucucuccggcgacggguggccuuauaucgcaucccgaacaagcaucgucggucgcgcaugggaaaacacaaccguagaccucgaauccgacggaaaaccgcacaaaguaggcacagcgggguccaacaaaagccuucaguccgccggauucccaaccggccucaccuacucccaacuaaugacccucaaagacucaaugaugcaacuggaccccuccgccaagaccuggaucgacaucgaaggccgcccagaagacccaguggagauagcccuauaccaaccaaugagcggcuguuacauccacuucuucagggaaccaaccgaccuaaaacaauucaaacaagacgcgaaauacucgcacggcaucgacgucgcagaccucuuccccgcccaacccggccucacauccgccguuaucgaagcccucccccgcaacaugguacuaaccugccaaggcagcgacgacaucaaacgacuacucgacucccaaggccgacgagacaucaaacuaaucgacaucgcgcucucgaaagccgacucucgccgcuucgaaaacgcagucugggaccaaugcaaagaucucugccacaugcacaccggcguagucgucgaaaagaagaaacgcggcggcaaagaagaaaucaccccucacugcgcacucauggacugcaucauguacgacgccgcgguaagcggcggccuuaacauaccuguccuucgagccguacuccccagagacaugguauucagaacaucauccccaaaagucguacucuaa

SEQ ID NO: 3198 - RNA, 1710 nt, Artificial Sequence
  derived and/or modified CDS sequence (opt11) from Lassa virus__ADU56627__NP
auguccgccucaaaagaagucaaaucauuccuuuggacccagucacuuagaagagaacucucuggguacugcuccaacauaaaacuccaggucguaaaagacgcacaagcccuccuccacggacucgacuucucagaaguaagcaacguccaacgacucaugcgcaaacaaaaacgcgacgacucagaccucaaacgacuccgggaccucaaccaggccgucaacaaccuggucgaacucaaauccacccaacaaaaguccauccuccgagucggcacccuaaccucagaugaccuccuuacacuagccgcagaccucgaaaaacuuaagucaaaaguaauacgaaccgaacgaccccuauccucuggcguauacaugggcaaccuuaacacacaacagcucgaacaaaggcgcgcacuccuaaauaugaucggaauggccgguggcgcccaaggcacacaacccggacgagacggcgucguaagaguaugggacgucaagaaccccgaccuucucaacaaccaauucggaacaaugcccucccucacccuugcaugccucacaaaacaaggacaagucgaccucaacgacgccguccucgcccuaaccgaccuaggccucaucuacaccgccaaauaccccaacucauccgaccuagacagacuuagccaaucccaccccauccucaacauggucgacaccaagaaauccucccuuaacauauccggauacaacuucucacuuggagcggcaguaaaagccggagcgugcaugcucgacggcggaaacaugcuagagaccaucaaagucacaccccaaaccauggacggcauccugaaaucaauccucaaaguuaaaaagagcuuaggaauguucgucucagacaccccaggagaacgaaaccccuacgaaaacauacuauacaaaaucugccucuccggcgacggauggccauacaucgccucacgaaccucaauagucggacgcgcaugggaaaacaccacagucgaccucgagucagacggcaaaccacaaaaagucggcacagcaggcagcaacaaaucacuccaauccgccggcuuccccaccgggcuaacguacucccaacucaugacccucaaagacucaaugaugcaacucgacccuagcgcgaaaacuuggaucgacaucgaaggacggccagaagaccccgucgaaauagcccucuaccaaccaauguccggcugcuacauccacuucuuccgcgaacccaccgaccucaaacaauucaaacaagacgccaaauacucccacggcauugacgucgccgaccucuuccccgcacaacccggccucacauccgccgucaucgaagcccucccacgaaauaugguucuaaccugccagggcagcgacgacaucaaacgccuucucgacucucaaggucggcgcgacauuaagcuaaucgauaucgcacucuccaaagcugacuccagacgcuucgaaaacgcggucugggaucaaugcaaagaccucugccauaugcacaccggaguaguagucgagaaaaagaaacgcggcggaaaagaagaaaucacaccccacugugcgcuaauggacugcaucauguacgacgccgccgucucuggcggccuaaacaucccaguccuccgcgcaguccuaccccgcgauauggucuuccgcaccagcucccccaaagucguccuauaa

SEQ ID NO: 3199 - RNA, 1710 nt, Artificial Sequence
  derived and/or modified CDS sequence (opt11) from Lassa virus__ADU56631__NP
auguccgcaagcaaagaaguaaaaucauuccuauggacacaaucacuccgccgcgaacugagcggcuacugcuccaacauaaaacuccaggucgucaaagacgcucaagcgcuccuccacggccuagacuucagugaagucagcaacguccaacggcucaugcgcaaacaaaaacgcgacgacuccgaccuaaaacgacucagagaccucaaccaagccguaaacaaccugguugaacugaaaaguacccaacaaaaauccauccuaagaguaggaacccuaaccucagacgaccuccuuacccuugcggcugaccuugaaaaacuaaaaucaaaaguaauccgcacggagcgcccacucuccucuggugucuacauggguaaccucucaacacaacaacucgaacaacgcagagcccuccuaaacaugaucggcauggucggcggcgcacaaggaacucaaccuggacgcgacggcgucgucagagucugggacgugaaaaacccagaccuccucaacaaccaauucggaaccaugccgucccucacccuggcaugccucacaaaacaaggccaggucgaccuaaacgacgcaguccucgcccuaacggaccucggccucauauacaccgcgaaauaccccaacuccuccgaccucgacagacucucacaaucccacccaauccucaacaugguagacaccaagaaauccucacucaacaucuccggcuacaacuucucacuaggcgcagccgucaaagccggcgccuguaugcucgacggaggaaacaugcucgaaaccauaaaaguuacaccccaaaccauggacggcauccucaaaucaauccucaaagucaagaaaucacuaggcauguucguauccgacaccccaggcgaaagaaaccccuaugaaaacauacucuacaaaaucugccuauccggcgacggauggcccuacaucgcaucucggaccuccaucgucggccgcgcgugggaaaacacgacaguagaccucgaauccgacggcaaaccccaaaaagucggcacagccggaagcaacaaaucccuccaauccgccggauuccccaccggccuuaccuacucucaacucaugacacucaaagacuccaugaugcaacucgauccauccgcaaaaaccuggaucgacauugaaggacgcccggaagacccggucgaaaucgcccuauaccaaccaaugagcggcugcuacauacacuucuuccgagaacccacagaccucaaacaguucaaacaagacgccaaauacagccacggcaucgacgucaccgaccuauucccugcacaacccggccucaccucagccguuaucgaagcacuaccccgaaacaugguacugaccugccaaggcuccgaugacaucaaacgccuccucgacucccaaggccgacgagacaucaaacucaucgacaucgcccucuccaaagccgacucgcgacgcuucgaaaaugccgucugggaucaaugcaaagaccucugccacaugcacaccggcguaguagucgagaaaaagaaacgcggcggaaaagaagaaauaacaccccacugcgcccuaauggacugcaucauguacgacgccgccgucuccggcggccucaacaucccaguacuccgcgccguccuaccaagagacauggucuuccgcaccucauccccaaaaguaguccucuaa

SEQ ID NO: 3200 - RNA, 1710 nt, Artificial Sequence
  derived and/or modified CDS sequence (opt11) from Lassa virus__AFY05580__NP
augucagcauccaaagaaauaaaaucauuccuauggacccagucacuccgacgcgaacucucuggauacugcucaaacaucaaacuccaaguagucaaagacgcgcaagcacuccuccacggccucgacuucagcgaagucagcaacgugcaacgccucaugaggaaagaacguagagacgacaacgaccuuaaacgacuacgcgaccuaaaccaagcaguaaacaaccucgucgaacucaaauccacccaacaaaaauccauccuccgcgucggaacccucaccuccgacgacuuacucauccucgccgccgaccuagaaaaacuacgcucaaaaguaauccgaaccgaacgcccccuuucagccggagucuacaugggaaaccucuccucccaacaacucgaccaacgccgcgcccuccuaaacaugaucggcauguccggaggaaaccaaggagcccgagcuggcagggacggagucguacgcgucugggacgucaaaaacgcagaacuccucucaaaccaauucggcaccauccccucccuaacacuagcaugccucaccaagcaaggucaggucgaccuaaacgacgcaguccaagcccucaccgaccucggccucauauacaccgccaaauaccccaacaccuccgaccuggaccgacuaacccaaucacaccccauccuaaacaugaucgacaccaagaaaagcagccuaaacauuucagguuauaauuucucacugggagcagcagugaaagccggcgcaugcaugcuagacgggggcaacaugcuagaaacgaucaaagucagcccccaaacaauggacgggauucuaaaaagcauccuaaaagucaagaaagcacuuggcauguucaucucagacacaccgggagagcgcaaccccuacgaaaauauccuauauaagaucugccuaucaggcgacggcuggcccuacaucgcaaguagaaccuccaucaccggacgagccugggaaaacaccgucgucgaccucgaauccggcggaaaaccccaaaaagccgacagcaauaacagcucaaaaucccuccaauccgccggauucaccgcuggguugacauacucccaacuaaugacccucaaagaugccaugcuccaacucgaccccaacgcaaagacauggauggacaucgaaggacgacccgaggaccccguagaaauugcacucuaccaacccucaucaggcugcuacauucacuucuuuagagaaccaacagaccucaaacaauucaaacaagacgccaaauacucacacggaauagacgucaccgaccuguucgccacccagccaggccuaacuucagccguaauagacgcccucccacgcaacaugguaaucacgugccaagggucagacgauauccgcaagcuccuagaaagccaaggccgcaaagacaucaaacuuauagacauugaccuaagcaagaccgacucaagaaaauacgaaaacgccguaugggaccaauacaaggaccuaugccacaugcauacaggcgucgucguggagaaaaagaagagaggcggaaaagaagaaauaacaccccacugcgcacuuauggauugcauaauguucgacgccgccguuucaggcggccucaacaccagcguccuccgcgccguccuaccccgcgacauggucuuccgaacauccacaccccgaguugugcucuaa

SEQ ID NO: 3201 - RNA, 1710 nt, Artificial Sequence
  derived and/or modified CDS sequence (opt11) from Lassa virus__AFY05581__NP
augucagccuccaaagaaauaaaauccuuccuauggacccaaucccuacgccgagaacucagcggcuauugcuccaacaucaaacuacagguugucaaagacgcccaagcccuacuccacggacucgacuucucugaaguauccaacguccagcggcuaaugcggaaagaacgcagagacgacaacgaccucaaacgucugcgcgacuuaaaccaagccgucaacaaccucgucgaacuuaaauccacacaacaaaaauccauccuccgcgucggaacacugacaucugacgaccugcuaauauuagcagccgaccucgaaaaacuuaaaucaaaagucauacgcaccgaacgaccccucuccgcaggggucuauaugggcaaccucaguucccagcaacucgaccaacgccgagcccuacucaacaugauaggcaugucaggaggaaaccaaggcgcccgagccggacgcgacggcgugguccgagucugggacgucaaaaacgccgaacuccuaucaaaccaauucggaaccauuccgucgcucacccucgccugccucaccaaacaaggccaaguagaccuuaacgacgcaguacaagcacuaacagaccuuggccuaauauauaccgccaaguacccaaacacauccgaccuggacagacucacacaaagccacccaauccucaacaugaucgacaccaagaaaagcagccucaauauauccggauacaacuucucacucggagccgccguaaaagcaggagcaugcaugcucgacggaggaaacaugcuagaaaccaucaaagucagcccccaaacaauggauggcauccucaaaucaauccucaaagucaagaaagcccuuggaauguucauauccgacacacccggcgaaagaaaccccuacgaaaacauacuguacaaaaucugccucucaggagacggauggcccuacaucgccagccggaccuccauaaccggccgcgccugggaaaacacagucgucgaccucgagucaggaggcaaaccccaaaaagccgacucaaacaacagcucaaaaucccuacaauccgcuggcuucacagcuggacuaacauacucccaacuaaugacccucaaagacgcuaugcuccaacucgacccaaaugccaaaacauggauggacauagagggcagacccgaagacccggucgaaaucgcgcucuaccaacccagcagcggaugcuacauucacuucuuccgcgaacccacagaccucaaacaauucaaacaggacgcaaaauacucccacggcaucgacguaacagaccucuucgccacacaaccaggacuuaccuccgccgucaucgacgcccuaccccgaaacauggucaucacuugccaaggcuccgacgacaucagaaagcuccuagaaucacaaggaagaaaagacaucaaacuaaucgacaucgaccucagcaaaacggacucaagaaaauacgaaaacgccgucugggaccaauacaaagaccuuugccacaugcacaccggcguagucgucgaaaagaagaaacgaggcggcaaagaggaaaucacaccccacugcgcacucauggacugcaucauguuugacgccgcagucuccggaggacucaacaccagcguccucaaagcaguccucccccgcgacauggucuuccguaccuccaccccacgagucguccucuaa

SEQ ID NO: 3202 - RNA, 1710 nt, Artificial Sequence
  derived and/or modified CDS sequence (opt11) from Lassa virus__AFY05587__NP
augagcgcguccaaagaaaucaaaucguucuuauggacccaaucacucagacgcgaacuaucgggcuacugcagcaacaucaaacuacagguggucaaagacgcccaagcucuacuacauggccucgacuucuccgaagucucaaauguccaacgccuaaugcgcaaagaaagacgcgacgacaacgaccucaaacgacuaagagaccuaaaccaggccgucaacaaccugguggaacucaaaagcacccaacaaaaauccauccuacgaguaggaacccucaccagcgacgaccugcucauacuagcagccgaccucgaaaaacuacgaucaaaaguaauccgaaccgaacgaccacucucagcaggaguguacaugggaaaccuaucaucccagcaacuagaccaacgccgagcccuccucaacaugaucgguaugucaggaggcaaccaaggcgcccgagccggacgagacggcguaguacgcguaugggacgucaaaaacgccgaacuauuauccaaccaauucggcacaaugcccucgcuaaccuuagccugccuuaccaaacaaggccaagucgaccucaacgacgccguacaagcccuaacagaccuaggccucaucuacaccgcgaaauaccccaacacaucagaccuugaccgacucacacaaagccaccccauacucaacaugaucgacacuaagaaauccagccugaacauaagcggcuacaacuucagccuaggcgccgcagucaaagccggcgccugcaugcucgacggcggcaacaugcucgaaacgaucaaagucaguccccaaaccauggacgguauacuaaaaagcauccuaaagguaaagaaagcccucggaauguucaucagcgauacccccggcgaacgcaaccccuacgaaaacauccucuacaaaauaugccucagcggagacggcuggccauacaucgcaucccgcaccucaauaaccgggcgagccugggaaaacaccgucgucgaccuagaaagcgacggcaaaccccagaaagccgacuccaacaacagcucaaaaucccuccaaucagcagguuucacagccggucucacauauagccaacuuaugacacuaaaagaugccaugcuccaacuggacccgaacgcaaaaaccuggauggacaucgaagggcgcccagaggaccccgucgagaucgcccuauaccagcccagcucaggcugcuacauccacuucuuccgcgagccaacggaccucaaacaauucaaacaagaugcaaaauacucacacggaaucgacgucacagaucucuucgcaacccagccaggccuaacauccgcaguuauagacgcccucccccgaaacauggucauaaccugccaaggcagcgaugacauccgcaaacuccuagaaagucagggccgcaaagacaucaagcucauagacauagaccugagcaaaaccgacucgcgcaaauacgagaacgcaguaugggaccaguacaaagaccucugccauaugcacaccggcgucgucguagaaaagaagaaacgcggcggcaaagaagaaaucaccccgcacugcgcgcuaauggacugcauaauguucgacgccgccgucucaggcggacuaaacaccucaguccucagagccguacuaccccgagacauggucuucaggacaucaacaccccgcgucguccucuaa

SEQ ID NO: 3203 - RNA, 1710 nt, Artificial Sequence
  derived and/or modified CDS sequence (opt11) from Lassa virus__AFY05591__NP
augucagccagcaaagaaauaaaaucguuccucuggacccaaucacugagaagagaacucucaggauacugcagcaacaucaaacuccaagucgucaaagacgcccaagcacuccuacacggccucgacuucucagaggucuccaacguccaacgccucaugcgcaaagaacgccgagacgacaacgaccucaaacgccuccgagaccucaaucaggcuguaaacaaccuagucgaacucaaaucaacccaacagaaaagcauccuaagagucggcacacuaaccagcgacgaccuccuaauccucgcagccgaccuggagaaacuaaaauccaaaguaauacgcaccgaacgcccacucucagcgggcguuuacaugggcaaccuauccucccaacagcucgaccaacgccgagcccuacugaacaugaucggaauguccggaggcaaccaaggcgcacgcgccggacgcgauggggucguccgcgucugggacgucaaaaacgucgaacuucucuccaaccaauucggcaccaugccaucucucacccuagccugccucaccaaacagggccaagucgaccucaacgacgccguccaagcccucaccgaccuaggccuuaucuacaccgccaaauacccaaacacaucagaccucgacagacuagcccagucucacccaauacucaacaugaucgacaccaagaaauccagccugaacauaucaggauacaacuucucacucggcgccgccguaaaagcaggagccugcaugcucgacggaggcaacaugcuagaaacgaucaaaguaucuccccaaacaauggacggcauccucaaauccauacucaaagugaagaaagcccucggaauguucauaagcgacacaccuggcgaacgaaacccauacgaaaacauacucuacaaaauaugccucuccggagacggcuggccauacauagcaucgcguacaucuauaacagguagagccugggaaaacacaguaguagaucucgagucagacggcaaaccacaaaaagcagacucaaacaacuccuccaaaucgcuacaauccgccggcuuuaccgccggacuaacauacucacaacucaugacccucaaagacgcaaugcuacagcuagacccaaacgcaaaaaccuggauggacaucgaaggacgccccgaagacccaguggaaaucgcccuauaucaacccagcuccggcugcuacauccacuucuuccgcgaacccacagaccuuaaacaauucaaacaggacgccaaauacagccacggcaucgacgucacagaccucuucgcuacccaacccggccucaccucagccgugaucgacgcacuaccccgcaacaugguaaucacaugccaaggcuccgacgacauccgaaaacuucucgaaucccaaggccggaaagacaucaaacuaauagacauagaccucuccaaaacagacucacguaaauacgaaaacgccgucugggaccaauacaaagaccucugccacaugcacaccgguguagucgucgaaaagaagaaaagaggaggcaaagaagaaauaacuccacacugcgcccuaauggacugcaucauguucgacgccgccguaagcgguggacugaacaccagcguccuaagggccguccucccccgagacauggucuuccgcaccucuacaccaagagucguccucuaa

SEQ ID NO: 3204 - RNA, 1710 nt, Artificial Sequence
  derived and/or modified CDS sequence (opt11) from Lassa virus__AFY05597__NP
augucagcaucuaaagaaauaaaauccuuccuauggacccaaagccuaagacgcgaacucuccggcuacugcucaaacauuaaacuucaaguagucaaagacgcccaggcacuucuacacggacuagauuucagcgaagucuccaauguccaaagacuaaugcgcaaagaacgccgcgacgacaacgaccucaaacgccuacgcgaccuaaaccaagccgucaauaacuuaguagaacuaaaaucaacccaacaaaaaucaauccuacgggucggcacccucacaucagacgaccuacucauccucgccgccgaccucgaaaaacuaaaaucaaaagugauccgcaccgaacgaccacuauccgccggaguauacaugggaaaccucagcagccaacaacuagaccaacgccgagcccuccucaacaugaucggaauguccggaggcaaccaaggcgcccgagccggccgcgacggaguaguacgcguaugggacgucaagaacgcagaacuccugucaaaccaauucggaaccaugcccucacuaacccuggcaugccuaaccaaacaaggccaaguagaccucaaugacgcgguacaagcccucacagaccucggccucaucuacaccgccaaauaccccaacacauccgaccuugaccgccuuacccaaucacaccccauccucaacaugaucgauacaaagaaaagcagccugaacaucagcggcuacaacuucucacucggggccgccgucaaagccggugccugcaugcucgacgggggcaacaugcuagaaaccaucaaagucucgccccaaacaauggacggcauacucaaaucaauucucaaagucaagaaagcccucggcauguucauaucugacacccccggagaaaggaaucccuacgaaaacauccuauacaaaaucugccuuuccggcgacggcuggccauacaucgccucgcgaaccucaaucacaggccgcgccugggaaaacacgguaguagaucucgaaagcgacggcaaaccccaaaaagccgacagcaacaacagcucuaaaucgcuccaauccgccggcuucaccgcaggcuugaccuacagccaacucaugacauugaaagacgccaugcuccaacucgaccccaacgccaaaacauggauggacaucgaaggaagaccagaggaucccgucgaaaucgcccucuaccaacccucauccggcugcuacauacacuucuucagagaaccaacagaccucaaacaauucaaacaagacgccaaauacucccacggcaucgacguaaccgaucuuuucgccacccaacccggacuaacaagcgcagucauagacgcccucccacgaaacauggucauaaccugccaaggaagcgacgacauccgaaaacuccuggaaagccagggucgcaaagacauaaaacucaucgacaucgaccuauccaaaaccgacucucgcaaauacgagaacgcaguaugggaccaauauaaagacuuaugccacaugcacaccggagucgucgucgagaagaagaaacguggaggcaaagaagaaaucacgccccacugcgcacugauggacugcaucauguucgacgccgcagucagcggcggacucaacacuagcguccuccgcgccguucucccacgcgacauggucuuccgaaccuccacaccccgaguaguccucuag

SEQ ID NO: 3205 - RNA, 1710 nt, Artificial Sequence
  derived and/or modified CDS sequence (opt11) from Lassa virus__AFY05610__NP
auguccgccucaaaagaaauaaaaucuuuccucuggacccagagcuuacgacgugaacucucgggcuacuguuccaacaucaaacuccaaguagucaaagacgcacaagcacuacuccacggccucgacuucagugaagugaguaacguacaacgcuuaaugcgcaaagaaaggagagacgauaacgaccucaagcgccuccgcgaccuaaaccaagccguaaacaaccuggucgaacucaaaucaacccaacaaaaaucgauacuccgcguaggaacccuaaccagcgacgaccucuuaauccucgccgcagaccucgaaaaacucaaaagcaaaguaaucagaacagaacgcccacucuccgccggcgucuacauggggaaccucuccucccaacaacucgaccaacguagagcacuacuaaacaugauaggcauguccggaggcaaccaaggcgcccgagccggccgggacggcgucguucgcgucugggacgucaaaaacgccgaacuccuuucaaaccaauucggaaccaugccuagccucacccucgccugccucaccaaacaaggacaagucgaccuaaacgacgcagugcaagcccucacagaccucggccuuaucuacacugcgaaauaccccaacaccucugaccuugaccgccuuacccagucacacccgauccuaaacaugaucgacaccaagaaaucaucccucaacaucuccggcuacaacuucucccuaggcgccgccgucaaagcaggcgccugcaugcucgacggcgggaacaugcucgaaaccauaaaaguuagcccacaaaccauggacggcauccucaaaucaauacucaaaguaaagaaagcccucggcauguucauauccgacaccccaggcgaacgaaaccccuacgaaaacauccucuacaaaauaugccuauccggagacggcuggcccuacaucgccuccagaaccucaauaaccggccgagcaugggaaaacacaguaguagaccuagaaagcgacggaaaaccacaaaaagccgacagcaacaacuccucaaaaucacuccaaucagcgggcuucaccgcuggacucaccuacagccagcucaugacccugaaagacgccaugcuccaacuagaccccaacaccaaaaccuggauggauauagaaggacgccccgaagacccagucgaaaucgcacuguaccaacccagcucaggaugcuacauccacuuuuucagagaacccaccgaccuuaaacaauucaaacaggacgcuaaauacucccacggaaucgacgucaccgaccucuucgccacccaacccggccucaccagcgccgucauagacgcucucccacgaaacauggucaucacaugccaaggcagcgacgacauucgaaaacuccuagaaucucaaggccggaaagacaucaaacuaauagacauagaccuguccaaaaccgacucacgcaaauacgagaacgcagucugggaccaauacaaagaccuaugccacaugcauaccggcgucguaguagaaaagaagaaacgcggaggcaaagaagaaauaaccccacacugcgcccuaauggacugcauaauguucgacgccgccguguccggaggccucaacacuucaguacuccgagcaguacucccacgcgacaugguguuccgcaccucaaccccucgagucguacucuaa

SEQ ID NO: 3206 - RNA, 1710 nt, Artificial Sequence
  derived and/or modified CDS sequence (opt11) from Lassa virus__AFY05616__NP
augucagcguccaaagaaaucaaaucauuccuguggacucaaucccuacgacgugaacucuccggcuacugcuccaacaucaaacuccaagucgucaaagacgcacaagcacuccuccacggccucgacuucucagaagucagcaacguccaacgacucaugagaaaagaacgccgagacgacaacgaccucaaaagacuacgagaccugaaccaagccgucaacaaucuagucgaacuaaaauccacacaacagaaaucaauccuccgcguaggaacccucacaucagacgaccuacucauccuugccgccgacuuggaaaaacucaaaucaaaaguaauacgaaccgaacgcccacucagcgcuggagucuacaugggcaaccuaagcagccagcaacucgaccaacgucgcgcccuauuaaacaugaucgguauguccggaggcaaccaaggcgcacgcgccggccgcgacggcgucgugcgaguaugggacgucaaaaacgccgaacuccucucaaaccaauucggcacaaugcccucccucacccucgccugccucaccaaacaaggacaaguagaccucaacgacgcaguacaagcgcucacagaccucggccucaucuacaccgccaaauacccaaacaccucagaucuagaccgacucgcccaaucucaccccauccuaaacaugauagacaccaagaaaucaucacugaacauauccggcuacaacuucagccucggagcagcagucaaagccggcgccugcaugcucgacggcggaaacaugcuugaaaccaucaaagucagcccccagacaauggacggcauacucaaauccauccuaaaagugaagaaagcccucggcauguucaucuccgacacaccaggagaacgcaacccauaugaaaacauacucuacaaaaucugccuauccggcgacggauggccauacauagccucgcgcaccucgaucaccggccgagccugggaaaacaccguagucgaccucgaaagcgacggcaaaccccaaaaagccgacuccaacaacagcuccaaaagccuccaaagcgccggauucaccgccggccucacauacagccaauuaaugacccucaaagacgcaaugcuacagcucgacccaaacgccaaaaccuggauggacaucgaaggacgaccagaagacccagucgaaauagcacucuaccaaccguccucgggcugcuacauacauuucuuccgagaacccacagaccucaaacaguucaaacaagacgccaaauacucacacggcauagacguuacagaccuuuucgccacccaaccuggacuaaccuccgccgucaucgacgcacuaccccgcaauauggucauaacaugccaaggcucagacgacauaagaaaacuauuagaaucacaaggccgaaaagauauaaaacuuaucgacauagaccuuagcaaaaccgacucucgcaaauacgaaaacgccgucugggaccaauacaaagaccucugccacaugcacaccggcgucguuguagaaaagaagaaacgaggcggaaaagaagaaaucacgccccacugcgcucucauggacugcauaauguucgacgcagcagucagcggaggacucaacaccagcguacuccgagccguccucccacgagacaugguauuccgcacauccaccccacgcgucguccucuaa

SEQ ID NO: 3207 - RNA, 1716 nt, Artificial Sequence
  derived and/or modified CDS sequence (opt11) from Lassa virus__AFY05618__NP
auguccgccucaaaagaaaucaaauccuuccuguggacccaaagucuucgccgcgaauuaucaggcuauugcuccaacauaaaacuacagguagucaaagaugcccaggcccuccuacacggccuagacuucuccgagguuucaaauguccaacgccuaaugcgcaaagaacgccgcgacgauaacgaccucaagagacucagagaccuaaaccaagcuguaaacaaccucguagaacucaaauccacccaacagaaaucaauccuccgaguaggcacccuaacuucggacgaccuccuaauacuagccgccgaucuagaaaaacuccgcagcaaagugauccgcacagaacgcccccucuccgcaggcgucuacaugggcaaccugagcucacaacaacucgaccaacgcagagcccuccucaacaugauaggcaugagcggaggcaaccaaggcgcccgagccggccgcgacggcgucguccgcgucugggacgucaagaacgccgagcuccucagcaaccaauucgguacuaugcccagccucacccucgccugccuaaccaaacaaggccaaguggaccucaacgacgccguccaagcucucacagaccucggacuuauauacaccgccaaauacccaaacacauccgaccucgaccgacugacacaaucccacccaauccuaaacaugaucgacaccaaaaagucaagccucaacaucuccggcuacaacuucagccuaggagccgcaguuaaagcaggcgccugcaugcucgacggcggcaacaugcucgaaacaaucaaagucagcccccagaccauggacggaauccuaaaauccauccucaaagugaagaaagcucuaggaauguucauaagcgacacccccggagaacgcaaccccuacgaaaacauacucuacaaaaucugccuauccggcgauggguggccguauaucgcaucacguaccagcaucaccggaagggccugggaaaacacugucguagaccuagaaagcgauggaaaaccccagaaagcagacuccaauaauuccagcaaaucccuccaguccgcgggguucacagccggacucacauacagucagcucaugacacuaaaagacgccaugcugcaacucgaccccaacgccaagaccuggauggacauagaaggccgccccgaagaccccgucgaaaucgcacucuaccaacccagcuccggcugcuacauccacuucuuccgcgaaccaaccgaccucaaacaaaaacaauucaaacaagacgccaaauacucacacggcaucgacgucacagaccucuucgcaacacaacccggccuaaccucagcaguaaucgacgcgcuccccagaaacaugguaaucacaugccaaggcuccgacgacauccgcaaacugcucgaaucccaagggcgcaaagacauuaaacugauagacaucgaccuaagcaaaaccgacucccgcaaauacgaaaacgccgucugggaccaauacaaagaucuuugccacaugcacaccggcguugucguagaaaagaagaaacgaggcggcaaagaggaaaucacaccccacugcgcccuuauggacugcaucauguucgacgcugcaguauccggcggccucaacaccuccguccuaagagccguacuaccacgcgacauggucuuccgaaccagcacgccccgagucguccucuag

SEQ ID NO: 3208 - RNA, 1710 nt, Artificial Sequence
  derived and/or modified CDS sequence (opt11) from Lassa virus__AHC95552__NP
augucagccucaaaagaagucaaauccuuccucuggacccaaucuuuacgacgagaacuaagcggcuacugcagcaacauaaaacuccaaguggucaaagacgcccaagcccuacuccacggccuagacuucagcgaggucucuaacguacaaagacucaugcgcaagcaacgccgggacgacggagaccucaaaagacuccgcgaccucaaccaggccgucaacaacuuaguagaacugaaaagcacucaacagaaaaacguccuccgcgucggaacacugaacuccgacgaccugcucacacuagcagccgaccuagaaaaacucaaauccaaaguaacccggacagagcgcccccuaucguccggcguauacaugggaaaccucucgucacaacaacucgaccaacgacgggcccuccucaacaugaucggcaugaccgggggaaaccaaggcacgcaggccggacgcgacggagucguccgcgucugggacgucaaaaacgccgaacuccuuaacaaccaguucgguacgaugcccucgcuaacgcucgccugccucaccaaacaaggacaggccgaccucaacgacguaguacaagcccuaaccgaccuaggccuuauauacaccgcuaaauaccccaacgcaagcgaccucgacagacucacccaaucgcaccccauccugaacaugaucgauaccaagaaaucaucccuaaacauaucaggcuacaacuucucccucggcgcggcaguuaaggccggcgccugcaugcuagacggcggcaacaugcuagaaacaaucaaaguaagcccacaaucaauggacggcauccucaaauccauccuuaaagugaaacgagcccucggcauguucgucucggacacacccggcgaacgcaacccauacgagaacauccucuauaaaaucugccucagcggagacggcuggccguauaucgcaagccgcacaagcauagucggacgagcaugggaaaacaccguugucgaccuagaagcagacggcaaccccaaaaagcugaauagcaacggcucaaacaaaucacuacaaagcgcaggauuuccagccggacucaccuacagccaacucaugacacucaaagaugccaugcuacaacuggacccaaacgccaaaacauggauggacaucgaaggucgccccgaagaccccguagaaguagcacucuaccaacccaacagcgggugcuacauacacuucuuccgcgagcccaccgaccucaaacaauucaaacaagacgccaaauacucccacggaaucgacgucacagaucuauucgccgcccaaccaggacucaccuccgccgucaucgaagcacuaccccguaacauggucauaacaugccaaggcuccgaagacauacgaaaacuacuagagucccaaggccgaaaagacauuaaacuaaucgacaucgcccucagcaaaaccgacucacgcaaauucgaaaacgccguaugggaccaauacaaagaccucugccacaugcacaccggagucgucguugagaaaaagaaacgcggcggcaaagaagaaaucacaccccacugcgcccucauggacugcauaauguucgacgcagccguauccggaggccugaauacccucgugcucagagcuguccuccccagagacaugguauucagaacaucuaccccaagagucguccucuaa

SEQ ID NO: 3209 - RNA, 1710 nt, Artificial Sequence
  derived and/or modified CDS sequence (opt11) from Lassa virus__AHC95554__NP
auguccgccagcaaagaaguccgcagcuuucucuggacccagucacuccgccgagagcucucgggauacugcucaaacaucaaacugcaagucgucaaagacgcgcaagcccuacuacacggccucgauuucuccgaagucuccaacguacaacgucucaugcgcaaacaacgcagagacgacggagaucucaaacggcuccgugaccucaaccaagcugucaacaaccucgucgaacucaaauccacgcagcaaaaauccguccuccgaguaggaacacucaacucagacgaccuacucacccucgccgccgacuuagaaaaacucaaaucuaaagucaccagaacagaaagaccucuaagcuccggcguauacaugggcaaucuauccucacaacaacucgaccaacgucgcgcccuucuaaacaugaucggcaugacuggcgguaaccaaggcgcacaagccggccgcgacggcguaguccggguaugggaugucaaaaacgcggaacuucuaaacaaccaauucggcaccaugccaagccuaacccucgcaugccuaaccaaacaaggccaaguagaccugaacgacgucguccaagcccuaaccgaccucggacucaucuacaccgcaaaauaccccaauaccucagaccucgaccgucugacacaaagccacccuauccuaaacaugaucgacaccaaaaaaaguucccucaacauauccggauacaacuuuucccucggcgccgcaguaaaagccggcgccugcaugcucgacggcggcaacaugcucgaaaccaucaaaauauccccccaaucaguagacggcauccucaaaucaauacucaaagucaaacgaucauuaggcauguucgucucagacacccccggggaaagaaaccccuacgaaaacaucuuauacaaaaucugccuauccggcgacggcuggccauauaucgccucccgcacuucaauaguaggucgcgccugggagaacaccgucgucgaucucgaggccgacggcaaaccccagaaaccaaacucaggcucguccaacaaaucccuccaguccgcuggcuuccccgcaggccucaccuacagccaacuaaugacucuaaaagacgccaugcuucaacuagacccuaacgccaaaaccuggauggacauagaaggccgccccgaagaccccgucgaagucgcucucuaccaacccagcucaggcugcuacauccacuucuuccgagaaccaaccgaccuaaaacaauucaaacaagacgcaaaguacucacacggcaucgacgucacagaccucuucgccgcacagcccggccucaccuccgcugucaucgaagcccuaccucgcaacauggucauaaccugccaaggcucagaagacaucaaaaaacuccucgaaucacaaggccgcaaagacaucaaacucaucgacauagcacucucaaaaaucgauagccgcaaauucgagaacgcugucugggaccaauacaaagaccuuugccacaugcacacuggagucguagucgaaaaaaaaaaacgcggcggaaaagaagaaauaaccccacacugcgcacucauggacugcaucauguucgacgcagccguuucaggcggacuuaacgcauccgucuuacgagccguacucccaagagacauggucuuccgcaccucaacucccaaaguaguccuauaa

SEQ ID NO: 3210 - RNA, 1710 nt, Artificial Sequence
  derived and/or modified CDS sequence (opt11) from Lassa virus__AHC95556__NP
augucggccuccaaggaaguaaaauccuuucucuggacccagucccuccgacgagaacuaucaggauacugcuccaacaucaagcuccaagucgucaaagacgcacaagcacuccuacacggccuggacuucucggaaguauccaacguccagcgccucaugcggaaacaacgacgcgacgacggcgaccucaaacgccuacgcgaccuaaaccaagccguaaacaaccuggucgagcugaaguccacccaacagaaaaauguacuacgcguaggcacccugaacagcgacgaccuacucacccucgcagccgaccuagaaaaacucaaauccaaagucacaagaacagaaagaccccucuccuccggcgucuacaugggcaaccucuccucacaacaacuagaccaacgacgcgcccuccucaacaugauaggaaugaccggcggcaaccagggcacccaaaccggaagggacggagucguccgcgucugggacgucaaaaacgccgaacuccucaacaaccaauucggaacaaugccaucccuaacacuggcaugccucacaaaacaaggccaagcagaccugaacgacguaguccaagcccuaacagaccugggacuaauauacaccgcaaaauaucccaacgcauccgaccuagacagacuaacccaaucccacccaauccuaaacaugaucgacaccaagaaauccucccugaacaucuccggauacaacuucucccugggcgccgcugucaaggcaggagccugcaugcuagacggcggcaacaugcuagaaaccaucaaagucagcccccaaagcauggacgggauccucaaaagcauacuaaaagucaaaagagccuuaggaauguucgucagcgacacccccggcgaacgaaacccuuaugaaaacauccuuuacaaaauaugccucagcggcgacggauggcccuacaucgcgagccgcaccuccaucgucggcagagccugggaaaacaccgucgucgaccuagaagccgacggaaacccuaagaaacucaacucaaacggaagcaacaaaucccuccaguccgccggcuuccccgccggccucacauacagccaacucaugacccucaaagacgccaugcuacaacuagaccccaacgccaaaaccuggauggacaucgaaggucgaccagaagaccccgucgaagucgcacucuaucaacccaacuccggcugcuacauccacuucuuccgcgaaccaaccgaucucaaacaauucaaacaggacgcaaaauacucacauggcauagacguuacagaccucuucgccgcccaacccggccucaccuccgccgucaucgaagcccuccccagaaacauggucauaaccugccagggauccgaagacauaagaaaacuccucgaaucucaaggaagaaaagacaucaaacucauagacauugcgcuaagcaaaacagacagccgcaaauucgagaacgccgucugggaccagcacaaagaccucugccacaugcacaccggaguaguaguagagaaaaagaaacgcggaggaaaggaagaaauaacuccccacugcgcccucauggauugcaucauguucgacgcagcagucagcggcggccuaaacacccucguccuucgagcuguucuuccccgggacaugguauuccgaaccagcaccccgaaagucguccucuaa

SEQ ID NO: 3211 - RNA, 1710 nt, Artificial Sequence
  derived and/or modified CDS sequence (opt11) from Lassa virus__AHC95558__NP
augagcgccagcaaagaaguccgcagcuuccucuggacucaaucccuccgacgagaacuauccggcuacugcuccaacauaaaacuccaagucgucaaagacgcccaagcacuccuacacggccucgacuuuucagaaguaagcaacguccagcgacucaugcggaaacagcgacgggacgacuccgaccucaagcgccuaagagaccuaaaccaagcggugaacaaccugguagagcuaaaaagcacacaacagaagucaguccuccgagucggaacacucuccagcgacgaccucuuaacacucgccgccgaucuagaaaaacucaaaucgaaagucauacgcaccgaacgcccccuaucgagcggcguauacaugggaaacuuaagcucacaacaacucgaccaaagacgagcacuacucaacaugaucggaaugaccggcggaaaccaaggcgcacaggcgggccgagacggagucguacgaguuugggacguccgaaacgccgaacuccucaacaaccaauucgggaccaugccaucccucacccucgccugccuaaccaaacaaggacaaguagaccuuaacgaugucguacaagcccuaaccgaccucggccucauauacaccgccaaauaccccaacaccagcgaccuagaccgacucacgcaaaaccaccccauacugaacaugauagacacgaagaaaucaucacucaacauaagcggcuacaauuucucgcuaggagccgccgucaaagccggggccugcaugcucgacggcggaaacaugcuagaaaccaucaaagucucaccccaaagcaucgacgggauacuaaaauccauccucaaagucaaacgcacccucggaauguucgucagcgacacccccggugaacgaaaccccuacgaaaacauccucuacaaaaucugccucagcggagacggcuggccauacaucgcaagccgcaccagcaucgucggccgggcaugggaaaauacgguagucgaccucgaaaccgaccgaaagucacagggccccaacagcggcaacuccaacaaaagccuccaaagcgcaggcuucagcgccggccucaccuauagccaacuuaugacacuaaaagacgccaugcuccagcucgaccccaaugcgaaaacauggauggauaucgaaggacgcccagaggacccaguagagguagcacuuuaccaaccgauaucaggcugcuacauacauuucuuccgggaaccgaccgaccucaaacaguucaaacaagacgcaaaauauagccacggcaucgacauaaccgaccucuucgccgcccaacccggccuaacauccgccgugaucgaagcacuccccagaaacauggucauaacaugccaaggcagcgaagacaucaagaaacuccucgaaucccaaggacgcaaagacaucaaacuuauagacaucgcacuaucaaaaauagacucccggaaauucgaaaaugcugucugggaccaauacaaagaccuaugccacaugcacaccggcguuguagucgaaaagaagaaacggggcgggaaagaggaaauaaccccacacugcgcauuaauggacugcaucauguucgacgccgccguuagcggcggccuuaacgcuagcguacucagagccgugcucccacgagacaugguauuccgcacaagcacccccaaagucguccuauaa

SEQ ID NO: 3212 - RNA, 1710 nt, Artificial Sequence
  derived and/or modified CDS sequence (opt11) from Lassa virus__AHC95560__NP
augucagcaagcaaagaagucaaauccuuccuauggacccaaucccuccggagagaacuaucaggguacuguagcaacauaaaacuccaaguaguaaaagacgcccaggcccuccuccacggacucgacuucagcgaagucagcaacguacaacgccucaugcgcaaacaacgcagagacgacggcgaccuaaaacgacuacgagaccucaaccaggcaguaaacaaccuggucgaacucaaaagcacgcaacagaaaaacguccucagaguaggcacacugaacuccgacgaccuccuaacccuagccgccgaccucgaaaaacucaaauccaaaguuacacgcaccgaaagaccgcucuccucaggggucuauaugggcaaccuauccagccaacaacuagaccaacgcagagcgcuucuaaacaugauagggaugucaggcggcaaccaaggcacccaagucggacgcgacggcgucguacgcgucugggacgucaaaaacgccgaacuccucaacaaccaauucggaacaaugcccucccucacacucgcaugccugacaaaacaaggacaagccgaccugaacgacgucguacaagcccucacagaccucggacucaucuacaccgccaaauaucccaacgccuccgaccucgacagacucacccaaagccaucccauccucaacaugaucgacaccaagaaauccucacucaacauuuccggauacaacuucucccuaggagccgcaguaaaagcgggugcaugcaugcucgacggcggcaacaugcucgaaacaaucaaagucucaccccaaucaauggacggcauacucaaauccauacucaaagucaaacgugcccucggcauguucgucuccgacaccccaggcgagcgaaauccauacgaaaacauccucuacaaaauaugccucucgggagacggcuggccguacaucgcaucccgaacaucaaucgucgggcgagccugggaaaacaccguagucgaccucgaagccgacggcaacccgaagaaacugaacucaaacggcagcaacaaaucacuccaauccgcaggauuccccgccggccuuacauauucccaacucaugacucugaaagacgccaugcuccaacucgacccaaacgcgaaaaccuggauggacaucgaaggccgaccggaagacccaguagaagucgcccucuaccaacccaacuccggcugcuacauccacuucuuccgagaaccaaccgaccuaaaacaguucaaacaggacgcaaaauacagccacggcauagacguaaccgacuuauucgccgcucaaccaggccucacaagcgcaguaauagaagcacuuccccgcaacaugguaauaacaugccaagguuccgaagacauacgcaaacuacuggagucccagggccgcaaagacaucaaacucaucgacaucgcucuaucaaaaacagacucaagaaaauuugaaaacgccgucugggaccaacacaaagaccucugucacaugcacaccggagucgucgucgaaaagaagaaacgcggcggaaaagaggaaaucacaccucacugcgcccucauggacugcaucauguucgacgccgcaguaucaggcggccuuaacacauuaguccugcgcgccguacuccccagagacauggucuucaggaccuccacaccaaaaguuguccuauaa

SEQ ID NO: 3213 - RNA, 1710 nt, Artificial Sequence
  derived and/or modified CDS sequence (opt11) from Lassa virus__AIT17127__NP
augagcgccuccaaggaaauaaaaaguuuccucuggacccaaucacuccgacgagagcuaucaggauacugcucaaacaucaagcuacaaguaguaaaagacgcccaagcccuccuccacggccucgacuucuccgaaguaagcaacguacaacgccuaaugcgcaaagaaagacgagacgacaacgaccuaaagagacuacgcgaccuaaaccaagccguaaacaaucucguagaacucaaauccacccaacagaaaagcauccuccgcguaggaacacucacauccgacgaccuacucauccuagcagcagaccucgaaaaacuaaaaucaaaagucauaagaacagaacgcccccugucagccggagucuacaugggcaaccucuccagccaacaacuagaccaacgcagagcacuacuuucaaugaucggcauguccggcggcaaccaaggcguacgagcaggcaaagauggugucguacgcgucugggacgugaaaaacgccgaacuacuaaacaaccaauucgggaccaugccuucccucacccuggccugccucaccaaacaaggccagguagaccugaacgacgccguacaagcccuaaccgaccuaggccucauauacaccgccaaauacccgaacaccagcgaccuugacagacucacacaaagccaccccauacuaaacaugaucgacacaaagaaauccagccucaacaucuccggcuacaacuucucgcucggagcagcaguaaaagccggagccugcaugcucgacggcggaaacaugcuagagacaaucaaaguaucgccacaaacaauggacggaauacucaaaucaauccugaaagucaaaaaggcacuggguauguucaucucugacacaccaggcgagcgcaacccauacgaaaacauauuauacaaaauuugccucuccggcgacggcuggcccuacaucgccucccgaacaucaaucaccggccgcgcaugggaaaacaccgucgucgaccucgaaagcgacggcaaaccccaaaaagccggaucaaacaacagcaacaaaucccugcaaagcgcaggcuuuaccgcaggccucaccuacucacaacucaugacccucaaagacgccaugcuccagcuagacccaaacaccaaaaccuggauggacaucgagggccgaccagaagacccagucgagaucgcccucuaccaacccuccagcggcugcuacauccacuucuuccgcgaaccuacagaucucaagcaauucaaacaagacgcaaaauacagccaugggauagacgucacagaccuauucgcagcccaaccaggucugaccuccgcagucaucgacgcucuaccucgaaacaugguuauaaccugccaaggauccgacgauauccgaaagcuccucgaaagccaaggccgaaaagacaucaaacuaaucgacaucgcacucaacaaaaccgacagccgcaaguacgaaaacgcaguaugggaccaauacaaagaccucugucacaugcacaccggcguagucguggaaaagaagaaacgcggcgggaaagaggaaaucacaccacacugcgcauuaauggacugcauaauguucgaugccgccguauccggcggccuaaacacguccguacuaagggccguccucccccgcgacauggucuuccgcaccuccacgccccgaguaguccuauaa

SEQ ID NO: 3214 - RNA, 1710 nt, Artificial Sequence
  derived and/or modified CDS sequence (opt11) from Lassa virus__AIT17131__NP
augagcgccuccaaagagaucaaaucguuuuuguggacccaaucgcuccgccgcgagcuauccggcuacugcagcaacaucaaacuccaagucgucaaagacgcucaagcccuccuccacggacucgacuucucagaaguaucaaauguacaacgacuaaugcgaaaagaacgccgagacgacaacgaccuaaaacgccuccgcgaccucaaccaagccgucaacaaccuaguggaacucaaaagcacccaacaaaaauccauccugagagugggcaccuuauccuccgacgaccugcucguccucgcagcugaucucgagaaacuaaaauccaaaguaacccgcaccgaacgcccgcuaucggcuggagucuacauggggaaccuaucaucacaacaacucgaccaaagacgggcccuccucaacaugaucggcauguccggaggcaaccaaggcgcgcgcgccggccgagacggcgucguacgaguaugggaugucaaaaacgcagaacuccucaauaaccaauucggaaccaugccuagccuaacacucgcuugccuaacaaaacaaggccaaguagaccucaacgacguaguacaagcccucaccgaccucggccuaauauacaccgcuaaauaccccaacaccagcgaccucgaccgccucacccaaagccaccccauccucaacauggucgacaccaagaaauccucccucaacauaagcggcuacaacuucucccuaggcgccgcuguaaaagcaggcgccugcaugcuugacggcggcaauaugcuagaaaccaucaaggucucaccccaaacaauagacgggauccuaaaaucaauuuuaaaagucaagaaagcccucggaauguucaucuccgacacccccggcgaacggaacccauacgaaaacauacucuacaaaaucugccuaucaggcgacggcuggcccuacauagccagccgcaccucaauaaccggccgagccugggaaaacacagugguugaccucgagagcgacggaaaaccccaaaaagccggauccaacaacagcaacaaaucacuccaaucagcugguuucaccgccggacugaccuacagccaacucaugacccuaaaagacgccaugcuacaacucgacccaaaugccaaaaucuggauggacauagaaggcagaccggaagaccccguagaaaucgcucucuaccagccauccagcgguugcuacauccacuucuuccgagaacccaccgaccucaaacaauucaaacaagacgcuaaauacagccacggcauagacgugacugaccuauucgccgcccaaccgggccucaccuccgccguaaucgacgcacuacccagaaacaugguaauaacaugccaaggagcggacgacauccgcaaacuccuggagagccaaggccgcaaagacaucaagcucaucgacaucgcccucaacaaagcggacucccgcaaauacgagaacgccguaugggaccaauacaaagaccuaugccauaugcacaccggcgucguagucgaaaagaagaaaagaggagguaaagaagaaaucacaccacacugcgcccuaauggacugcauaauguucgacgcagcagucuccggcggccucaacaccuccguccuaagagccguccuuccacgcgacaugguauuccgcaccucaacaccccgcgucgugcucuaa

SEQ ID NO: 3215 - RNA, 1710 nt, Artificial Sequence
  derived and/or modified CDS sequence (opt11) from Lassa virus__AIT17139__NP
auguccgccucaaaagagaucaaauccuucuuguggacccaaucccuccgccgcgaacucuccggcuacugcucaaacaucaaacuacaaguaguaaaagacgcccaagcccuccuccacggacucgacuucucagaaguuucaaacguacagcgccucaugcgcaaagaacgccgcgacgauaaugaccuaaaaagacuacgcgaccucaaccaagccguuaacaaccuagucgaacuaaaauccacccaacaaaaauccguacuacgcgucggcacccuaaccuccgacgaccuacuuauccucgcagccgaccuagaaaaacuaaaauccaaagucacacgaaccgaacgcccccucucagcaggcgucuacaugggcaaccucuccucacaacaacuggaccaaagacgcgcacuacuaaacaugaucggcaugucuggaggcaaccaaggagccagagcaggacgggacggcgucguccgagucugggacgucaaaaacgccgaacuucuuaacaaccaauucggaaccaugcccucccucacacuagcaugccucaccaaacagggacaagucgaccucaacgaugcaguccaagcccuaacugaccuaggccucaucuacaccgcaaaauacccuaacaccucagaccucgaccggcucacacaaucacaccccauccucaacaugaucgacaccaagaaauccucucucaacaucuccgguuacaacuucucccucggcgccgccgucaaagccggugcaugcaugcucgacggcggcaacaugcuugaaacaauaaaagucucaccccaaaccauggacagcauacuuaaaucaauacuaaaaguuaagaaagcccuagguauguucaucagcgacaccccuggcgaacgaaacccauacgagaacauacuauacaaaaucugccuauccggcgacggauggcccuacaucgccucccguaccuccauaacaggccgagcaugggaaaacaccgucguugaccucgaaucggauggaaaaccccaaaaagcaggcucaaacaacucaaacaaaagccuccaauccgccggcuucgccgccggccuaacauacucacaacucaugacauuaaaagacgccaugcuccaacucgaccccaacgcaaaaacauggauggacaucgaggggcgccccgaagauccagucgagaucgcucucuaccaacccucgagcggauguuacauccacuucuuccgcgaacccacugaccucaagcaauucaaacaagacgcaaaauacucccacggaauugacgugacagaccucuucgccgcccaaccgggccucaccucagccguuaucgacgcccucccccgcaacauggucauaaccugccaagguucagaugacaucaggaaacuacucgaaagccaaggaagaaaagacaucaaacuaauagacauugcccucuccaagacugacucccgcaaauacgaaaacgcaguaugggaccaauacaaagaucuaugccacaugcacaccggcaucgucguagaaaagaagaaacgcggcggaaaagaagaaauaacuccacacugugcacucauggacugcauaauguucgacgccgccguauccggcggccucaacaccuccguccuuagggcaguccucccccgcgacauggucuucaggacaaccacccccagagucguccucuaa

SEQ ID NO: 3216 - RNA, 1710 nt, Artificial Sequence
  derived and/or modified CDS sequence (opt11) from Lassa virus__AIT17143__NP
augucagcgucaaaagaaauuaaauccuuucuauggacacaaucacuccgacgagaacucucaggcuacugcuccaacaucaaacuccaagucgucaaagacgcccaagcccuccuacacggccuagacuucuccgaaguaucuaacguccagcgacucaugcgcaaagaacgccgcgacgacaaugaccucaaacgccuccgcgaccucaaccaagcggucaacaaccuagucgaacuaaaauccacacaacaaaaauccauccuacgcguaggaacccucaccagcgacgaccuccucauacucgccgccgaccucgaaaaacuaaaauccaaagugaccagaacugagcgcccgcucuccgcugggguuuacaugggcaaccuaagcucacaacaacucgaccagcggcgcgcccuacuaaacaugauaggaauguccggcagcaaccaaggcgcccgcgcaggccgggacggcgucguccgcguaugggacgucaaaaacgccgaacuccucaacaaccaauucggcaccaugccaucacucacacucgcgugccuaaccaaacaagggcaaguagaccucaacgacgccguccaagcccuaaccgacuugggacugaucuacacagcgaaauaccccaauaccuccgaccucgauagacucacccaaagccacccaauacucaauaugaucgacaccaagaaaagcagccucaacaucuccggauacaacuucucccucggcgcagcgguaaaagcaggcgccugcaugcucgacggcggcaacaugcuugaaaccaucaaagucagcccccagacaauggacggcauucucaaauccauacucaaagucaaaaaggcccucggaauguucaucuccgacacccccggagaacgcaaccccuacgaaaacauccuauacaaaauuugucucagcggagacggcuggcccuacaucgccagccgaacauccaucaccggccgcgccugggaaaacacaguaguagaccuagaaucagacggaaaaccacaaaaagccggcaacaacggaucaaacaaaucccuacaaagcgccggauuuaccgccggacuuaccuacagccaacugaugaccuugaaagacgccaugcuacagcuugaccccaacgcaaaaacuuggauggacauagaaggccgcccagaagaccccguagaaaucgcccuuuaccaaccauccucaggcugcuacauacacuucuuccgcgaaccaacagaccuaaaacaauucaaacaagacgccaaauacucccacggcauagacguaacagaccuauucgcagcacaacccggucucaccuccgccgucauagaugcacuaccccgcaaccuaguuauaacaugucaaggcagcgacgacauacgaaaacuccucgaaagucaaggccgaaaagacaucaaacucauagauaucgcccuaucaaaaaccgacucccgcaaauacgaaaaugcagucugggaucaauacaaagaucucugccacaugcacaccggcauagucguagagaaaaagaaacgagggggaaaagaagaaauaaccccacacugugcccuaauggacugcaucauguucgaugccgccgucagcggaggauuaaacaccagcguacuacgcgcgguccuccccagagacauggucuuccgcaccagcaccccacgcgucguccucuga

SEQ ID NO: 3217 - RNA, 1710 nt, Artificial Sequence
  derived and/or modified CDS sequence (opt11) from Lassa virus__AIT17147__NP
auguccgccuccaaagaaaucaaaucuuuccucuggacccaaucccuccgucgugaacucuccggcuacugcagcaacauaaagcuccaagucgucaaagaugcccaagcccuacuccacggucuagacuuuuccgaagucucaaacguacaacgccuaaugagaaaagagcgccgcgacgacaacgaucucaaaagacuccgagaccucaaccaagcagucaauaaccucgucgaacuaaaguccacccaacagaaauccguccuccgaguaggcacacucaccucagacgaccugcugauccuagcagcagaccucgaaaaacuaaaaucaaaagucacccgaaccgagcgcccacucucagccggcgucuacaugggcaaccucucaucacaacaacuagaacaacgacgagcccugcuaaacaugaucggcaugucagguagcaaccaaggagcccaggcaggccgcgacggggucguccgugucugggacgucaaaaacgccgaacuacuaaacaaccaauucggcacaaugcccagccuaacccucgccugccucaccaaacaaggccaaguagaccuuaacgacgcaguacaagcccucaccgaccuaggccucaucuacaccgucaaauaucccaacaccuccgaccucgaccgacuuacacaaucacacccaauacuaaacaugauagacaccaagaaauccucccuaaacaucagcggcuacaacuuuucacuaggcgccgccguuaaagcaggcgccugcaugcuggacggcgggaacaugcucgaaacgauaaaagucagcccccaaaccauggacggaauccuaaaaucaauccucaaaguaaagaaagcccucggcauguucauauccgacacaccaggcgagcgcaacccguacgaaaacauucuauacaaaaucugccucucaggcgacggcuggccauacaucgcaucacgaaccuccaucacaggacgagccugggaaaacaccgucgucgaccucgagagcgacggaaaaccccaaaaagccgacuccaauuccuccaacaaaucacuacaauccgcuggcuuuaccgcaggacucacguacucccagcuaaugaccuuaaaagaugccaugcuccagcuagaccccaacgccaagacguggauggauaucgaaggccgcccagaagaccccgucgaaguugcccucuaccaacccagcucaggcugcuacauacacuucuuccgcgaaccaacagaccuuaaacaauucaaacaagacgccaaauacucacacggcauagacgugaccgaccucuucgccgcacaaccaggccugacaagugccguaaucgaugcacucccccgaaacaugguaauaacaugccaaggcagcgaugacaucagaaaacuacuugaaucccaaggccggaaagacauaaaacugaucgacaucgcccuauccaaaaccgacuccagaaaauacgaaaacgcuguaugggaccaauacaaggaccuaugccacaugcacaccggcguagucgucgagaaaaagaaacgaggcggcaaagaagaaaucacgccccacugcgcacucauggacugcaucauguucgaugcagccgucucgggcggccucaacaccagcguccuccgcgccguucucccaagagacauggucuuucgcaccuccacgccccgcguaguccucuaa

SEQ ID NO: 3218 - RNA, 1710 nt, Artificial Sequence
  derived and/or modified CDS sequence (opt11) from Lassa virus__AIT17151__NP
augucagccagcaaagaaaucaaaucguuccucuggacccaauccuuaagacgcgaacuuuccggcuacugcuccaacauaaaacuccaggucgucaaagacgcacaagcccuucuccacggacucgacuucuccgaaguuagcaacguucagcgccucaugagaaaagaacgccgagacgauaacgaccucaaacgacuacgcgaccucaaccaggccgucaacaaccugguagaacuaaaaucaacgcagcaaaaauccauccuccgcgucggcacacucacaucagacgaccuccuaauccucgccgcagaccucgaaaaacucaaaagcaaaguaaccaggaccgaacgcccacuaucagccggagucuacaugggaaaccuauccucccaacaacucgaucagcgccgcgcgcuccucuccaugaucggcauguccggcggcaaccagggagcccgugccggacgcgacggcgucgucagagucugggacgucaaaaacgccgaacuccuaaacaaccaauucggcacgaugcccucccucacccuagcaugccugaccaaacaaggccaaguagaccuaaacgacgucguccaagcacucacagaccuuggccuaaucuacaccgccaaauacccaaacaccucagaccucgaccgccuaacacaaucccauccaauacuaaacaugaucgacaccaaaaagagcucccucaacaucucaggcuacaacuucucccuaggcgcagcagucaaagccggcgccugcaugcucgacggcggcaacauguuagaaacaaucaaagucucuccacaaaccauggacggaauacucaaaucgauccugaaaguaaagaaagcccucggcauguucauaagcgacacccccggggagcgaaaccccuacgagaacauacucuacaaaaucugccucuccggcgacggcuggcccuacaucgcaucucgcaccuccauaacagguagggccugggaaaacacggucgucgaccuugaauccgacggaaaacuccaaaaagcuggcuccaacaacagcaacaaaucccuccaaagcgccggcuucacagccggacucacauacucccaacucaugacccuuaaagacgccaugcuccagcucgacccaaacgcaaaaacguggauggauaucgaggggcgacccgaggaccccgucgaaaucgcacuauaucaacccagcucuggcugcuacauccacuucuuccgagaaccuaccgaccucaaacaauucaaacaagacgccaaguacucacacggaauagacgucacagaccucuucgccgcccaaccaggucuaaccuccgccguaauagacgcccucccccggaacaugguaauaacaugccaaggaagcgacgacaucagaaaacuacuagaaagccagggacgcaaagacaucaaacuaauagauauagcccucaacaaaaccgacucucgaaaauacgagaacgcagucugggaccaguacaaagaccucugccacaugcacacaggaguugucgucgaaaagaaaaagaaaggcgggaaagaggaaaucaccccacacugcgcacuaauggacugcaucauguucgacgcagcagucagcggcggacuaaacaccagcguacuaagagcaguccucccucgcgacaugguauuccgcaccuccacuccccgagucguccuauaa

SEQ ID NO: 3219 - RNA, 1710 nt, Artificial Sequence
  derived and/or modified CDS sequence (opt11) from Lassa virus__AIT17155__NP
augagcgccuccaaagaaaucaaaucguuccuauggacccaaucgcuccgccgagaacucucaggguacugcuccaacaucaaacuacaagucgucaaagacgcccaggcccucuugcacggccucgacuucuccgaagucucaaauguccaacgccugaugcgcaaagagcgccgagacgacaacgaccuaaaacgacuucgagaccucaaucaggcaguaaacaaccucgucgaacuuaaaagcacacaacagaaaucgguacuccgcgucggcacacucacaagcgacgaacuccucguacuagccgccgaccucgaaaaacuuaaauccaaagugaucagaacggaacgaccccucagcgccggaguauacaugggcaaccuguccagccaacaacucgaccaacggcgcgcccuacuaagcaugaucggaauguccggcggcaaccaaggcgcccgcaccggacgcgacggcgucguccgcgucugggaugucaaaaacgcugaacuccuaaacaaccaguucggcaccaugccaucccucacccucgcaugccuaaccaaacaagggcaggucgaccucaaugacgcaguccaagcacuaaccgaccucggccugaucuacacagcaaaauacccgaacaccucagaccuggacagacuaacacagucccaccccauccucaacaugaucgacaccaaaaaguccucccucaacauauccggcuacaacuucagccucggcgcggccguaaaagcaggcgccugcaugcuggauggcggaaacaugcucgaaacaaucaaagucaguccccaaacaauggauggaauacuaaaauccauccuaaaaguaaagaaagcccucggcauguucaucuccgacacaccaggcgaacgcaaccccuacgaaaacauccuauacaaaaucugccucuccggagacggauggcccuacaucgcaucccgaaccucaaucaccggacgcgccugggaaaacaccgucgucgaccucgaguccgacggcaaaccccaaaaagcaggcucaaacaauagcaacaaaagccuacaauccgcaggcuucacagcaggccuaacguacucccaacucaugacucucaaagacgccaugcuccaacuggacccaaacgccaaaaccuggauggacaucgagggccgccccgaagacccagucgaaaucgcucuauaccaacccucgucaggaugcuacauacacuucuuccgcgaacccaccgaccucaaacaauucaaacaggacgcaaaauacucccacggcauagacgucaccgaccucuucgccgcccagccgggccuaaccagcgcagucaucgacgcccuaccccgcaacauggucaucacaugccaaggcuccgacgacaucagaaagcuacuagagucccaaggucgaaaagacauaaaacucaucgacauagcacucucgaaaauugauucacgcaaguacgagaacgcagucugggaccaauacaaagaccucugccacaugcacaccggcguaguaguagaaaagaagaaacggggcggcaaagaagaaauaacaccacacugcgcacuuauggacugcauaauguucgacgccgccgucagcgguggacuaaacucccucguacuccgagcugugcuaccacgagacauggucuuucgcaccucgacaccccgagucguccucuga

SEQ ID NO: 3220 - RNA, 1710 nt, Artificial Sequence
  derived and/or modified CDS sequence (opt11) from Lassa virus__AIT17161__NP
auguccgcauccaaagaaaucaaaucauuccucuggacccaaagccuacgacgcgaacuaagcggcuacugcagcaacaucaaacuacaggucgucaaagacgcgcaggcccuacuccauggccucgacuucucagaaguaucgaacguccaacgccucaugcggaaagaacgacgcgacgacaacgaccuaaaacgccuccgugaccucaaccaagccguuaacaaccuagucgaacucaaaucaacgcaacagaaaucaauauuacgcguaggaaccuugacguccgacgaccuccucauccucgcagccgaucuagaaaaacucaaaucaaaaguuacccgcaccgaacgcccacuuucagccggagucuacaugggcaaccuaucaucgcaacaacucgaccagcgccgcgcccuccucaacaugauaggaaugucaggcagcaaccaaggcgccagaaccggacgagacggagugguccgcgucugggacgucaaaaacgccgaacuccucaacaaccaauucggcaccaugcccucccuaacccucgccugccucacaaaacaaggccaagucgaccucaacgacgcaguccaagcucucacagaccuaggccuaauauacaccgccaaauacccaaacacuucugaccucgaccgacuaacccaaucccaccccauccuaaacaugaucgacaccaagaaauccucccucaauauaagcggcuacaacuucagccucggcgccgcaguaaaagccggcgccuguaugcuagacggcggcaacaugcuugaaacaaucaaagucuccccacaaaccauggacgguauccuuaaauccauccucaaagucaagaaagcccuaggaauguucauauccgacaccccaggcgaacgaaaccccuacgagaacauccucuacaaaaucugccuaagcggagacggcuggcccuacauagccuccagaaccucuaucacuggccgagcuugggaaaacaccguagucgaccuggaaagcgacggcaaaccccaaaaagcgggaucaaacuccuccaacaaaucccuacaaagcgccggacucaccgcaggccuaacauacucccaacucaugacccuaaaagacgccaugcuccaacucgaccccaacgcaaaaacauggauggauaucgaaggaagacccgaagacccagucgaaaucgcacucuaccaaccaagcuccggcugcuacauccacuucuuucgcgaacccaccgaccucaaacaauuuaaacaagacgcgaaauauucccacggaaucgacguuacagaccucuucgcagcccaaccaggucugaccucagccgucaucgacgcacuacccaggaaccuugucauaaccugccaagggucagacgacauccgcaaacuacuagaaucacagggacgaaaagauaucaaacucaucgacaucgcccuaagcaaaacagacucacggaaauacgaaaacgcagucugggaccaauacaaagaccucugccacaugcacaccggcaucgucguagagaaaaagaaacgcggcggcaaagaagaaauaacuccccacugugcacuaauggacugcauaauguucgacgcagccguaucaggcggccuaaacgccagcguacuccgagccguccucccucgagacaugguguuccgaaccuccaccccgcgagugguucuauaa

SEQ ID NO: 3221 - RNA, 1710 nt, Artificial Sequence
  derived and/or modified CDS sequence (opt11) from Lassa virus__AIT17165__NP
augagcgccagcaaagaaauaaaauccuucuuauggacccagagccugcgacgcgaacuaucaggcuacugcagcaacaucaaacuccaaguagucaaagacgcccaagcccuccuccacggccucgacuuuucugaagucaacaacguccaacgccucaugcgcaaagaacgacgggacgacaacgaccuuaagcgccucagagaccuaaaccaagcggucaacaaccuaguagagcuaaagucaacacaacaaaaauccauacugcgcgucggcacacugaccuccgacgaccuccuaauccucgccgccgaccucgaaaaacugaaaucaaaaguuacccgcacagaacgaccccuauccgccggaguguacaugggcaaccucuccagccaacaacucgaccagcggcgcgcccuccucaacaugauaggcaugucaaacggcaaccaaggaacccgagcaggacgagacggagucgucagagucugggacgucaagaacgcugaacuccuaaacaaccaauucggcaccaugcccucccucacacuagcaugccuaaccaaacaaggccaagucgaccuaaacgacgucguacaagcacucacagaccuaggccucauauacacugccaaguaucccaacacauccgaccucgaccgccuaacacaaucacaccccauccucaacaugauagacaccaagaaauccagcuuaaacaucagcggauacaacuucucacucggcgcagcagucaaagccggcgccugcaugcucgacggcggaaacaugcucgaaacaauaaaagucuccccacaaaccauggacggcauccuaaaaucaauccucaaagucaagaaagcacucggcauguucaucuccgacacacccggcgaacgcaacccauacgaaaacauccuguacaaaaucugccuauccggagacggcuggccauacauagccagcaggacuuccaucacaggucgagcaugggaaaacacagucguagaccuggaaagcgacggcaaaccccaaaaagccgacagcuccaacucaaacaaaagccuacaauccgccggcuucacggcaggccuaaccuacucacaacucaugacccucaaagacgccaugcuucaacuagaccccaacgccaaaacauggauggacauagaaggaagacccgaagaccccguggaagucgcacuauaccagccauccucuggcugcuacauucacuucuuccgagagccaacagaccucaaacaguucaaacaagacgccaaauacucccacggaauagacgucaccgaccucuucgcagcccaaccaggccuaaccuccgccgucauagacgcgcuuccccgaaacaugguaauaaccugccaaggcuccgacgacaucagaaaacuccucgaaucccaaggccgcaaagacaucaaacuuaucgacauagcacucuccaaggccgacucacgcaaguacgaaaaugcugucugggaccaacacaaggaccucugccacaugcacacgggagucgucgucgagaaaaagaaacgaggcggaaaagaagaaaucacgccccacugcgcccucauggacugcaucauguacgacgcagcugucuccggcggccuaaacaccagcguacuacgcgccguacuccccagagacaugguauuccgaaccagcacaccccgaguagucuuauaa

SEQ ID NO: 3222 - RNA, 1710 nt, Artificial Sequence
  derived and/or modified CDS sequence (opt11) from Lassa virus__AIT17169__NP
augagcgccagcaaagagauaaaaucguuccuuuggacacagucacuccgccgcgaacucucaggauacugcuccaacauaaaacuccaagucgucaaagaugcccaagcccuacuccacggccucgacuucagcgagguaucaaacguccaacgccuaaugcgcaaagaacgcagagacgacaacgaccucaaacgccuacgugaccuaaaccaagccgucaacaaccucguagaacuuaaaagcacccaacaaaaauccauccuacgcgucggcacccucacauccgacgaccuacucauccucgccgccgaccucgaaaaacuaaaaagcaaagucauccgcacagaacggccccuaucagcgggagucuacaugggaaaccuaagcagccaacaacuagaccaacgcagagcccuccucagcaugauaggaaugucuuccggcaaccaacgagcacaagccggccgagacggcguaguaagagucugggacgucaaaaacguagaacuacuaaacaaccaauucggcaccaugccaucgcugacccucgccugccugaccaaacaaggccaagucgaccucaacgacgccguucaagcccucaccgaccuaggacuuaucuacacugcaaaguaccccaacaccuccgaccuugaccgucuaacccaaucccaccccauacucaacaugaucgacaccaagaaaagcucccuaaacaucuccgguuacaacuucucacucggagccgcagucaaagcaggcgccugcaugcucgacggcgguaacaugcucgaaacaaucaaagucagcccccagaccauggacggaauccugaaaagcauccucaaagucaagaaagcccuuggcauguucaucucagacacacccggggagaggaaccccuacgaaaauaucuuauacaaaaucugccucucgggugacggauggcccuacaucgcaucaaggaccucaaucacuggacgagccugggagaacaccguaguagaucucgaauccgacggcaaaccccaaaaagcaggcucaaacaacucgaacaaaucccuccaauccgucggcuucacagccggacucacauauucccaacucaugacacucaaagacgcaaugcuacaacuagacccuaaugcaaaaacauggauggacaucgaaggccggcccgaagaccccguugaaaucgcccuuuaccaaccauccuccggcugcuacauccacuucuuccgcgaaccaacggacuuaaaacaauucaaacaggacgccaaauacucacacggcauugacgucaccgaccucuucgccgcccaaccaggccucacgagcgcaguuaucgacgcccucccucgaaauauggucauaaccugccagggaagcgacgacauccgcaaacuucucgaaucccaaggacgaaaagacauaaaacucauagacaucgcgcucuccaaaacagacucccgcaaauacgaaaacgcagucugggaccaauacaaagaccuuugccacaugcacaccggaguaguuguagagaaaaagaaacgaggcgguaaggaagagauaacuccccacugcgcccucauggacugcaucauguucgacgccgccguauccggaggccuaaacaccucaguccuucgcgccguccuaccgcgcgacaugguauuccgcacaucaacaccccgagucguccucuga

SEQ ID NO: 3223 - RNA, 1710 nt, Artificial Sequence
  derived and/or modified CDS sequence (opt11) from Lassa virus__AIT17173__NP
auguccgccucaaaagaaaucaaaucauuccucuggacccagucacuacgacgcgaacuuuccggauacugcagcaacauaaaacugcaagugguuaaagacgcacaagcccuccuccacggccucgacuucucagaaguuagcaacguacagcgccuaaugagaaaagagcgaagagacgacaacgaucuaaaacgacuccgcgaucucaaccaagcggucaacaaccuggucgaacucaaauccacccaacaaaaaucaauuuuacgcgucggcacacuaaccucugacgaccuccucauccuugccgccgaccucgaaaaacucaaaucaaaagucacucgcacagaaagaccccuaagcgccggagucuacaugggaaaccucuccagccaacaacucgaccagcggagagcucugcuaaacaugaucggcaugucaggauccaaccaaggcgcccgagcgggccgagacggcgucguacgaguaugggacgucaaaaacgcagaacuccucaacaaccaauucggaaccaugcccagccucacacuggccugucucacgaaacaaggccaagucgaccuaaacgacgccgugcaagcacugacagaccucggccucauauacaccgccaaauacccaaacaccuccgaccuagaccgacugacccaaagccaccccauacucaacaugaucgacaccaagaaauccucacucaacaucagcggauauaacuucucacucggagccgcagucaaagccggcgcaugcaugcucgacgggggcaacaugcuagagacaauuaaagucucaccccaaacaauggacgguauccucaaauccauccuaaaaguuaagaaagcacuaggcauguucauuucagacgccccgggagaacggaaccccuacgaaaacauucuauacaaaaucugccucucaggcgacggauggcccuacaucgcuagccgcaccucaauaaccggccgggccugggaaaacaccgucguagaccucgagagugacggcaaaccccaaaaagccggcucaaacggcagcaacaaaucccuccaauccgccggauucaccgccggccucacauacucacaacuaaugacacucaaagacgcaaugcuacaacucgacccaaacgccaaaacauggauggacaucgaaggccgacccgaagacccagucgaaauagcccuauaccagcccuccucaggaugcuacauccacuucuuccgagagcccacagaccuaaaacaauucaaacaagacgcaaaauacucccacggcaucgacguaacggaucuauucgcagcccaaccagggcuaaccagcgccguaaucgaugcccucccacggaacaugguaauaacaugccaagguucagacgauaucagaaaacuguucgaaucccaaggcagaaaagacaucaaacuaauagauaucgcccucucgaaaacggacucccgcaaauacgaaaacgcagucugggaccaguacaaagaccuaugccacaugcauaccggcaucgucguagagaaaaagaaaagaggcggcaaagaagaaaucacaccgcacugcgcccucauggacugcauaauguuugacgcugcagucucaggaggacucaacaccucaguucuccgagcaguacuacccagagacauggucuucagaaccagcaccccacgcgucguccuguaa

SEQ ID NO: 3224 - RNA, 1710 nt, Artificial Sequence
  derived and/or modified CDS sequence (opt11) from Lassa virus__AIT17177__NP
augagcgccagcaaagaaaucaaaucguuccuauggacccaaucccuccgcagagaacuaagcggcuacugcuccaacaucaaacuacaagucgucaaagacgcacaagcacuccuacacggccuggacuucagcgaaguaucgaacguccaacgccucaugcgcaaacaaagacgcgacgacaacgaucugaagcgccuccgcgaccuaaaccaagcagucaacaaccucguggaacugaaauccacccaacagaaaagcguccuuagggucggaacccucacaucugacgaccuccugguccucgcagccgaccuagaaaaacuaaaaagcaaggucauccgcacagagcgaccacucuccgcaggcaucuacaugggcaaccucuccucacaacaacucgaccaaagacgggcacuacucaacaugaucggcaugagcggcggcaaccaaggcgcacgcgccggaagagauggagucguccgaguaugggacgucaaaaacgcagaccuccuuaacaaccaauucggcaccaugcccucccuuacccucgcauguuuaacaaaacaaggccaagucgaccucaacgaugucguccaagcacuaaccgaccuuggacuaaucuacaccgccaaauacccgaacaccuccgaccuagaccgccucacacaaucccacccuauccucaaaaugauagacgccaacaaaucuucacuaaacaucucgggauacaacuucagccucggagccgccgucaaagccggcgcaugcaugcucgacggcggcaacaugcuagaaaccauaaaagucagcccccaaaccauggacgggauccuaaagagcauccugaaaguaaagaaaucauuaggaauguucaucuccgacacacccggagaacgcaaccccuacgaaaauauccuuuacaaaaucugccuaucaggggacggcuggccauacauagcaucccgcacaagcaucauaggacgcgcaugggaaaacacagucguagaccuagaauccgacggcaaaccccagaaaaccggcagcaacaacagcucuaaaagccugcaaagcgccggcuucgccgccgggcuuacauacucacaacuaaugacccuuaaagacgcaaugcuacaacucgaccccaacgccaagacauggauggacauagaaggccgccccgaagaccccguagaaaucgcccuuuaccaaccuagcagcggaugcuacauccacuucuuccgcgagcccacagaccuaaaacaauucaaacaagacgccaaauacagccacggcaucgacgucacggaccucuuugcggcccagcccggccucacguccgccguaaucgaagcgcuaccgcgcaacaugguuauaaccugccaaggcagcgacgacauccgaaaacuccucgaaucccaaggaagaaaggacaucaaacuuaucgacaucgcccuguccaaaaccgacucccgaaaauacgaaaacgcugucugggaccaauacaaagaccucugccacaugcacaccggcaucguggucgaaaagaagaaacgcggaggaaaagaagaaauaacuccccacugcgcacuaauggacugcauaauguucgacgcggccgucuccggcggacucaacacccucguccuccgagcgguacuaccacgagacauggucuuccgcaccuccacgcccaaagucguacucuaa

SEQ ID NO: 3225 - RNA, 1710 nt, Artificial Sequence
  derived and/or modified CDS sequence (opt11) from Lassa virus__AIT17181__NP
augagcgccuccaaagaagucaaauccuuccuguggacccaaucccuccgccgagaacugucgggauacugcuccaacaucaaacugcaaguagucaaagacgcacaagcacuccuacacggccucgacuucuccgaaguaagcaacguccaaagacucaugcgaaaacaacgcagagacgacaacgaccuaaaaagacugcgcgaccucaaccaagcagucaacaaccucguagagcucaaaagcacacaacaaaaauccguacuccgagucggcacccuaaccagcgacgaccuccucguccuagcggccgaccuagaaaaacucaaaagcaaagucauccgcaccgaaaggccccucuccgccggaguuuacauggggaaccuuuccucacaacaacuugaccaacgucgugcacuccuaaacaugaucggcauguccggcggaauccagggcacccgaaccggacgagacggaguaguccgcgucugggacgucaaaaacgccgacuuacuaaacaaccaguucgggacaaugccaucacucacccucgccugccucacuaaacaagggcaaguggaccuaaacgacgucguacaagcccucacugaccuaggccucaucuacaccgcaaaauaccccaacgccucggaccucgaccgccucacacaaagccaccccauacuaaacaugaucgacacaaagaaauccagccucaacaucuccggcuacaacuucucacuaggcgccgccgucaaagcaggcgccugcaugcuagacggcggaaacaugcuagaaaccaucaaagucagcccccaaacaauggacggaauccuaaaaucaauccuuaaagucaaaaagacacucggaauguucaucucagacacaccaggcgaacgaaacccauacgaaaacauacuauacaaaaucugccuaucgggagacggguggccuuacaucgccucccgaaccuccauaaccggcagagcgugggaaaacacaguugucgaccuagaauccgacggcaaaccacaaaaagccggcucaaacaacagcaacaaaucccuccaaucugccggcuucgccgcaggacuuaccuacucccaacucaugacccucaaagacgccaugcuacaacuagacccgaacgccaaaaccuggauggacaucgaaggccgacccgaagaccccgucgaaaucgcacucuaccaaccguccuccggcugcuacauccacuucuuccgcgagccaaccgaccucaaacaauucaaacaggacgccaaguacucccauggcaucgacgucacagaccuauucgcagcccaaccuggacucacaagcgccgucaucgaagcacugccacgcaacaugguaauaacaugccaaggcucagacgacauaaagaaacuccucgaaucacagggccgaaaagacauaaaacuaauagacauagcccucuccaaaacugacagucgaaaauacgaaaacgccgucugggaccaguacaaagaccuaugccauaugcacacaggaguagucgucgagaaaaagaaaaggggaggaaaagaagaaaucacaccccacugcgcacuaauggacugcaucauguucgacgcagccgucagcggcggccuaaacacccuuguccuccgcgccguccucccccgagacauggucuuccgaaccagcaccccaagaguuguccuauga

SEQ ID NO: 3226 - RNA, 1710 nt, Artificial Sequence
  derived and/or modified CDS sequence (opt11) from Lassa virus__AIT17185__NP
augagcgccuccaaagaaauaaaaaguuuccuauggacccagagccuaaggcgcgaacuauccggcuacugcucaaacauaaaacugcaggucgucaaagacgcccaagcccuacuccacggccuagacuucucagaaguaagcaacguccaacgccuaaugcgcaaacaaagacgggacgacggagaccuaaagcgacuccgagaccuuaaccaggccgucaacaaccucgucgaacuaaaaucuacacaacaaaaauccguccuccgcguaggaacccucacuucagacgaccuccucauacucgccgccgaccucgagaaacucaaaucaaaaguuacaagaaccgaaagaccacucagcgccggaguauacauggggaaucugucaucacaacaacucgaccaaagacgcgcacuccuaaacaugauuggcauguccggcggcaaccgcggcgcccgaaccggcaaagacggagucguccgcaucugggacgucaaaaacgccgaccuacucaacaaccaauucggcaccaugcccagccuaacacucgcaugccucaccaaacagggacaagucgaccuaaacgacgucguacaagcccuaaccgaccucggacuaauuuacacagcuaaauaccccaacaccuccgaucuagaccgccuaacccaaucccacccgauccugaacaugaucgacaccaacaaaucaucacucaacauauccggcuacaacuucuccuuaggcgcagcugucaaagccggcgccugcaugcuagacgggggaaacaugcucgagacaaucaaagucucaccccaaacaauggacggcauccucaaauccauccuaaaagucaagaaaucccuggguauguucaucuccgacacccccggcgaacgcaaccccuacgagaacauccuauacaaaauaugccucuccggcgacggcuggcccuacauagccucccgaaccuccaucaccggucgcgccugggaaaacacagugguagaccuggaauccgacgaaaaaccccaaaaagcagguagcaacaacuccaacaaaagccuccaaucgacuggcuuuaccgccggacucaccuacagucaacucaugacccucaaagacgccaugcuacaacucgaccccaacgcgaagaccuggauggacaucgaagggcgcccagaagaccccguagaaauagcacucuaccaacccuccucaggcugcuacauccacuucuuccgagaacccaccgaccucaaacaauucaaacaagacgccaaauacucccacggcaucgacgucacagaccucuuugccgcccagccaggccugacauccgccgucaucgauacacucccacgaaacauggucauaacaugccagggcagcgacgacaucagaaaacuucuagaaucacaaggacgcaaagacaucaaacuaauagacaucgcccucuccaaaaccgacucacgcaaauacgaaaaugccgucugggaccaauacaaagaccucugccacaugcacaccggcguagucgucgaaaagaagaaacgaggcggaaaagaagaaauaacaccccacugcgcgcucauggacugcauaauguucgacgcugcugucagcggcggccucaacgcaagcguccuccgagcaguacuaccgcgcgacauggucuuccgaaccucaaccccacgcguuguccucuaa

SEQ ID NO: 3227 - RNA, 1710 nt, Artificial Sequence
  derived and/or modified CDS sequence (opt11) from Lassa virus__AIT17189__NP
auguccgccagcaaagagauaaagucauuccuuuggacccaaucccuccgucgcgagcuaucaggguacugcucaaacauaaaacuccaaguaguaaaagacgcccaagcccuccuccacggccuagacuucuccgaaguaucaaacguacagagacuaaugcgcaaagagagacgagacgacaacgaccugaaacggcuccgcgaccucaaccaagcggucaacaaccucgucgaacugaaaucuacccaacaaaaauccguccuccgagucgguacccucaccuccgaugaccuucucauccucgccgccgaccuagaaaaacucaaauccaaagucaccagaaccgagcgaccucucucagccggcguuuacauggguaaccucuccucgcaacaacucgaccagagacgagcccuacuuagcaugaucggcauguccggcgguaaccaaggcgcucgcaccggacgugacggcguaguucgagucugggacgucaaaaacgccgaacugcuuaacaaccaguucgggaccaugcccucccucacacucgcgugccucaccaaacaaggacaaguugaccuaaacgacguaguacaagcccuaacggaccucggacucaucuauaccgccaaauaccccaacaccuccgaccucgaccgccucacccaaucccaccccauccuaaacaugaucgacaccaagaagucaagccucaacaucuccggcuacaacuucuccuuaggagccgccgucaaagcaggggccuguaugcucgacggcggcaacauguuagaaaccaucaaagucucaccccaaaccauagacggcauauuaaaaagcauacuuaaagugaagaaagcacucggcauguucaucucagacacgcccggagaaagaaacccauacgaaaacauuuuauacaaaaucugccucuccggcgacggcuggccauacaucgcauccagaaccuccaucaccggccgcgccugggaaaauaccgucgucgaccucgaaagcgacggcaaaccccaaaaagccggcucaaacaacagcaacaaaucccuccaauccgcaggauucaccgccggccucaccuacucacaauuaaugacccuaaaagacgccaugcuccaacucgaccccaacgccaaaaccuggauggauaucgaaggaagaccagaagacccaguagagaucgcgcuauaccaaccauccagcggaugcuacauccacuucuuccgcgaaccaaccgaccucaaacaguucaaacaagacgccaaauacagccacggcaucgacgucacagaccuauucgccgcacaaccaggccuuacauccgccgucaucgaugcacuuccacgcaacauggucauaacaugccaaggaagcgacgacauacgcaaacuccucgaaucccagggacgcaaagacauaaaacucaucgauauagcgcuguccaaaaccgacucacgcaaauacgaaaacgcaguaugggaccaauacaaagaccucugccacaugcacacaggcgucgucguugagaaaaagaaacgcggcggaaaagaggagauaacaccccacugugcacucauggacugcauaauguucgacgcagccguaagcggaggacuaaacucgcuaguccuacgagcaguauuaccccgagacauggucuuccgcaccuccacuccccgcgucguacucuaa

SEQ ID NO: 3228 - RNA, 1710 nt, Artificial Sequence
  derived and/or modified CDS sequence (opt11) from Lassa virus__AIT17193__NP
augagcgccagcaaagaaauaaaaucauuccuauggacucaaucgcucaggagagagcucucgggguacugcucuaacaucaaacugcaaguagucaaagacgcccaagcacuacuccacggcuuagauuucucagagguguccaacguccaacgccugaugagaaaagaacgccgagacgacaacgaccucaaacgacuccgcgaccuuaaucaagccguaaacaaucuugucgaacucaaauccacacaacaaaaaucaguacucagagucggaacccuaaccuccgacgaccuacuaauacuugccgccgaccucgaaaaacucaaaucaaaaguaacacgcaccgagcgcccgcucuccgcaggaguauauaugggcaaccuaagcucgcaacaacucgaccaacgccgagcacuccuauccaugauaggaaugucaggcggcaaccagggcgcacgaaccggacgggacgggguaguccgagucugggacgucaaaaacgcagaacuacuaaacaaccaauucggaaccaugcccucacucacacucgcaugccuuaccaaacaaggccaaguagaccucaacgacgcagugcaagcccucacagaccuaggccucaucuacaccgcuaaauaccccaauaccagcgaccucgacagacuaacccaaucacaccccauacugaacaugaucgacaccaagaaauccucgcucaacaucagcggcuacaacuucuccuuaggcgccgccgucaaagcaggcgcaugcaugcucgacggcggcaauaugcuagaaaccaucaaagucuccccgcaaacaauggacggaauccuaaaaucaauccucaaaguaaagaaagccuugggcauguucaucagcgacacaccaggcgaacgcaacccauacgaaaacauccucuacaaaaucugccucuccggagacggcuggcccuauauagccucacgcaccucaaucacuggccgcgcaugggaaaauaccgucgucgaccucgaaagcgacggcaagccacaaaaagcagggaacaacaacucuaacaagucccugcaguccgcaggcuuuacagccggccucaccuacucccaacucaugacccugaaggacgcaaugcuccaacucgaccccaacgcaaaaacauggauggacaucgaaggaagaccagaagacccuguagaaauagcccuguaccaaccaucaucgggcugcuacauacacuucuucagagaaccaaccgaccugaaacaauucaaacaagacgccaaauacucacacggaauagacgucaccgacuuauucgccgcgcagccaggccucacauccgcugucaucgacgcacuaccccgaaacauggugaucacaugccaaggaucagacgacauccgaaaacuccuagaaagccaaggacgcaaagacaucaaacuaaucgacauagcccuauccaaaaccgacagccgcaaauacgaaaacgcagucugggaccaauacaaagaccucugccacaugcacaccggcgucgucgucgaaaagaagaaacgcggaggcaaagaagagauaacaccccacugcgcccugauggacugcaucauguuugacgccgcagucucaggaggacucaacucccuaguacuccgagcaguccuaccacgagacauggucuucagaaccuccacaccacgcgucgugcuguaa

SEQ ID NO: 3229 - RNA, 1710 nt, Artificial Sequence
  derived and/or modified CDS sequence (opt11) from Lassa virus__AIT17197__NP
augagcgcaucaaaggaaauaaaguccuuccucuggacccaaucccuccgucgagaacuauccggcuacugcucuaacauaaaacuccaaguagucaaagacgcgcaagcacuccuccacggccuagacuucucagaagucuccaacguccaacgccucaugagaaaagaacgccgcgacgacaacgaccuaaaacgccuccgggaccucaaccaggccgucaauaaccucguugaacucaaaagcacgcaacaaaaaucaauccuacgcgucggcacccucacauccgacgaccuacucauccucgcagcagaccucgaaaaacuaaaguccaaaguaaucaggacagagcgcccccucuccgcaggcguuuacaugggcaaccuuucccuacaacaacuagaccaacgacgcgcccuccucaacaugaucggaaugucaggcucaaaccaaggaguccgcgccgggcgagacggcguagucagagucugggacgucaaaaacgcggaacuccuuaacaaccaauucggcaccaugcccucgcugacgcuggcaugccucacaaaacaagggcaagucgaccucaacgacgcuguacaagcacucaccgaccugggacucaucuacacagccaaauaccccaacaccucggaccuggacagacuuacccaaucccacccaauccugaacaugauagacaccaagaaauccucccugaacaucagcggcuacaacuucucccuaggcgccgcagucaaagcaggcgccugcaugcuagacggaggcaacauguuagaaacuaucaaaguaucaccccagaccauggacggaauccucaaauccauccugaaagucaagaaagcccuaggcauguucaucuccgauaccccaggggagagaaaucccuacgaaaacauccucuacaaaaucugccuaucgggcgacggcuggcccuacaucgccuccagaacguccaucacaggccgagccugggaaaacacagucgucgaucuggaaagcgacggcaaaccacaaaaagccggcucgaacggauccaacaaaucacuccaaagcgccggcuucaccgcaggccuaaccuacucccagcugaugacccucaaagacgccaugcuccaacucgaccccaacgccaaaaccuggauggacaucgaaggaagaccagaagacccgguugaaauagcgcuauaccaacccucauccggcugcuacauccacuucuuccgggaaccaaccgaucucaaacaauucaaacaagacgccaaauacucacacggcauagacguaaccgaccuauucgccgcacagcccggacucacauccgccgugaucgacgcccuaccgcgcaacauggucauaacuugccaaggaagcgacgacauacgcaaacuccuagaaucccaagggcgcaaggacauaaaacucaucgacaucgcacucuccaagacagacucgcgaaaauacgaaaacgcaguuugggaccaauacaaagaccucugccauaugcacaccgggaucguagucgaaaagaaaaagcgaggcggaaaggaagaaauaacaccccacugcgcacucauggacugcauaauguucgacgccgccgucagcggaggacucaacaccucaguccuccgcgccguacucccccgcgacauggucuucagaaccucaaccccacgcguaguacuauaa

SEQ ID NO: 3230 - RNA, 1710 nt, Artificial Sequence
  derived and/or modified CDS sequence (opt11) from Lassa virus__AIT17201__NP
augagcgcaagcaaagaaaucaagucauuccucuggacccaaucguuacgcagagaacuguccggauacugcuccaacauaaagcuacaagucgucaaagacgcccaagcccugcuacacggucucgacuucuccgaagucucaaacguccagcgccuuaugcgaaaagaacgacgcgacgacaacgaccucaaaagacuacgcgaccuaaaccaagccgucaacaaccucgucgaacugaaaagcacucaacaaaaauccauccuacgcgucggcacgcucacuagcgacgaccuccuaauccucgccgcagaccuagaaaaacuaaaaagcaaagucacccguaccgaacgcccccuguccgccggcguguacaugggcaaccucuccucacaacaacucgaccaacgaagggcccugcuaaacaugauagguauguccggaagcaaccaaggcgcaagagccggccgcgacggcgucguccgcgucugggacgucaaaaacgccgaacugcucaacaaccaauucggaacaaugcccucccuaacccucgcuugccucacaaaacagggccaaguagaccuuaacgacgcaguccaagcacucacagacuuagggcucaucuacaccgcgaaauacccaaacacaagcgaccuggaccgccucacccaaucccaccccauucuuaacaugauagacacaaaaaaaagcagccuaaacaucucaggguacaacuucucccucggcgcagcaguaaaagccggugccuguaugcuugacggaggcaacaugcucgaaaccauaaaagucuccccccaaaccauggacggcauacucaaaucaauccucaaagucaaaaaagcccuuggcauguucaucucagacgcccccggcgagagaaaccccuacgaaaacauccucuacaaaaucugccuauccggagauggcuggcccuauauagcaagccgaaccucaauaacaggccgcgcuugggaaaacacagucguagaccucgagagcgacggcaaaccacaaaaagccggcucaaacggcucuaacaaaagccuccaaagcgccggauucaccgcuggccuaaccuacucccaauugaugacccucaaagacgccaugcuccaacucgacccaaacgcgaaaaccuggauggauauagagggccgcccagaagaccccguugagauagcccuauaccaaccauccagcggcugcuacauccacuucuuccgcgaacccacagaccuaaaacaguucaaacaagacgccaaauacagccacggcauagacgucacggaccucuucgcagcacaacccggucuaacauccgccguaaucgacgcccucccacgaaacaugguaaucacuugccaaggaucagacgacaucaaaaaacucuucgaaucacaggggagaaaagacaucaaacucauagacaucgcccucuccaaaacagacagccggaaauacgaaaacgcaguaugggaccaauacaaagaccucugccacaugcacacgggaaucgucgucgaaaaaaaaaaacgcggcggcaaagaggaaauaacgccccacugcgcucucauggacugcauuauguucgacgcagccgucagcggaggacuaaacaccuccguacuaagggcaguccucccccgcgacauggucuuccgcaccuccacaccccgagucguacucuga

SEQ ID NO: 3231 - RNA, 1710 nt, Artificial Sequence
  derived and/or modified CDS sequence (opt11) from Lassa virus__AIT17205__NP
auguccgccagcaaagaaauaaaaucauuccuguggacccaaagccuccgccgcgaacucucuggcuacugcuccaacaucaaacuucaggucgucaaagacgcccaagcccuccugcacggccucgacuuuuccgaagucucaaauguccaaagacuaaugcgaaaagaaagacgcgacgacaacgaccugaaacgacucagagaccucaaccaggcagucaacaaccucgucgaacugaaauccacccaacaaaaaucaauccuccgcgucggaacccucaccuccgacgaccuccuuauacuagccgcagaccuagaaaaacucaaaagcaaaguaacccguacagaacgaccacuaagcgccggcguauacaugggcaacuuaucaucccaacaacucgaccaacgcaaagcccuauuaaacaugaucggcauguccggaaguaaucaaggcgcccgaaucggacgcgacggcguaguccgaguaugggacguaaagaacgccgaacuccugaacaaccaauucgggaccaugccaagccucacccucgcaugccucaccaaacaaggacaaguagaccucaacgacgcaguacaagcccuaacagaucuaggacucauauacaccgccaaauacccaaauaccucagaccucgaccgacuaacacaaucacacccaauccucaacaugaucgacaccaagaaauccagccuaaacauuuccggcuacaacuucucacucggcgccgccgugaaagccggcgcaugcaugcucgacggaggcaacaugcuagaaaccauuaaagucucaccccaaacaauggacggcauccucaaaagcauccucaaagucaagaaagcccuaggcauguucaucagcgacacccccggcgaacgcaacccauacgaaaauauccucuacaaaauaugccuauccggcgacggauggcccuacauagcaucccgaacaucuaucaccggcagagcaugggaaaacacaguagucgaccuagaaucagacggcaaaccccaaaaagccggauccaacuccucaaacaaaagccuacaaucagccggccucacagccggccucaccuacucccaacuaaugacccugaaagacgcaaugcuacaacucgaccccaacgcaaaaaccuggauggacauagaaggccgacccgaagacccagucgaaaucgcacuauaccaaccauccucaggaugcuauauccacuucuuccgcgaacccaccgaccucaaacaguuuaaacaagaugccaaauacucccacggcauagacgucacagaccuauucgcggcccagcccggccugaccagcgcaguaaucgacgcccucccacgcaaucuaguuaucacaugucaaggcucagacgacauccgaaaacuccuagaaucacagggccgcaaagacauaaaacucaucgacaucgcccuauccaaaaccgacucccgaaaauacgaaaacgccgucugggaccaauacaaagaccucugccacaugcauaccggaaucguagucgagaaaaagaaacgcggaggaaaagaagaaaucaccccucacugcgcucuaauggacugcauuauguucgacgccgccgucucgggcggccuaaacgccuccguccuacgcgccguccucccccgcgacauggucuuccgcaccuccacaccccgggucguacucuag

SEQ ID NO: 3232 - RNA, 1710 nt, Artificial Sequence
  derived and/or modified CDS sequence (opt11) from Lassa virus__AIT17209__NP
augagcgcgagcaaggaaauaaaaucauuccuuuggacccaaucacugagaagagaacuauccggcuacugcucaaauaucaaacuccagguagucaaagacgcccaagcacuccuacacggccucgacuucuccgaaguauccaacguccaacgccuaaugcgcaaagaacgccgcgacgacaacgacuuaaaacgccuccgagaccucaaucaagcaguaaacaaccuagucgaacuaaaaagcacgcaacagaaaucuauucuacgcguaggcacacucacaucagacgaccuccuaauccucgccgccgaccuagaaaagcucaaaucaaaagucacacgcacagaacgaccgcucucagccggcgucuacaugggcaaccuaagcucucaacagcucgaucagaggcgcgcccuacucuccaugauaggaaugagcggcggcaaucaaggcgcacgagcaggccgagacggagucgugcgcgucugggacgucaaaaacgccgaacuccuaaacaaccaauucggcaccaugccaucccucacccucgccugccucaccaaacaaggccaaguagaccuaaacgacguaguccaagcccucacggaccucggacucaucuacaccgccaaguaccccaauaccagcgacuuagaccggcucacccaaucccaccccauccucaacaugaucgacaccaagaaaucaucacuuaacaucuccggcuacaacuucucacucggcgccgcggucaaagccggcgccugcaugcucgacggcggcaacaugcuggaaaccaucaaaguaucaccccaaacgauggacggcauccuaaaaagcauccuaaaagucaaaaaggcacucggaauguucaucagcgacacccccggcgaacgcaacccauacgaaaacaucuuauacaaaaucugccucuccggcgauggcuggccauacauagccucccgcaccucaaucacaggccgagccugggaaaacaccguagucgaccucgaauccgacggcaaacuacagaaaacaggcuccaacaacucaaacaagucccuccaauccgccggauuuaccgccggacuaacauacagccaacucaugacccuaaaagacgccaugcuacaacuagaccccaacgccaaaaucuggauggacaucgaaggccgcccugaagacccugucgaaaucgcccucuaccaaccaagcucaggcugcuacauccacuucuuucgugaaccaacagacuuaaaacaauucaaacaagaugcaaaauacagccacggaauagacgucacagaccucuucgccgcacaacccggccugaccagcgccguaaucgacgcacucccccgaaacaugguaauaaccugucaaggaagcgacgacauccgaaaacuacuagagucccaagggagaaaagacauaaaacucauagacaucgcucuaaacaaaaccgacucaagaaaauacgaaaacgcagucugggaccaauacaaagaccuaugccacaugcacaccggcgucguaguagagaaaaagaagaagggcggaaaagaagaaaucaccccacacugcgcccucauggacugcaucauguuugacgccgccgucagugggggccuaaacaccagcguacuccgcgcugucuuaccccgagacaugguguuccgcaccuccaccccgcgcguaguacucuaa

SEQ ID NO: 3233 - RNA, 1710 nt, Artificial Sequence
  derived and/or modified CDS sequence (opt11) from Lassa virus__AIT17211__NP
augagcgcaucaaaagaaaucaaauccuuccuauggacccaaagccuccgccgcgaacucucaggauacugcucaaauauaaaacuacagguagucaaagacgcccaagcccuccuacacggacuagacuucuccgaaguuuccaacguccaacgacucaugcgcaaagaacgucgagacgacaacgaccucaaacgucuucgcgaccucaaccaagcagucaacaaccucgucgaacucaaauccacccaacagaaaaguauacuccgcguuggcacccucaccagcgaugaccuucuaauccucgccgccgaccuagagaaacucaaaucuaaaguaaccagaaccgaaagaccccuaagcgccggagucuacaugggcaaccucucaucccaacaacucgaccaacgccgagcccuccugaacaugaucggaaugagcggaggcaaccaaggcgcccaagccggacgagacggcgucguacgcgucugggacgucaaaaacgccgaacuccugaacaaucaauucggcaccaugccaucccucacacucgccugccucaccaaacaaggccaagucgaccucaacgacgccguccaagcccuaacagaccuaggccuaaucuacacagcuaaauaccccaacacauccgaccucgaccgccucacccaaucacaccccauccuuaacaugauagacaccaagaaaucaucacucaauauaaguggcuauaacuuuucucucggcgccgccgucaaagcaggcgcuugcaugcuggacggaggaaacaugcuagaaaccaucaaagucucaccccaaacuauggauggcauccucaaauccauccucaaagucaaaaaggcccuaggcauguucaucuccgacaccccaggcgaacgcaaccccuaugaaaacauccucuacaaaauuugccucucgggagacggcuggcccuacaucgcaagccgaaccuccaucacaggacgugccugggaaaacaccgugguugaccucgaauccgacggcaaaccccaaaaggcaaauuccaacucauccaacaagucccuacaauccgcaggcuuuaccgccggcuugaccuacucccaacucaugacccucaaagacgccaugcuccaacuagaccccaacgccaaaaccuggauggacaucgaaggccgacccgaagacccagucgaaaucgcccucuaccaacccucaaguggaugcuacauccacuucuuccgcgaacccacagaccucaaacaauucaagcaggacgccaaauacagccacgggauagacguaacagaccucuucgccgcacaacccggccuaaccuccgccguaaucgaugcccuuccaagaaacauggugauaaccugccagggcucagacgacauccgcaaacuccucgaaucccaaggacgaaaagacaucaaacugaucgauaucgcccucagcaaaacggauagccgcaaauaugaaaaugcaguuugggaccaauacaaggacuuaugccacaugcacacaggcaucgucguagaaaagaagaaacguggcggaaaagaggagauaaccccacacugcgcccucauggauugcauuauguucgacgccgcagucagcggaggccucaacacuucuguacuccgcgcaguccucccccgcgacaugguauuccgcaccagcacccccagagucguccucuaa

SEQ ID NO: 3234 - RNA, 1710 nt, Artificial Sequence
  derived and/or modified CDS sequence (opt11) from Lassa virus__AIT17213__NP
augagcgccuccaaagaaauaaaaucauuccucuggacccaaucccucagaagagaacucgccggauacugcucaaacaucaaacuacaagucgucaaagacgcccaggcacuccuacacggccucgacuuuucagaagucagcaacguccaacgccuaaugcggaaagaacgccgagaugacaaugaccucaaaagacuccgcgaccucaaccaagccguaaacaaccucgucgaacuaaaauccacccaacaaaaaucagucuugagaguaggcacccucacauccgacgaccuccuaauacucgcggcagaccucgaaaaacugaaaagcaaagucauucggaccgaacgcccccucucagccggggucuacaugggcaaccugucgucacaacaacucgaccaacgcagagcacuccuaaacaugaucggcauguccggguccaaccaaggaguccgcgcgggacgggacggcguaguccgagucugggacgucaaaaacgccgaacuacucaacaaccaauucggcacaaugccaucacucacgcucgccugccuaaccaagcaaggacaagucgaccugaacgacgcaguacaagcacucaccgaccucggccucaucuacacagcgaaauauccaaacacaagcgaucucgaccgccucacccaaucacacccaauucuaaacaugauagacaccaagaaauccagccugaacaucuccggguacaacuucucccucggcgccgccgucaaagccggcgccugcaugcucgacggcggcaacaugcuugaaacgaucaaagucucaccacaaaccauggacggcauauugaaaaguauccuaaaaguaaagaaagcacuuggcauguucauaagcgacaccccaggcgaaaggaacccauacgaaaacauacuauacaaaauaugccuauccggcgacggcuggcccuacauagccagccgcacaucaauaaccggacgcgcaugggaaaacaccguuguagacuuagaaagugacggcaaaccacaaaaagccggauccaacggcuccaacaaaagccuccaauccgcaggauucaccgcaggccugacguauucccaacucaugacccuaaaagaugcaaugcuccaacucgaccccaaugccaaaaccuggauggacauagagggcagaccagaagaccccguagagaucgcccuuuaccagccauccagcggcugcuacauacacuucuuccgcgaacccacggaccucaaacaguucaaacaagacgcaaaauacagccauggcaucgacgucaccgaccucuuugccgcacaacccggacucaccagcgcggucauagacgcacuaccccgcaacaugguaauaaccugccaaggcagcgacgacauccgaaaacuccucgaaucgcaaggacgaaaagacauuaaacuaaucgacaucgcacucucaaaaacagacucacggaaguacgaaaacgccguaugggaccaauacaaagaccuaugccacaugcacaccggaauaguagucgaaaagaagaaacgcggaggcaaagaggaaaucaccccacacugcgcccucauggacugcaucauguucgacgcagccgucaguggaggacucaacaccucaguccuacgcgccguacucccccgagacauggucuuccggaccagcacaccccgcgucguccucuaa

SEQ ID NO: 3235 - RNA, 1710 nt, Artificial Sequence
  derived and/or modified CDS sequence (opt11) from Lassa virus__AIT17217__NP
auguccgcaagcaaagaaaucaaaucauuccucuggacacaaagucuccgccgcgaacucagcggcuacugcagcaacaucaaacuacaaguagucaaagacgcccaagcccuccuccacggccucgacuucagcgaaguaagcaacguccagcgacucaugcgcaaagaaagacgagacgacaacgaccuaaaaagacuccgagaccucaaccaagccgucaauaaccuagucgaacucaaaucaacgcaacaaaaaucaauacuccgaguuggaacgcucacaagcgacgaccuacucauacuagccgcagaccuagaaaaacucaagucaaaaguaaccagaacagaacgcccacucuccgccggcguauacauggggaaccucuccucacaacaacucgaccaaagacgagcccuccuaagcaugaucggaaugucguccgggguacaaggcgcccgagcaggcagagacggaguaguacgagucugggacgucaaaaacgccgaacuccucaacaaccaauucggcaccaugccaagucucacccuggccugccucacaaaacaaggacaagucgaccucaacgacgucguacaagcacuaacagaccugggccucaucuacacagcuaaauaccccaacaccagcgaccucgacagacucacacaaucccacccuauccucaacaugaucgacacaaagaaauccucacucaacauaagcggcuacaacuucagucucggcgcagcagucaaagccggagcuugcaugcucgacggcggcaacaugcucgaaaccaucaaagucucuccccaaacaauggacggcaucuuaaaauccauacucaaaguuaagaaagcccucggcauguucauaucagaaacacccggcgagcgcaaccccuacgaaaacauccuauacaaaaucugccuauccggcgacggauggcccuacaucgcauccagaacgucgaucaccggaagggccugggaaaacacugucgucgaccuagaauccgacggaaaaccacaaaaagcuggcucaaacaacagcaacaaaagccuccaaagcaccggguucgcagccggccucaccuacucucagcuaaugacacugaaagacgcaaugcuccaacucgacccaaacgccaagacauggauggacauugagggccgcccagaagaccccgucgaagucgcucucuaccaaccauccucaggcugcuacauccacuucuuucgcgaaccuacggaccucaaacaauucaagcaagacgcaaaauacucccacggaauagacgucaccgaccucuucgcagcccaacccggacuaaccucagcugucaucgacgcacucccgcgcaacaugguaauaacaugccaaggcagcgacgacaucaaaaagcuccucgaaagucaaggacgcaaggacauaaaacuaauagacaucgcccucucaaaaacggacucccgaaaauacgaaaacgccgucugggaccaguacaaggaccuaugccacaugcacacaggaguaguuguagaaaagaagaaacggggaggaaaagaagagaucacaccccacugcgcccuaauggacugcauuauguucgacgcggcaguaucaggcggacugaacaccagcguccuccgcgccguacuaccgcgcgacauggucuuccgaaccuccacaccccgcguaguccuauga

SEQ ID NO: 3236 - RNA, 1710 nt, Artificial Sequence
  derived and/or modified CDS sequence (opt11) from Lassa virus__AIT17225__NP
augucagccucaaaggaaaucaagucguuccuauggacccaaucccuccgccgugaacuauccggcuacugcucuaacauaaaacuacaagucgucaaagacgcccaagcccuucuccacgggcucgacuucagcgaagucagcaacguccaaagacugaugcggaaacagagacgcgacgacaacgaccuuaaacgccuaagagaccucaaccaagccgucaauaaccucguagaacugaaauccacccaacagaaaagcguucuaagagucggcacacuaacaagcgacgaccuccuaguacuugccgccgaccucgaaaaacucaaaagcaaggucaccaggacggaacgcccccuaucugccggcguauacaugggcaaccucucaagccaacaacuggaccaacggcgcgcucuacugaacaugauaggaauguccggcggcaaccaaggcgcacgcgccggaaacgacggcgugguaagggucugggacgucaaaaacgcagaccuccuaaacaaccaguucggaacaaugccgagccucacacuggccugccucaccaaacaaggccaaguagaccucaacgacguaguacaagcacuaacagaucuaggccucaucuacaccgccaaauaccccaacaccagcgaccucgaccgacuaacccaaucacacccaauacugaacaugauagacaccaaaaagagcucacuaaacauaagcgguuacaacuucucacuaggcgccgccguaaaagccggcgcaugcaugcucgacggcgggaacaugcucgaaaccauaaaaguuucaccccaaaccauggacggcauccucaaguccauacugaaggucaaaaaggcacugggcauguucaucucagacacgcccggagaaagaaacccauacgagaacauccuuuacaaaaucugccuaagcggcgacggauggccguacaucgccucgcgcacauccauaaccggcagagcaugggaaaacaccguaguagaccucgaaucagacggaaaaccgcagaaaaccgguaacaacagcucaaacaaaucacuacaauccgccggcuucaccgccggacuaacguacucccaacucaugacccugaaagacgccaugcuacaacucgaccccaaugcaaaaaccuggauggacaucgaaggccgacccgaagaccccgucgaaguagcccuauaccaacccucaucaggcugcuacauucacuuuuuccgcgaaccaacagaccuaaaacaauucaaacaagacgcaaaauacagccauggcaucgacgucaccgaccucuucgccgcccaacccggccucacuagcgccgucaucgaagcccuaccgcgaaacaugguaaucacuugccaagguucagacgacauccgcaagcuccucgagucacagggacgaaaggacaucaaacucaucgacaucgcccuguccaaaaucgacuccagaaaauacgaaaacgccguaugggaccaguacaaggaccucugccacaugcacacgggaguagucgucgagaaaaagaaacgcggcggcaaggaagaaaucacaccccacugcgcccuaauggacugcaucauguucgacgcagcggucagcggcggccucaacacccuaguacuccgcgcgguccuaccaagagacauggucuucagaaccucaacccccaaaguuguccucuag

SEQ ID NO: 3237 - RNA, 1710 nt, Artificial Sequence
  derived and/or modified CDS sequence (opt11) from Lassa virus__AIT17229__NP
augucagcuucaaaagaaauaaaaucauuccuauggacccagagccuacgccgcgaacucucaggauacugcuccaacaucaaacuccaagucguaaaagacgcccaagcacuccuccacggacucgacuucucagaaguuucaaacguccaacgacugaugcgcaaagaaagaagagacgacaacgaccucaaacgacuccgagaccuaaaucaagcuguaaacaaccucgucgaacuuaaaagcacccaacagaaaucaguacuccgagucggcacccuaaccucagaugaccugcucauccuagccgcagaccucgaaaaacucaaauccaaaguaauacgcacagaacgaccacucucugccggaguuuacaugggcaaccucucuucccagcaacuggaccaacgucgagcacuccuauccaugaucggcaugagcggcggaaaccaaggcacccgcgccggccgcgacggugucguccgcguuugggacgucaaaaacgcagaacuacucaacaaccaauucggcaccaugcccucccucacccucgccugccuuacaaaacagggccaagucgaccucaacgacgccguccaagcccuaaccgaccucggccuaaucuacaccgcaaaauacccuaacaccagcgaccucgaccgccucacccaaucacaccccauucucaacaugauagauaccaaaaagucaagccucaacaucucaggauacaacuucagccuaggcgccgcggugaaagccggagccuguaugcucgacggaggcaacaugcuggaaaccauaaaagucucgccccagacgauggacggcauccugaaauccauccucaaagucaagaaagcccucggcauguucaucuccgacaccccaggcgaacgcaacccauacgagaacauccuauacaaaaucugccuauccggugacggauggccauacaucgcaucacggaccagcauaaccggucgagccugggaaaacaccguagucgaccuggaaucagacggaaaaccccaaaaagccgggucuaacaacuccaacaagucucuccaauccgcaggcuuuaccgccggacucaccuacucccaacuuaugacacucaaagacgccaugcuccaacucgaccccaacgcaaaaaccuggauggacaucgaaggacggcccgaagacccagucgaaauagcccuuuaccaacccucaagcggcugcuacauacacuucuuccgcgaaccuaccgaccucaaacaauucaaacaagacgccaaauacagccacggcauagacgucacagacuuauucgccgcucaacccggacuaaccucggcagucauagacgcacucccccggaacaugguaauaaccugccaaggcagcgaugacaucagaaaacuccucgaaucccaaggacgcaaagacaucaagcugaucgacauagcacucuccaaggcagacucacgaaaauacgaaaacgcagucugggaccaauacaaagaccuaugccacaugcacacaggagucgucguagaaaagaagaaacgagggggcaaagaagaaaucacaccccacugcgcccucauggacugcauaauguucgacgccgccguaagcggcggccuaaacaccucaguacuccgcgccguucuccccagagacauggucuuuagaaccucaaccccaagagucguacuauaa

SEQ ID NO: 3238 - RNA, 1710 nt, Artificial Sequence
  derived and/or modified CDS sequence (opt11) from Lassa virus__AIT17233__NP
augagcgccucaaaagaagucaaauccuuccucuggacccaaagccucagacgagagcucagcgguuacugcuccaacaucaaacuacaaguugucaaagacgcccaagcccuacuccacggccuagacuucuccgaagucucaaacguccaacggcucaugagaaaagaacgccgagacgacaacgaccucaaaagacuccgagaccucaaccaagcagucaacaaccucguggaacucaaaaguacccaacaaaaauccauccuacgcguaggcacccucaccagcgacgaucuucucguccucgcggccgaccuugaaaaacuaaaaagcaaaguaacccgaacagaacgaccccugucagccggagucuacaugggcaaccucucaucacaacaacucgaccaacgacgagcccugcuaagcaugauaggcaugagcggcggaaaccaaggcgcacaagccggacgagacggagucguccgcguaugggacgucaaaaacgccgaacuacucaacaaccaauucggaaccaugcccucauuaacccuagcuugccuuacaaaacaaggucaaguagaccuaaacgacgccguccaagcacuaaccgaccucggccucaucuacaccgccaaauaccccaauacaagcgaccucgacaggcucacccagucccaccccauacuaaacaugauagacaccaaaaaguccagccuaaacauaagcggcuacaauuucagccucggcgccgccgucaaagcaggagccugcaugcuggacggcggcaacaugcucgaaaccauaaaggucagcccccaaacaauggacggaauccuaaaauccauacucaaagucaagaaagcacucggaauguucauaagcgauacccccggcgaacgcaacccauacgaaaacauccucuacaaaaucugccuguccggagacggcuggccauacaucgcaagccgaacaagcauaaccggccgggccugggaaaacaccgucguagaccuagaaagcgacgggaaaccucaaaaagccggaagcaacaacuccaauaaaucccuccaaagcgccggcuucaccgccggccucaccuacucacaacucaugacccucaaagaugccaugcuacaacuagaccccaaugcaaaaaccuggauggauaucgaggggagacccgaagaccccguggaaguagcccuuuaccaaccaucaagcggaugcuacauacauuucuucagggaaccaacagaccuaaaacaauucaaacaagacgcgaaauacucccacggcaucgacgucaccgaccucuucgcagcccagccgggacuuaccuccgcggucaucgacgcccuuccaagaaacauggucauaaccugucaaggcagcgacgacauccgcaaacuacuagaaucccaaggaagaaaagauauaaaacugaucgacaucgccuuauccaaaaccgacagcagaaaauacgaaaacgccguaugggaccaauacaaagaccuaugccacaugcacaccggggucgucgucgagaaaaagaaacgcgggggcaaagaagaaaucacaccccauugcgcacucauggacugcaucauguucgacgcagccguuagcggaggccucaacaccuccguccuucgagccguccuaccaagagacauggucuucagaaccaguacaccccgagucguacucuaa

SEQ ID NO: 3239 - RNA, 1710 nt, Artificial Sequence
  derived and/or modified CDS sequence (opt11) from Lassa virus__AIT17237__NP
augagcgcuagcaaagaaaucaaauccuuccuauggacccaaucacuccgccgcgaacuaagcggauacugcucuaacaucaaacuccaagucgucaaagacgcacaagcacuccuccacgggcucgacuucuccgaagucucaaacguacaacgccuaaugcgaaaagaacggcgcgacgacaacgacuuaaaacgccuccgcgaccuaaaccaggcagucaacaaccucguagaacucaaaagcacccaacaaaaauccauccuacguguuggaacccuaacaucagacgaccuacuaauccucgcggccgaccucgaaaaacuaaaaucaaaaguaacccgcacagaacgcccccucuccgcaggcgucuacaugggcaaccucagcucccaacaacucgaccaaagacgcgcacuacuaaguaugauaggcaugucaggaggcaaccagggcgcccgcgcaggccgagacggcgucgugcgcgucugggacgucaaaaaugccgaauuacuaaacaaccaauucggcacaaugcccucccuaacccuagccugccucaccaaacaaggacaagucgaccuuaacgacgcaguucaagcccucacugaccuaggccucauuuacaccgccaaauaccccaacacauccgaccuggaccgacucacccaaucccaccccauccuaaacaugaucgauacuaagaaaucgagccucaacauaagcggcuacaauuuuagucuuggcgccgcagucaaggcuggcgccugcaugcuagacggaggcaauaugcucgaaacaaucaaagucuccccacaaacaauggacggcauccuaaaauccauccucaaagucaaaaaggcccucggaauguucaucuccgacaccccaggagaacgcaaccccuacgaaaacaucuuauacaaaauaugucucuccggggacggcuggcccuacaucgcuucacgaaccucuaucaccggcagagccugggaaaacaccguaguagaccucgaauccgacggcaagccccagaaagcaggauccaacaacagcaacaagucacuccaauccgccggcuucaccgcaggccuuacauacucccagcuaaugacccucaaagacgccaugcuccaauuagacccaaaugccaaaaccuggauggacaucgaaggccgucccgaagaccccgucgaagucgcccuguaccaacccucaucaggcugcuacauacacuuuuuccgcgaacccaccgaccucaaacaauuuaaacaagacgccaaauacagccacggcauagacguaacugaccuauucgccgcccaaccaggacucacaucggcagucaucgacgcccucccacgaaacauggucauaaccugccaaggcagcgacgacauaaggaaacuacuagaaucccaagggcguaaggacauaaaacuaaucgacaucgcccuauccaaaacagacucacgaaaauacgaaaacgccgucugggaccaauacaaggaccuaugccacaugcacacaggcguagucgucgagaaaaagaaacggggcggcaaagaagaaauaacaccucacugugcccuuauggacugcauaauguucgacgccgcagucuccgguggccucaacaccuccguacuaagagccguccuaccccgcgacauggucuuccgaaccuccaccccgagagucguccuauga

SEQ ID NO: 3240 - RNA, 1710 nt, Artificial Sequence
  derived and/or modified CDS sequence (opt11) from Lassa virus__AIT17241__NP
augagcgccuccaaagaaaucaaauccuuccucuggacccaaucacuacguagagaacucaguggcuacugcuccaacauaaaacuacaaguugucaaagacgcccaggcccuccuccacggccucgacuucucagaggucuccaacguccaacgccuuaugagaaaagaacggagagacgacaacgaccuaaaacggcuacgugaccuaaaccaagcggucaauaaccucgucgaacucaaauccacccaacagaaauccauccucagagucggaacccuaacaagcgacgaccuacuuauacucgcagccgaccuagaaaaacucaaaagcaaagugacccgcaccgagagaccucucucagccggcgucuacauggggaaccuaucaucccaacagcucgaccaacgacgcgcucuccuauccaugauaggaaugaguggcggcaaccaaggcgcccgagccggacgagacggaguaguccgagucugggacgucaaaaacgccgaacuccugaacaaccaauucggcacgaugccaucucucacccucgccugccuaacaaaacaaggccaaguagaccucaacgacgccguacaagcccuaaccgaccuaggccucauauacaccgccaaauacccaaacacaucagaccucgaccgccuaacacaaagccacccuauacucaacaugaucgacacaaagaaauccucccucaacauuuccgguuacaacuucagccuaggcgccgccgucaaagcaggagcgugcaugcuagacggcggcaacaugcuugaaacaaucaaaguaaguccccaaaccauggacggcauacuaaaaagcauacuaaaaguaaagaaagcccucggcauguucauaucggacacccccggcgaacgcaacccauacgaaaacauccuauacaagaucugccuaagcggugacggguggcccuacaucgccagccgcacgagcauaacuggacgagccugggaaaacaccgucgucgaccucgaguccgacggcaaaccacagaaagcaggcagcaacaacucaaacaaaucacuacagagcgcaggcuucaccgcaggccuaacauacagccaacuaaugacacucaaagaugccaugcuccaacuugaucccaacgccaaaaccuggauggauaucgaaggccgaccagaggacccaguagaaauagcccucuaccaaccuuccucaggaugcuacauucacuucuuccgggaaccaacagaccucaaacaauucaaacaagacgccaaauacagccacggcaucgacguaacugaccucuuugcagcccagcccggccucaccuccgccgucauagacgcccucccccgcaacauggucaucacaugccaaggcagcgacgacauacgaaaacucuucgaaucgcaagggcggaaggacaucaaacuuaucgacaucgcccuauccaaaacagacucccgcaaauacgaaaacgcuguaugggaccaguacaaagaccucugccacaugcacaccggcgucguggucgaaaagaagaaacgcggcggcaaagaagaaaucacuccacacugcgcacucauggacugcaucauguucgacgccgcaguuuccggcggccucaacaccagcguacuacgcgccguccuaccaagagacauggucuucagaaccuccacaccccgaguaguucucuaa

SEQ ID NO: 3241 - RNA, 1710 nt, Artificial Sequence
  derived and/or modified CDS sequence (opt11) from Lassa virus__AIT17245__NP
augucagcuuccaaagaaaucaaaucauuccuauggacacaaucccuccgacgcgaacucuccggcuacugcuccaacaucaaacuccaagucgucaaagacgcgcaggcccuccuccacggacuugacuucucagaagucagcaacguccaacgcuuaaugcgaaaagaacgccgagacgacaacgaccugaaacgacuccgagaccuaaaucaagcggucaacaaccucguagaacugaaauccacacaacaaaaauccauccuccgcgugggcacacuaaccagcgacgaccuccuaauacuagccgccgaccuugaaaaacuaaaaucaaaagucacucgaacagaacgcccccuauccgcaggagucuacaugggcaaucucucaucccaacaacuggaccaacggcgagcacuauuaaacaugaucggcaugagcggcucaaaccaaggcgccagaaccggccgagauggcgucguccgggucugggacgucaaaaacgccgaacuacuaaacaaccaauucggaaccaugcccagcuuaacccucgccugccuaaccaagcaaggacagguagaccucaacgacgccguacaagcccuaacggaccugggcuuaaucuacaccgcaaaauacccaaacacaucagaccucgaccgccucacacaaucccaccccauacuaaauaugaucgacaccaagaaauccagccucaacaucuccggauacaacuucagccucggcgccgccguaaaagccggcgcaugcaugcuagacggaggcaacaugcuagaaacaaucaaagucucaccccaaacaauggacggcauccucaaaucaauccuaaaagucaagaaagcacuaggcauguucauauccgacacacccggugaacgcaacccauacgaaaacauccuauacaaaauaugccuauccggcgacggauggcccuacaucgcaagcagaacaucaauaacaggacgagcaugggaaaacaccgucgucgaccucgaaagcgacgggaaaccacaaaaagcaggcuccaacaacucaaacaaaucccuccaaagugccggacuaaccgccggccucaccuacagccaacucaugacccuuaaagacgcaaugcuccaacucgaccccaaugcaaaaaccuggauggacaucgaaggcaggccagaagaccccgucgaaauagcccuauaccaacccagcuccggcugcuacauccacuucuuccgcgagccaacggaccuaaaacaauucaaacaagacgcaaaauacucacacggcauagacgucgcggaucucuucgccgcccagccaggacucaccucagcagugaucgacgcccuacccaggaaccucguaaucacuugccaagguuccgacgacauccgcaaacuccucgaaucucaaggccgaaaagacaucaaacugaucgacaucgcccucagcaaaacagacucucgcaaauacgaaaacgccgucugggaccaauacaaagaccucugccacaugcacaccgggaucgucgucgagaagaagaaacgaggaggcaaagaagaaauaacaccccacugcgcccuuauggauugcauaauguucgacgcagcuguaagcgggggccucaacgcguccgugcucagagccguccuaccuagagacauggucuuccgaaccucuacccccagaguaguccuauga

SEQ ID NO: 3242 - RNA, 1710 nt, Artificial Sequence
  derived and/or modified CDS sequence (opt11) from Lassa virus__AIT17247__NP
auguccgcaagcaaagaaauaaaauccuuucucuggacucaaucucuccgccgcgaacuauccggcuacugcucaaacaucaaacuccagguagucaaagacgcacaagcccuacuacacggccucgacuucucagaaguaucaaacguccaacgccuaaugcgcaaacaacgccgcgacgacuccgacuugaaacgucucagagaccuuaaccaggccguaaacaaucuagucgaauuaaaauccacacagcagaaaagcguccuccgcgucggcacccucacuucagacgaccuacuaauccuagccgcugaucucgaaaaacugaaauccaaaguaaucagaaccgaacgaccccucucauccggagucuacaugggaaaccuguccucccaacaacuagaccaaagacgagcacugcucaacaugaucgguaugagcggaggaaaccaaggugcccaaguaggccgcgacggagucgucagagucugggacgucaaaaaugccgauuuacucaacaaccaauucggcacaaugcccagccugaccuuagcaugccuuacuaaacaaggccaagucgaccucaacgacguaguucaagcccucacagaccuaggccucaucuacaccgcuaaauaccccaacacuucagaccucgacaggcuagcccaaucccaccccauacuaaacaugaucgacaccaagaaauccucccucaacauuucaggcuacaacuucagccuaggcgccgcaguaaaagccggagccugcaugcuagacggaggcaacaugcuugaaacaaucaaagugucaccucaaaccauggacggaauccuuaaauccauacucaaagucaagaaagcccuaggaauguuuauauccgaaacccccggcgaacguaaccccuacgaaaacauccuuuacaaaauaugccuaucaggugacggcuggcccuacaucgccucccgaaccucaauaacuggccgugccugggaaaacaccaucgucgaccucgaaucggacggaaaaccccaaaaagcuggaagcaacaacucgaacaaaucccuacaauccgccggcuucacggccggacucaccuacucccaacucaugacccucaaagacucaaugcuccaacuagacccaaacgccaaaaccuggauggacauugaagggcgccccgaggaccccgucgaagucgcccuguaccaacccagcuccggcugcuacauacauuucuuccgcgagccaacagaccuaaaacaauucaaacaagacgcaaaauacucacacggcauagacgucaccgaccuauucgccgcacaacccggccucaccucugccgucaucgaagcccuccccagaaacaugguaauaaccugccaaggcucagacgacauacgcaaacuacucgaaucccaaggccgcaaagacauuaaacuuauagacaucgcccugaacaaaaccgacucccguaaauacgaaaacgccgucugggaccaauacaaagaccucugucacaugcacacaggcguagucgucgagaaaaagaaacgcggcgguaaagaagaaauuacaccccacugcgcacuaauggacugcaucauguucgacgcagccgucuccggcggccuuaaaacgcuuguacuacgagccguacucccccgagacauggucuuccgcacauccacccccaaaguaguccucuaa

SEQ ID NO: 3243 - RNA, 1710 nt, Artificial Sequence
  derived and/or modified CDS sequence (opt11) from Lassa virus__AIT17251__NP
auguccgcuucaaaagaaaucaaauccuuccucuggacacaaagccuacgccgagagcucagcggcuacugcaguaacaucaaacuccaagucguaaaagaugcacaagcccuccugcacggccuugacuucuccgaagucagcaacguccagcgccuaaugcgaaaacaacgacgggacgacagcgaccucaaacggcuccgcgaccucaaccaggcagucaacaaccucgucgagcuuaaauccacacagcaaaaaucaguccuccgaguaggcacucuaaccuccgacgaccugcucauacucgcagcagaucuagaaaaacuuaaaucaaaagugauccgcacagaacgcccccuauccagugggguauacaugggcaaccucuccagccaacaacuagaccagagacgcgcccuccuaaacaugauaggcauguccggcggaaaccaaggcgcccaaguaggccgcgacggcgucguacgcguaugggacgucaaaaacgcugaccuacuaaacaaccaauucggcaccaugcccucccucacccuggcaugccucaccaaacagggccaagucgaccucaacgacgucguccaagcgcugaccgaucuaggccuuauauacacagccaaauacccaaacacaucagaccucgacagacuagcccagucgcaccccauccucaacaugaucgacaccaaaaagucaucccucaacaucagcggcuacaacuucucccuaggcgccgccguaaaggccggagcgugcaugcucgacggcggcaacaugcucgaaaccauuaaaguaagcccacaaacaauggacggcauccugaaaucaaucuuaaaagucaaaaaggcccucggcauguucauaagcgaaaccccaggcgaacgcaaccccuacgaaaacauccucuauaaaaucugccucuccggugacggcuggcccuacaucgccucaagaacaucgaucaccggacgcgcaugggaaaacaccauuguagaccuagaaagcgacggcaagccccagaaaacaggaucaaacaacuccaacaagucccuccaaagcgccggguucaccgcaggccucaccuacagccaacuaaugacccuaaaagacuccaugcuccaacucgaccccaacgccaaaaccuggauggacauagaaggacgccccgaagaccccguugaagucgcacucuaccaacccagcagcggaugcuacauccacuucuucagggaacccaccgaccuuaaacaauucaaacaagacgccaaauacucccacggcauagacguaaccgaccucuucgccgcgcaacccggccucaccucagcagucaucgaagcccucccccgaaacauggugauaaccugccaaggaagcgacgacauacgaaaacuccuagaaucacaaggacgcaaagacauaaaacucaucgacauagcccuaaacaaaaccgacucccgcaaauacgagaacgccguaugggaccaauacaaagacuuaugccacaugcacaccggggucgucguugagaaaaagaaaagaggcggaaaagaggaaaucacaccccacugcgcccucauggacugcaucauguucgacgccgccguauccggcggccucaaaacccucgugcucagagccguccuaccccgagacauggucuuccgcacauccacgcccaaagugguccuauaa

SEQ ID NO: 3244 - RNA, 1710 nt, Artificial Sequence
  derived and/or modified CDS sequence (opt11) from Lassa virus__AIT17255__NP
auguccgccagcaaagaaaucaaauccuuucucuggacccaaucccuacgccgugaacucucagguuacugcuccaacauaaaacugcaaguagucaaagacgcccaagcacuacuucacggccucgacuucucagaagucucaaacguccaacgacucaugcguaaggaaagacgagacgacaacgaccuaaagcgacuacgagaccucaaccaagccgucaacaaccucgucgaacucaaauccacccaacagaaauccguucuccgcgucgggacccucacauccgacgauuuacucguccuggccgccgaccucgaaaaacuaaaguccaaagucacacgcacagaacgcccccucagcgccggcguguacaugggcaaccucuccucccaacaacuagaucaacgccgcgcacuacucucaaugaucggcaugucuggaggcaaccaacgagcacaagcaggacgcgacggagucguccgcgucugggacgucaaaaacgcagaacuucugaacaaucaauucggcaccaugccaagccucacccuagccugccugaccaaacaaggacaagucgaccucaacgacgccguucaggcccucacagaccucggucucaucuacaccguaaaauacccaaacgcgucagaccuagacagacucacccaaucccaccccauacuaaacaugaucgacacaaagaaauccagucuaaacauuagcggauacaacuucagccuaggcgccgccguaaaagcaggagcaugcaugcucgacggagggaacaugcucgaaaccauaaaaguauccccacagacaauggacggcauccuuaaauccauacucaaagucaagaaaacccucggaauguucaucagcgacacacccggugaacgcaacccguacgaaaauauccucuauaaaauuugccucuccggcgacggcuggcccuacaucgccucccgcaccagcaucacaggccgcgcaugggaaaacacagucguagaccuggaauccaacggaaaaccacaaaaagccgacagcaacucauccaacaaaucccuccaaagcgcgggauucacugcaggccugacauacucacaacucaugacgcucaaagacgccaugcuacagcuagaccccaacgccaaaacauggauggacaucgaagggcgcccugaagacccggucgaaaucgccuucuaccaacccuccucaggaugcuacauccacuucuuucgcgagccaaccgaccucaaacaguucaaacaagaugccaaauacucacacggcaucgacgucacagaccucuucgccgcccaacccggccuaaccuccgcagucauagacgcccucccccgcaacauggucauaaccugccaaggcucugacgacauccgcaaacuccuagaaucucaaggccgcaaagauaucaaacuuaucgacauagcccuaucaaaaaccgacucccgcaaauacgaaaacgcuguaugggaccaauacaaagaccucugccacaugcacaccggcguagucgucgaaaagaagaaacgcggcgggaaagaagaaaucacaccacacugcgcccucauggauugcauaauguucgacgccgcagucuccgggggucugaacacucucguacuacgggccguccucccacgcgacauggucuuccgcaccucaacaccccgagucguccucuaa

SEQ ID NO: 3245 - RNA, 1710 nt, Artificial Sequence
  derived and/or modified CDS sequence (opt11) from Lassa virus__AIT17259__NP
augucagcuuccaaagaaaucaaaucuuucuuauggacccaaagccugcgacgcgaacuaagcucauacugcuccaacaucaaacuccaagucgucaaagacgcccaagcccucuuacacggccuggacuucagcgaagucucgaacgugcaacggcugaugcgaaaagaaagacgcgacgacaacgaccucaaaagacuccgggaccucaaccaagccgucaauaaccuggucgaacucaaaaguacccaacaaaaauccauccuccgggucggaacauuaacaagcgacgaccuacuuauccuugcugccgaccuagaaaaacuaaaauccaaagucaccagaacagagcgcccacuaagcgccggcguauacaugggcaaccucuccucacaacagcucgaccaacgacgcgcccuccuuaacaugcucgguaugucuggcuccaaccaaggcgcaagagccggccgcgacggcguaguacgcgucugggacguaaaaaacgccgaacuucucaacaaccaauucggcacaaugcccagccuuacacuagcuugcuuaaccaaacaaggacaggucgaccucaacgacgccguccaagcccucaccgaccucggacugauauacaccgcaaaguaccccaacaccucagaccuagacaggcucacacaaucccacccgauccucaacaugauagauaccaaaaaaucgucccucaacaucucaggauacaacuucucccuaggagcagccgucaaagccggcgccugcaugcucgacggcggcaacaugcucgaaaccauaaaagucucuccacaaacaauggacggcauccucaaaagcauccugaaaguaaaaaaagcccuagggauguucaucuccgacacccccggagaacgaaacccauaugaaaauauacucuacaaaaucugccucagcggagacggcuggcccuacaucgccagccgcacaaguaucacuggccgcgccugggaaaacacugucgucgaccucgaaagcgauggcaaaccccaaaaggcuggcagcaacucauccaacaaaucgcuccaaagcgccggcuuuaccgccggccuaacauauucccaacucaugacacucaaagacgccaugcuccaacucgaccccaacgcaaaaacauggauggacaucgagggaagacccgaagacccaguagaaauugcacuauaccagcccagcucaggcuguuacauccacuucuuccgcgagccaacagaccuaaaacaauucaaacaagacgcaaaauacagccacggcaucgacgucacagaccucuucgcagcccaacccggccucacgucagcaguaaucgacgcccucccgcgaaacauggucauaaccugucaaggcuccgaugacauccgcaaacuccucgaaucccaaggccgcaaagauaucaaacucaucgacaucgcccucuccaaaaccgacucacggaaauacgaaaacgccgucugggaccaauacaaagaccuaugccauaugcacaccggcaucguagucgaaaaaaaaaaacgcggcggaaaagaagaaaucacaccccacugcgcccucauggacugcaucauguucgacgcagcggucuccgggggacucaacgccagcguccuacgagccguccuuccacgcgacauggucuuucgaaccuccaccccccgaguaguccucuga

SEQ ID NO: 3246 - RNA, 1710 nt, Artificial Sequence
  derived and/or modified CDS sequence (opt11) from Lassa virus__AIT17263__NP
auguccgccucaaaagaaaucaaaucguuccuauggacccaaucccuucgacgcgaacucucaggguacugcucaaacaucaaacuccaagucgugaaagacgcccaagcccuccuacacggacuugacuucuccgaaguaagcaacguccaacgcuuaaugcgcaaagaacgucgcgacgacaacgaccucaagagacuccgcgaccucaaucaagcugucaacaaccuaguagaacuuaaaaguacccaacagaaguccguccuaagggucggcacccucacauccgaugaccuccuaauacucgccgccgaccuagaaaagcucaaaucaaaagucauccguaccgaaagaccacucuccgccggcgucuacaugggaaaccuauccucccaacagcuagaccaacgccgcgcucuacuaaacaugaucgggaugggcggcucaaaccaaggcgcccgcgcaggacgcgacggagucguacgcgucugggaugucaaaaacgccgagcuccucaacaaccaauucgggacaaugccaucgcuaacucucgccugccucaccaagcaaggacaagucgaccuaaacgacgcaguccaggcccucaccgaccuaggccuuaucuacacagcaaaguaccccaacaccuccgaccuugaccgacucacccaaucccacccuauccuuaacaugaucgacaccaagaaaucuucccucaacauauccggcuacaacuucucccuaggcgcagccguaaaagcaggcgccugcaugcucgacgggggcaacaugcucgaaaccauaaaagucucaccccaaacgauggacggaauccuaaaauccauacucaaaguaaagaaagcccucggcauguucauaucagacaccccaggggaaagaaaccccuacgaaaacauccuauacaaaaucugccuauccggcgacggcuggcccuacaucgccagccggacauccauaaccggccgcgcaugggaaaacacagucgucgaccucgaauccgacggcaaaccccaaaaagccggcagcaacggguccaacaaaagucuccaaagcgccggcuucaccgccggcuuaaccuacagccaacucaugacccucaaagacgccaugcuccagcucgaccccaacacaaaaaccuggauggacauagaaggacgcccagaagacccugucgaagucgcccucuaccaaccauccucaggcugcuacauacacuucuuccgggaacccaccgaccucaaacaauucaaacaagacgcaaaauacucccacggcauagacguaacagaccuuuuugccgcacaacccggccucaccucagcagucaucgacgcccuaccccguaacauggucauaaccugccaagguucagacgacauccgcaaacuccucgagucccaaggccgcaaagacaucaaacucaucgacaucgcccuaaguaaaaccgacucccgcaaauacgaaaacgccguaugggaccaauacaaagaccuaugccauaugcacaccggcaucguaguagaaaagaagaaaaggggaggcaaagaagaaaucacaccccacugcgcacuuauggacugcaucauguucgacgcagcagucuccgguggccucaauaccucaguccuaagagccguacucccccgcgacaugguuuuccgaaccucuacaccccgcgucguccucuga

SEQ ID NO: 3247 - RNA, 1710 nt, Artificial Sequence
  derived and/or modified CDS sequence (opt11) from Lassa virus__AIT17267__NP
auguccgccuccaaagaaaucaaauccuuccucuggacccaaucucuucgacgcgaacuauccggcuacugcuccaacaucaaacuacaagucguaaaagacgcacaagcccuccuccacggccucgauuucuccgaggucagcaacguccaacgccugaugagaaaagaacgcagagacgacaaugaccucaaacgucuccgcgaucuaaaccaagccgucaacaaccucgucgagcuaaaaagcacccaacaaaaaucuguccucaggguaggcacccuaaccuccgaugaccuacucauacucgcagcagaccuagaaaaacucaaaucgaaagucacacgcacagaaaggccccuaagcgccggagucuacaugggaaaccuaagcucucaacaacuggaccaacgucgagcccuccuaaacaugauaggcaugucaggaggaaaccaaggcgcccgcgccggacgcgacggcgucgugagagucugggacgucaaaaaugccgagcugcuuaauaaccaauucggcaccaugccaucacuaacccuagccugccuuacaaaacaaggccaagucgaccucaacgacgccguacaagcacucacagaccucggacuaauauacacagccaaauacccaaacaccuccgaccucgaccgucuaacccaaucacaucccaucuuaaacaugaucgacaccaaaaagucaucccuaaacaucucaggauacaacuucucccucggagcagccguaaaagccggagcuugcaugcuagacggcggcaacaugcuugaaacaaucaagguaucuccccaaaccauggacagcauacuaaaaagcauccucaaaguaaagaaagcacucggcauguucaucuccgacaccccaggcgaaagaaacccauacgaaaacauacuauacaaaaucugccuauccggcgacggcuggccauacaucgcaucccguaccagcaucacaggccgcgcaugggaaaacaccgucgucgaccuagagucagacggcaaaccacaaaaagccggcucaaacaacuccaacaaaucccuacaaucagccggcuucgcggccggccucaccuacucacaacucaugacucucaaagacgccaugcuccaacucgaccccaacgccaaaaccuggauggacauagaaggcagacccgaagauccaguagaaaucgcacucuaccaacccucaucuggaugcuacauccacuucuuccgagaacccaccgaccucaaacaauucaaacaagacgcaaaauacucucauggcauagacguaaccgaccucuucgcagcccaacccggucucacgagcgcagucaucgacgcacuaccccgaaacaugguaauaaccugccaaggcagcgacgacauacgcaaacuccuagaaucccaaggccgcaaagacauuaaacuuaucgauaucgcccucuccaaaacagacucucgcaaauacgaaaacgccgucugggaccaauacaaagaccucugccacaugcacaccggcgucgucgucgaaaagaagaaacgaggcggcaaagaagaaaucaccccucacugcgcccucauggacugcauuauguucgacgcggccgucuccggcggacuaaacacauccguccuacgcgcaguucucccgcgagacauggucuuccgcaccacaacaccccggguaguguuauaa

SEQ ID NO: 3248 - RNA, 1710 nt, Artificial Sequence
  derived and/or modified CDS sequence (opt11) from Lassa virus__AIT17271__NP
auguccgccagcaaagaaauaaaaucauuccuauggacccaaucccuucgaagagaacucucuggcuacugcucaaacaucaagcuacagguagucaaggacgcacaagcacuacuacacggccucgacuucucugaaguauccaacguacagcgccucaugcgaaaagaacgccgcgacgacaacgaccugaaacgauugagagaucucaaccaggcgguaaacaaccucguagagcuaaaguccacccaacaaaaauccauacuucgaguaggaacccucacgagcgacgaucucuugauccucgccgcagaccucgaaaaacuaaaauccaaagucacccggaccgaacgcccccuuucagcaggaguauacaugggcaaccuaagcucccaacaacuagaccaacgccgcgcacuucucaacaugaucggcaugucaggaggaaaccaaggcgcuagagccggacgagauggagucguccgcguaugggacgucaaaaaugcagaacuccucaacaaccaauucggaaccaugcccagccucacacuagccugccucaccaaacaaggccaagucgaucucaacgacgccgugcaagcccucacggaccucggacugaucuacacagccaaauacccgaauacuucagaccucgaccgacucacccaaagccaccccauccugaacaugaucgacaccaagaaauccucccugaacauauccggguacaacuucucacucggcgcagcggucaaagccggcgccugcaugcucgacggcggcaacaugcucgaaaccaucaaagucucaccacagaccauggauggcauccuaaaaaccauccucaaaguuaagaaagcccucggaauguucauaagcgacacaccuggagaacggaaucccuacgagaauauccuauacaaaaucugccucuccggagacggcuggcccuacaucgcguccaggacgucaaucaccggacgcgcaugggaaaacaccguagucgaccuagaaagcgacggaaaaccccagaaaacaggguccaacaacuccaacaaaagccuacaauccgcaggcuucgcagccggccuaaccuacagccaacucaugacacucaaagaugcaaugcuccaacucgaccccaacgccaaaacauggauggacauagaaggccggcccgaagaccccgucgaaaucgcccuauaccaacccucauccggaugcuacauccacuucuucagagaaccaaccgaccucaaacaauucaaacaggacgccaaauacucacacggcauagacgucaccgaccucuucgcagcacaacccggacuaaccagcgccgucaucgacgcccuaccccgcaacaugguaauaaccugccaaggaagcgacgacauccgcaaacuccuagaaagccaaggacgcaaagacaucaaacuuauagauaucgcacucucaaaagcggacucccgaaaauacgaaaacgcaguaugggaccaauacaaagaccucugccacaugcacacaggaguagucgucgagaagaagaaacguggaggaaaagaagaaauuacuccccacugcgcacuuauggacugcauaauguacgacgcagccgucagcggcggacucucgaccagcguacucagagccguccucccccgugacaugguauuccggaccuccacaccccgcguaguucuauga

SEQ ID NO: 3249 - RNA, 1710 nt, Artificial Sequence
  derived and/or modified CDS sequence (opt11) from Lassa virus__AIT17275__NP
augagcgcaucaaaagaaauaaaaucauuccuauggacacaaagccuccgccgugaacucagcggcuacugcuccaacauaaaacuacaagucguaaaagacgcacaagcccuacuccacggucucgauuucagcgagguuuccaacguacaacgacucaugcgaaaacaacgccgcgacgacggcgaccucaaacgacuccgagaccucaaccaggccgucaacaaccuagucgaacucaaauccacucaacagaaaagcguacuccgagucggaacacucaccagcgacgaccuccuuacacucgccgcugaccucgaaaaacucaaauccaaagucaccagaaccgaacgcccacuaucagcaggaguauacaugggaaaccucucuucccaacagcucgaccaacgacgagcccuucucaacaugaucggcaugagcggcggaaaccaaggagcaagaacaggaaaagacggugucguccgcauaugggacgucaaaaacgccgaccuccucaacaaccaauucggaaccaugccgucccucacccucgccugucuuacaaaacaaggacaaguagaccucaacgacguaguccaagcacucacggaccugggacuaauauacaccgccaaauacccaaacauauccgaccucgaccgccuggcccaaucacacccaauccucaaaaugaucgacacaucaaaaucgucccuaaauaucuccggcuacaacuucucacucggagcggcagucaaagccggagcaugcaugcucgacggaggaaacaugcuugaaacgguaaaaguauccccacaaacaauggauggcauacucaaauccauacucaaaguaaagaaaucccuuggaauguucaucuccgacacccccggcgaacgcaaccccuaugaaaacauacucuacaaaaucugccuauccggagacgguuggcccuacaucgcgucccgaaccagcaucaccggccgcgccugggaaaacaccgucgucgaccuagaauccgacggcaaaccacaaaaagucggcuccaauaacuccaacaaaucgcuccagucuaccggauucaccgccggacugacauacagccaacucaugacccuaaaagacgccaugcuccaacucgaccccaacgcaaaaaccuggauggacaucgaaggucgaccagaagaccccgucgagauagcccucuaccaaccaucaagcgggugcuacauccacuucuucagagaacccaccgaccucaaacaauucaaacaagacgccaaauacucacacggaaucgauguaacagaccuauuugccgcccaacccggacucaccuccgccguaaucgacacacuaccacgcaacauggucauaaccugccaaggcucagacgacaucggcaaacuccucgaaucccaaggccgcaaagacaucaaacucaucgacauagcccucucaaaaacugauucacgaaaauacgaaaacgcugucugggaccaauacaaggaccucugccacaugcacaccggagucgucgucgaaaagaagaaaagaggcggaaaagaggaaaucaccccacacugcgcccugauggacugcauaauguucgacgccgcagucuccggcggacuuaacgcauccguccuacgcgccguccucccccgagacauggucuucagaacaucuaccccgcgcguaguccuauga

SEQ ID NO: 3250 - RNA, 1710 nt, Artificial Sequence
  derived and/or modified CDS sequence (opt11) from Lassa virus__AIT17277__NP
augagcgcauccaaagaaauaaaaucauuccucuggacccaaucccugcgacgcgaacuuagcagcuacuguucaaacaucaaacuacaaguggucaaagacgcccaagcccuccuccacggccucgacuucucagaagucuccaacguucaacgccucaugcgaaaagaacgccgagacgacaacgaccuuaaacgccuccgcgaccugaaccaagccgucaacaaccucguagagcucaaaagcacccaacaaaaaucuauccuacgcgucggcacacucaccagcgacgaccuacucauacucgcagccgaucuagaaaaacucaaaucaaaaguaacacgcaccgaacgaccccucucagccggcguguacaugggaaaccuuucaucacaacagcucgaucaacgacgcgcccucuuaucaaugauaggcauguccggcuccaaccagggcgcgcgagccggcagagacggaguaguucgcguuugggacgucaaaaacgccgaacuccucaacaaccaauucggaaccaugccuucgcucacccucgcaugucucaccaaacaaggacaaguagaucucaacgacgccguccaagcccuaaccgaccucggccucauauauaccgcaaaauaccccaacaccuccgaccucgaccgccuaacccaaucacacccaauucucaacaugaucgacaccaagaaaucaucccucaacaucagcggcuauaacuucucucucggcgccgcagucaaagccggagcaugcauguuagacggcggcaacaugcucgagacaaucaaagucucaccccaaaccauggacggcauccucaaauccauccucaaagucaagaaagcccugggcauguucauauccgacaccccaggcgaacguaacccauacgaaaauauccuauacaagaucugucuaucaggagacggauggcccuacaucgccucacgcacauccaucaccggacgcgcaugggaaaacaccguagucgaucuagaauccgacggcaaaccgcaaaaagccggcagcaacaacuccaacaaaagccuccaguccgccggauucaccgccggccuaaccuacagccaacuaaugacccuuaaagacgccaugcuccaacucgacccaaacgccaaaacauggauggacaucgaaggccgaccggaagacccugucgagguagcccucuaccaacccagcuccggcugcuauauccacuucuucagagaaccgaccgaccuaaaacaauucaagcaagacgccaaauacucccacggcaucgacgucacagaccucuucgcggcccaaccaggccuaaccuccgcaguaauagacgcacucccacgaaacauggucauaaccugccaaggcagcgacgacauccguaaacuccucgaaucucaaggccgaaaagacaucaaacucaucgacaucgcccucagcaaaacugacagccgaaaauacgaaaacgcugucugggaccaauacaaagaccuaugccacaugcacaccggcgucgucgucgaaaagaagaaacgcgggggaaaagaagaaaucacuccccacugcgcccucauggacugcauaauguucgacgccgccguuuccggaggccuaaacaccuccguccuacgggcaguccuaccccgagacauggucuucagaaccucuacccccagaguagugcuauaa

SEQ ID NO: 3251 - RNA, 1710 nt, Artificial Sequence
  derived and/or modified CDS sequence (opt11) from Lassa virus__AIT17281__NP
augagcgcaucuaaagaaauaaagagcuuccucuggacccaaagccuccgccgcgaacucucaggcuauugcucaaauauaaaacuacaagucgucaaagacgcacaagcccuccuacacggccucgacuucuccgaagucagcaacguccaacgacugaugagaaaagaacgacgugacgacucggaucuaaaacgccuacgcgaccuaaaccaagcggucaacaaccuggucgagcuaaaauccacccagcagaaaagcguacugcgagucggaacccuaacgucagacgaccuccucgucuuagcagccgaccucgaaaaacuaaaauccaaggucacccgaacagaacgcccacucagcgccggugucuacaugggcaaccucagcucacaacaacucgaccagcgccgagcacuccucuccaugauaggcaugucgggcggcaaccaaggcgcaagagccggacgcgacggcguaguucgaaucugggacguuaaaaacgccgaacuccuaaacaaccaguucggcacaaugccaucccuaacccuagcgugccugacaaaacaagggcaaguagaccucaacgacgucgugcaagcacucaccgaccucggacucauauacaccgccaaguacccaaauaccagcgaccucgaccgccucacacaaucacacccaauccuaaacaugaucgacaccaagaaauccagccuaaacaucagcggguacaacuucucacucggggccgccgucaaagccggcgcgugcaugcuagacggcggcaauaugcucgaaaccauaaaagucucaccacaaacuauggacggcauccuaaaauccauacucaaagucaagaaagccuuaggcauguucauuagcgacacccccggcgaacgcaaccccuacgaaaacaucuuauacaaaaucugccucuccggcgacggcuggcccuacaucgccuccaggaccucgaucaccggacgcgcaugggaaaacacaaucguagaccucgagagcgacggaaaaccccagaaaacgucuacaaccaacucgaacaaaucccuccaaucagcaggcuucgccgccggccucaccuauucacaacucaugacucucaaagacgcaaugcuacagcuggaccccaacgccaaaaccuggauggacaucgaaggcagacccgaagaccccgucgaaaucgcacucuaccaacccagcagcggcugcuacauacacuuuuuccgcgagccaacagaucuuaaacaauucaaacaagacgcgaaauacagccacggcauagacgucaccgaccuauucgcagcccaaccaggccugaccagcgccgucaucgacacccuaccccgcaacaugguaaucacuugccaagguucggaagacauacgacgacuacuagaaucgcaaggacgcaaagacaucaaacucauagauaucgcgcucucaaaaacagacucccgcaaauacgaaaacgcagucugggaccaauacaaagaccucugccacaugcacaccggugucgucguagaaaagaaaaagaaaggcgggaaagaagagauaacaccucacugcgcccucauggacugcaucauguucgacgccgcaguaagcggaggacucaacaccucaguacuacgcgccguacuaccucgcgacaugguauuccgcacaucaaccccgcgggucguacucuaa

SEQ ID NO: 3252 - RNA, 1710 nt, Artificial Sequence
  derived and/or modified CDS sequence (opt11) from Lassa virus__AIT17285__NP
augucagcaagcaaagaaauuaaaucauuccucuggacacaaagccuucgccgagaacucucugguuacugcucaaacauuaaacuacaaguaguaaaagacgcccaagcacuccuacacggcuuagacuucucagaagucucaaacguccagcgcucaaugcgcaaagaacgcagggacgacaacgaucuuaaacgccuccgcgaccuaaaccaagcagucaacaaccucguagagcucaaauccacccaacaaaaauccauccuacgagucggcacccucacaucagacgaccuacucauacucgcagcugaccuagaaaaacugaaaagcaaagucaccagaacagaacgcccccuaucagccggagucuacaugggcaaccucucaucccaacaacucgaccagcgacgagcucuccucaacaugauaggaauguccggaagcaaccaaggcgcccgcgccggccgcgacggcguaguacgcgucugggacgucaaaaaugccgaacugcucaacaaccaauucggcacuaugccaucccuaacccuagcaugccucaccaaacaaggccaaguagaccucaacgacgucguccaggcccucacugaccucgggcuuauauacaccgcaaaauaccccaacgcauccgaccucgauagacuaacgcaaucccaccccauccucaacaugaucgacaccaagaaaucauccuuaaacaucucaggauacaauuucucccucggggccgcagucaaagccggagccugcaugcucgacggcggcaacaugcuugaaaccauuaaaguaagcccccagaccauggacgguauccucaaauccauccuaaaaguaaagaaagcccucggcauguucaucuccgacacccccggcgaacgcaaccccuacgaaaacauacucuacaaaaucugcuuaucaggugacggauggccauacauagccucccgcaccagcaucaccggucgagcaugggaaaacacaaucgucgaccucgaauccgacgguaaaccacaaaaagccggcaacaacggcuccaacaaaucacuccaauccgccggcuucacagccggacucaccuacagccaacucaugacacuaaaagacgccaugcuccaacuagacccaaacgcuaaaacauggauggacaucgaaggacgccccgaagaccccguagaaaucgcccuauaccaaccaagcagcggauguuacauccacuucuucagagaaccaacagaccucaaacaauuuaaacaagacgccaaauacagccacggcaucgacgucacagaccucuucgcugcccaacccggacucacauccgcagucaucgacgcucuaccacgaaaccuaguaauaaccugccaaggaagcgacgacauacgaaaacuccucgaaucccaaggccgcaaagacaucaaacuuauagacauagcccuaucaaaaaccgacucacgcaaauacgaaaaugccguaugggaccaauacaaagaucuaugccacaugcacacagguaucgucguagaaaagaagaaacgaggaggaaaagaagaaauaacaccccacugcgcucugauggacugcaucauguuugacgccgccguauccggcggguuaaacaccuccguccugcgagcaguacugccccgugacaugguauuccgcaccucaaccccgcgcguaguacucuaa

SEQ ID NO: 3253 - RNA, 1710 nt, Artificial Sequence
  derived and/or modified CDS sequence (opt11) from Lassa virus__AIT17289__NP
auguccgccuccaaagaaaucaagagcuuccuauggacccagucauuaagacgagaacucuccgguuacugcuccaacauaaaacuacaaguagugaaagacgcccaagcccuccuccacggccucgacuucuccgaagucuccaacguccaaagacuaaugagaaaagaacgcagagacgacucagaccuuaaacgccuaagagaccuaaaccaagcagugaacaaccucguagagcucaaaucaacccaacagaaaagcguccuucgagucggcacacucaccucagacgaccugcucguccucgccgccgaccuagaaaaacuaaaauccaaagucacaagaacagaaagaccccucuccgcuggugucuacaugggcaaccuaagcucccaacaauuggaccaaagacgcgcacugcugucaaugauaggcaugucgggaggaaaccaaggaguccgcgcaggccgagacggaguagucagaauaugggacgugaaaaacgccgaacuccuaaacaaccaauucggcaccaugccaucacucacccuagcaugccuaaccaaacaaggccaggucgaccucaacgacgucguccaagcacuaaccgaccuuggacucaucuacacagccaaauacccaaacaccucagaccucgaccgccucacccaaucccacccaauccuaaacaugaucgacaccaaaaagucaucacucaacaucuccggcuacaacuucucccuaggagccgccgucaaagccggggccugcaugcuagacggcggcaacaugcuugaaacaauaaaagucucaccccaaacaauggacggaauacucaaguccauacucaaggucaagaaagcccucggaauguucauauccgacacacccggcgagcgcaacccauacgaaaacauccuauacaaaauaugccuauccggcgacggcuggccauacaucgccucacgaacuuccauaacgggccgagcaugggagaacaccauaguagaccuagaauccgacggcaaaccacagaaaaccggcagcaucaacuccaacaagucacuccaaagcaccggcuucgccgccggacuaaccuacucccaacugaugacgcuaaaagacgccaugcuacaacuagacccaaacgccaaaaccuggauggacaucgaaggaaggcccgaagacccaguagaaaucgcccuauaccaacccucgagcggcuguuacauccacuucuucagagaacccaccgaccucaaacaauucaaacaagacgcuaaauacucacacggaaucgacguaaccgaccuauucgccgcacaacccggccuaacuagcgccguaaucgacgcccuaccccgcaacaugguaauaaccugccaaggauccgacgacauccgaaaacuccucgagucccagggacgaaaagauaucaaacucaucgacaucgcacuauccaaaacagacagccgcaaauacgaaaacgccgucugggaccaguacaaagaccuuugccacaugcacaccggcauagucgucgagaaaaagaaacgaggaggcaaagaagaaaucacaccccacugcgcccuaauggacuguaucauguucgacgcagccgucagcggcggucuaaacacaagcguccuccgcgccguccuucccagagacaugguauuccgcaccuccacuccccgagucguacucuga

SEQ ID NO: 3254 - RNA, 1710 nt, Artificial Sequence
  derived and/or modified CDS sequence (opt11) from Lassa virus__AIT17293__NP
augagcgcaucaaaagaaaucaaguccuuccucuggacacaaagccuccgcagagaacucuccggauacugcuccaacauaaaacuacaaguagucaaagacgcccaagccuuacuccacgggcuagacuuuucagaaguaucgaacguacaacgccucaugcggaaacaacgacgagacgacaacgaccuaaaacgacuacgcgaccucaaccaagcaguaaacaaccucgucgaauuaaaauccacccaacaaaagucaguacugcgagucggaacucucacauccgacgaccuccucguccuagccgcagaccuggaaaaacuaaagucaaaagucacgcgcacggaacggccacuauccgccggcguauacauggggaaccucuccacccaacagcucgaucaaagacgagcccuacuuaacaugauuggcaugucuggcggaaaccagggagcccgagccggccgcgacggagugguacgcguaugggacgucaaaaacgccgaccugcucaacaaccaauucggaacaaugcccagccuaacacucgccugccuaacaaaacaaggccaaguagaccucaacgacguaguccaagcccucaccgaccuaggccucaucuacaccgccaaauacccaaacacauccgaccucgaccgccucacccaaagccacccaauccucaacaugauagacacaaacaaguccucacucaacaucuccggcuacaacuuuucacucggagcagcugucaaagccggggccugcaugcuagacggcggcaacaugcucgaaacaaucaaaguaucaccccaaacaauggacggcauacuaaaaucaauccugaaggucaaaaaggcacucgggauguucaucucagacacacccggcgaacgcaacccauacgaaaacauccucuacaaaaucugccuuucaggagauggauggccauacauagccucacgaacauccauaacuggccgcgcuugggagaacaccguaguagaccucgaauccgacggcaaaccacaaaaagccgggggcaacaauuccaacaaaucccuccaauccgcaggauucaccgcaggccucaccuacagccaacucaugacacuaaaagacgccaugcuacaacuagacccaaaugcaaaaacauggauggacauagaaggccgaccagaagacccaguagaaaucgcacuuuaccaaccaagcagcggcugcuacauucacuucuuccgagaaccgacagaccucaaacaauucaaacaagaugcaaaauacagccacgguaucgacgucacagaccuguucgccgcacagcccgggcucaccuccgccgucaucgaugcccucccccgcaacaugguaauaacaugccaaggcuccgacgacauacgcaaacuccucgaaucccaaggccgcaaggacaucaaacuaaucgacaucgcccuauccaaaacggacucacgaaaauacgaaaacgccguaugggaccaauacaaagaccucugcaacaugcacaccggaaucgucgucgagaaaaagaaacgaggcggcaaggaagaaaucacuccacacugcgcccucauggacugcauaauguucgacgcugccgucuccggaggaaugaacacauccguccuccgcgcaguucuaccgcgcgacauggucuuccgaacuagcaccccacgagugguacucuaa

SEQ ID NO: 3255 - RNA, 1710 nt, Artificial Sequence
  derived and/or modified CDS sequence (opt11) from Lassa virus__AIT17295__NP
augucugcaagcaaagaaaucaaauccuuccuguggacccagucucuccgaagagaacucucagguuacugcucuaacauaaaauuacaaguaguaaaagacgcucaagcccuccuccacggccucgacuucuccgaagucucaaacguccaacgccucaugcggaaagagcgucgagacgacaacgaccuaaaacgacuaagagaccuuaaccaagccguaaauaaccucgucgaacucaaauccacacaacaaaaauccguacuacgcgugggaacacucacauccgacgaccuccugauucucgccgcugaccuggaaaaacucaaaucaaaaguaauccguaccgaacgcccccugucagccggagucuacaugggcaaccucucaucacaacaacucgaccaaagacgagcccuccucaauaugaucggcaugggaggaagcaaccaaggugccagagccggccgcgacggcgucguccgcgucugggacgucaaaaacgccgaacuacuaaacaaccaauucggaaccaugcccucacugacccucgccugccugacgaagcaagggcaaguagaccucaacgacgcaguccaagcacuaaccgaccuaggacuuauauacacagcaaaauacccaaacaccucagaccuagaccgacuaacccagucacaccccauccucaacaugauugacacaaagaaaagcagccucaacaucucuggcuacaacuucagccuaggcgccgccguaaaagccggcgccugcaugcuagacggcggaaacaugcucgaaaccauuaaaguaucaccccaaaccauggacggcauacugaaauccauccucaaaguaaagaaagcacuaggcauguucauauccgacacaccgggcgaacgcaacccauacgaaaacauccucuacaaaaucugccuaagcggcgacggcuggcccuacaucgccagccgcaccuccauaaccggcagagccugggagaauacaauagucgaccucgaaagcgacggcaaaccccaaaaagcgggcucaaacggcuccaacaaaucacuacaauccgccgguuucacagcuggacuaacauacucacaacuaaugacccucaaagacgcaaugcuccaacuggauccuaacgccaaaaccuggauggacaucgaaggccgcccagaggacccggucgaaaucgcccuauaccaacccagcagcggcugcuacauccacuucuuucgcgaacccaccgaccucaaacaauucaaacaggaugcaaaguacucacacggcauagacgucaccgaccuauucgccgcccaaccaggacuaaccucagccauaauagacgcccuccccagaaacauggucauaaccugccaaggaucggacgauaucagaaaacuacuagaaagccaaggccgaaaagacauuaaacuaauagacaucgcccucuccaaaaccgacagccguaaauacgaaaacgcagucugggaccaauacaaagaccuaugccacaugcacaccggcaucguugucgaaaagaagaaacgcggaggaaaagaggaaaucaccccacacugcgcacucauggauugcauaauguucgacgcagcaguaucaggaggacucaacaccagcgugcuccgcgccguccucccccgagacauggucuuccgcacaucuacgccccgaguaguacucuaa

SEQ ID NO: 3256 - RNA, 1710 nt, Artificial Sequence
  derived and/or modified CDS sequence (opt11) from Lassa virus__AIT17299__NP
auguccgcaucaaaagaaauaaaaucauuucucuggacccaaucccuccgccgggaacucaguggauacugcuccaacaucaaacuacaaguuguaaaagaugcccaagcgcuccuacacggacuagacuucucagaagucuccaauguucaacgacuuaugcgcaaagaacgccgcgacgacaacgaccucaaacgacuccgagaccucaaccaagccgucaauaaccucguggaacuuaaauccacccaacagaaaucaguccuccgugucggcacacuaacauccgacgaccuccuuguccuugcagcagacuuagagaaacugaaauccaaagucaccagaaccgaacgaccccucucugccggcgucuacaugggaaaccucagcucccaacagcucgaccaacgucgcgcccucuuauccaugauaggcauguccggaggaaaccaaggagcccgaacaggccgcgacggggucguccgcgucugggacgucaaaaacgccgaacuacuaaacaaccaauucggaacaaugcccagcuuaacacuggccugccugacaaaacaaggacaaguugaccucaacgacgucguccaagcccuaacggaccuaggacucaucuacaccgcaaaauaccccaacacgucagaccucgaccgacucacacaaucccaccccauccuaaacaugaucgacaccaaaaaguccucccuaaacaucagcggguacaauuucucccucggcgcagccguuaaagccggcgcaugcaugcuugacggagggaacaugcucgaaacaaucaaagucucaccccagaccauggacggcauccuaaaauccauccuaaaaguaaagaaagcccucggcauguucauaucagauacaccaggcgaaagaaauccguacgaaaauauacucuacaaaaucugccucucaggcgacggcuggcccuacauagcaucccgaaccagcaucaccgggcgcgccugggaaaacaccgucgucgaccuagagagcgacggaaaaccccaaaaagccggaagcaacaacucaaacaaaucccuccaauccgccggcuucaccgcaggacuaacauacagucaacucaugacccucaaagacgcgaugcuacaacucgacccaaacgccaaaaccuggauggacaucgaaggacgaccagaagaccccguggaaauugcacucuaccaacccuccuccggcugcuacauccacuucuuccgcgaaccguccgaccuaaaacaauucaaacaggacgccaaauacagccauggaaucgacgucacagaccucuucgccgcacaacccggacuaaccucagccguaauagacgcccucccgcgaaacauggucauuaccugccaaggcuccgacgacauccgaaaacuauucgaaucacaaggccgcaaagacauuaagcucaucgacauagcacucuccaaaaccgacucucgcaaauacgaaaacgccgucugggaccaauacaaagaccuuugccacaugcacacaggcguagucguagagaaaaagaaacgaggcggcaaagaagaaaucaccccucacugcgcccucauggacugcaucauguucgacgccgccgucagcgggggacucaacucccugguacuacgagcgguccucccacgagacauggucuuccgcaccuccacaccccgcgucguccuauga

SEQ ID NO: 3257 - RNA, 1710 nt, Artificial Sequence
  derived and/or modified CDS sequence (opt11) from Lassa virus__AIT17303__NP
auguccgcaucaaaagaaauaaaauccuuccucuggacacaaucacuacgccgcgaacuuuccggcuacugcuccaacaucaaacuccaaguuguaaaagacgcucaagcccuccuucacggucuagauuucuccgaagucagcaacguccaacgccugaugcgaaaacaacgacgcgacgacuccgaccucaaacgccuucgggaccucaaccaagcagugaauaaccuagucgaacucaaaucaacacaacaaaaaucaguccuccgaguaggaacacucaccuccgacgaccuacucguccuagccgccgaccucgaaaaacuaaaauccaaagucauccgcaccgaacgcccccuaucuucuggcguauacaugggcaaccucuccagccaacaacucgaccaacgcagagcacuucucaacaugauaggaaugucuggcggaaaccagggcgcccaaguaggcagagacggcguagucagaguaugggacgugaaaaacgcagaccuacuaaacaaccaguucggcaccaugcccucccucacccucgcaugccucacaaaacaagggcaaguagaccucaacgacgucguccaagcccucaccgaccucggacucauauacaccgccaaauaccccaacacaucagaccuagaccgacucguccaaucccaccccauccuaaacaugauagacacaaagaaauccagccuaaacaucucaggcuacaacuucucacucggugcagccguaaaagccggcgccugcaugcucgacgguggcaacaugcucgaaaccauaaaagucagcccccaaaccauggacgggauacuaaaauccauacucaaagucaagaaagcccucggcauguucauauccgaaacaccaggagaacgcaacccauacgaaaacauacuauacaaaauaugccucuccggcgacggauggccauacaucgccagccgcaccaguaucaccggcagagccugggagaacacaaucguagaccuagaaucagacggcaaaccacaaaaagccggaagcaacaacucuaacaagagcuuacagagcgccggcuucaccgccggacuaaccuauucccaacuaaugacacugaaagacagcaugcuccagcuugaccccaacgcgaaaacguggauggacauagaaggcagacccgaagaccccguagaaguagcccucuaccaacccuccagcggcugcuacauccacuucuuccgcgaacccaccgaccuaaaacaauucaaacaagacgcaaaauacucccauggcaucgacguaaccgaccucuucgccgcacaacccggccucacaucagccgugaucgaagcacucccccgcaacauggucauaaccugccaaggcagcgacgauauccgaaaacugcucgaaagccaaggacgcaaagauaucaaacucaucgacaucgcccuuaacaaaaccgacucucgaaaauacgaaaacgccguuugggaccaauacaaagaccuaugccacaugcacaccggcgucgucgucgaaaagaagaaaagaggcggcaaagaagaaaucaccccacacugcgcccugauggacuguauaauguucgacgccgccguauccggcggacuaaaaacccucguccuccgcgcaguacucccacgcgacaugguauuccgcaccagcacccccaaagugguccucuag

SEQ ID NO: 3258 - RNA, 1710 nt, Artificial Sequence
  derived and/or modified CDS sequence (opt11) from Lassa virus__AIT17307__NP
augagcgcgagcaaagaaaucaaaucguuccuguggacccaaucccuccgccgcgaacuauccggcuauugcucaaacauaaaacuccaagucgucaaagacgcacaagcccuacuccacggccuagacuucagcgaaguauccaauguacagcgacuaaugcgcaaagagcgacgcgacgacaacgaccuaaaacgacuucgagaccucaaccaagccgucaacaaccuaguagaacucaaauccacucaacaaaaauccguacuacgagucggcacacuaaccagcgacgaccuccuaauccuugcagcagaccuagaaaaacuaaaauccaaaguaacccgcacagaacgcccacuaucggcaggcgucuacauggguaaccucuccucccaacaacucgaccaacggcgcgcacuccuauccaugaucggcauguccggcggcaaccagggcgcacgcacaggccgcgacggcguaguacgcgucugggacgugaaaaacgcugaacuccuaaauaaccaauucggcacaaugcccucccucacccucgcaugccucacaaaacaaggccaaguagaucucaacgacgucgugcaagcccugaccgaccucggccucauuuacaccgccaaauacccaaacaccucagaccuagacagacucacacaaucgcaccccauccuuaacaugaucgacacaaagaaauccucacuaaacaucuccggcuacaacuucucacuaggcgccgccguaaaagcaggagccuguaugcuagacggaggcaacaugcuagaaacaaucaaagucagcccccaaacaauggauggaauccugaaauccaucuuaaaaguaaagaaagcucucggcauguucaucuccgacacacccggagaacgcaacccauacgaaaacaucuuauacaaaaucugccucuccggcgauggauggcccuacauagccucacgaacuuccaucaccggccgagccugggaaaacacagucguagaccucgaauccgacggcaaacuacagaaaaccggcagcaacaacuccaacaaaucucuccaauccgcaggcuucacagcaggccucacauacagccaacucaugacccuaaaagacgcaaugcuacaacucgacccaaacgcaaaaaucuggauggacaucgaaggccgcccagaagaccccguagaaaucgcccuauaccaaccaucaucaggcuguuacauccacuucuuccgcgaacccaccgaccucaaacaauucaaacaagacgccaaauacagccacggaauugacguaaccgaccucuucgccgcacaaccaggccucaccagcgccgucaucgacgcccuaccaagaaacaugguuaucacaugccaaggcucagacgacauacgaaagcugcuagaaucccaaggacgcaaagacauaaaacuaaucgacaucgcccucaacaaaacagacucccgcaaauacgaaaacgcagucugggaccaauacaaagaccucugccacaugcacacaggcgucgucgucgaaaagaaaaagaaaggagguaaagaggaaaucacaccccacugcgcccuaauggacugcauaauguucgacgccgccgucagcggcggacugaacaccagcguccuccgcgccgugcuccccagagacaugguguuccgcaccucuacuccccgagucguacuguga

SEQ ID NO: 3259 - RNA, 1710 nt, Artificial Sequence
  derived and/or modified CDS sequence (opt11) from Lassa virus__AIT17311__NP
augagcgcgagcaaagaaauaaaauccuuccuauggacccaaucacuacgcagagaacuaucaggcuacugcucaaacaucaaacuccaagugguaaaagacgcccaagcgcuguuacacggacucgacuucucagaggucuccaacguccaacgccucaugcgcaaagagcgcagggacgacaacgaccucaaacgccucagagaccuaaaccaagcaguaaacaaccuaguagaacucaaaucaacgcaacaaaaauccgugcuaagagucggcacacuaacauccgaugaccuucuaauccuagccgccgaccucgaaaaauuaaaauccaaagucauccgaacagaacgcccccuauccgcaggcguguacaugggcaaccucagcucccaacaacuugaccaaaggcgcgcacuacucaacaugaucggcaugggaggcucgaaccaaggagccagagccggacgcgacggcgucguccgagucugggacgucaaaaacgcagagcuacucaacaaccaauucggaacaaugcccucacucacacucgcaugccucaccaagcaaggacaaguugaccuuaacgacgccgugcaagcccucacagaccucggccucaucuacaccgccaaauaccccaacacaagcgaccuagacaggcucacucaaucccaccccauccuuaacaugauagauaccaagaaaucaucacuuaacaucucaggcuacaacuucucacucggagccgcagucaaagcaggagccugcaugcucgacggcggaaacaugcucgaaacaaucaaagucagcccacaaaccauggacggcauccuaaaaagcauccucaaaguaaagaaagcccuaggcauguucauaucagacacaccaggagaacgcaacccauacgaaaacauccuauacaaaauaugucuuucaggagacgguuggcccuacaucgccagccgcaccuccauaacagggagagccugggaaaacacaguggucgaccucgaauccgacggaaaaccacagaaagccggcagcaacggguccaacaaaucuuuacaaagcgcaggcuucacagccggacucaccuacucacaacucaugacccucaaagacgccaugcuacaacuagaccccaacgccaaaaccuggauggacaucgaaggccgcccagaggaccccguagaggucgcccuauaccaaccaaguucgggcugcuacauccacuucuuccgcgaacccacagaccuaaaacaauuuaaacaagacgcaaaauacucacacggcaucgacguaaccgaccuauucgccgcccaacccggccuaaccuccgcagucaucgacgcccuccccagaaacauggucauaaccugccaaggcucugacgacauccgcaaacuccucgaaagccagggaagaaaagacaucaaauuaaucgacauagcacucagcaaaaccgacucccgcaaauacgaaaacgcgguaugggaccaauacaaggaccuaugccacaugcacacaggcaucgucguagaaaagaagaaacgcggcggcaaagaagagauaacaccgcacugcgcacuaauggauugcauuauguuugacgcagccguauccggaggccuaaacacgucuguacuccgagccguacucccccgcgacauggucuuucggacuuccacaccccgcguuguacucuaa

SEQ ID NO: 3260 - RNA, 1710 nt, Artificial Sequence
  derived and/or modified CDS sequence (opt11) from Lassa virus__AIT17315__NP
auguccgcgucaaaagaaauaaaguccuuucucuggacccaaucacucagacgagaacuauccggcuacugcuccaacaucaaacuucaaguagucaaggacgcccaagcacuccuacacggacuggacuucagcgaggucuccaacguacaacgccucaugcgaaaagagcgaagagacgacaacgaccucaaacgccuacgcgaccucaaccaagcagucaacaaccucguagagcuaaaauccacccaacaaaaaucaguccuucgcguagguacccucacaagcgacgaccuccuaauacuagcugccgaccucgaaaaacuaaagagcaaaguaaccagaacagaacgcccacuauccgcaggcguuuacauggggaaucuuuccagccaacaacucgaccaacgccgcgcgcuccucaacaugaucggcaugucaggaucaaaccaaggcgcccgagccggccgagacggcgucguccgaguaugggacgucaaaaacgucgaacuacucaacaaccaauucggaaccaugccaucacugacacuugcaugccuaaccaagcaaggccaaguagaccucaacgacgcaguccaagcccucaccgaccucggccucaucuacaccgcaaaauaccccaacacauccgaccucgacagacuuacacagucccaccccauacuaaacaugaucgacacaaagaaauccucccucaacauaagcggcuacaacuucagccucggcgcagcagucaaagcuggggccugcauguuagacggcggcaauaugcucgaaacaaucaaggucuccccacagaccauggacggaauccucaagagcauccuaaaagucaagaaagcccuaggcauguucauauccgacaccccaggcgaacgcaaccccuacgaaaacauccuauacaaaaucugccucucaggcgacggauggcccuacaucgcaucccgaaccuccaucaccggcagagccugggaaaacaccgucgucgaccucgaauccgacggaaaaccucaaaaagcaggcuccaacuccucaaauaaaucacuucaaagcgcgggauucaccgcagggcuaaccuacagccaacucaugacccucaaagacgccaugcuccagcuugacccuaacgcaaaaaccuggauggacauagaaggccgcccggaggaucccguagaaauagcacucuaccaacccuccucgggcugcuacauccacuucuuccgugaaccgaccgaccuuaaacaauuuaaacaagacgccaaguacucacacggcauagacgucacagaccuauucgcagcccaacccggacucaccucagccgucauagacgcacuaccacgaaacauggucaucacgugccaaggaucugacgacauacgcaagcuccucgaaucacaaggccgcaaagacauuaaacuaaucgacaucgcccugucaaaaacagauuccagaaaguacgagaacgcaguaugggaccaauacaaagaccucugccacaugcacaccggcauagucguagagaaaaagaagaaaggauccaaagaagaaauaacaccacacugcgcacuaauggacugcaucauguucgacgcagcggucuccggcggccuuaacgccuccguacucagagccguccucccccgagauauggucuuccgcaccucaacaccccgggucguccuuuaa

SEQ ID NO: 3261 - RNA, 1710 nt, Artificial Sequence
  derived and/or modified CDS sequence (opt11) from Lassa virus__AIT17319__NP
augucagcauccaaagaaaucaaauccuuccucuggacgcaaucccuccgacgcgaacucagcggcuacugcucaaacauaaagcugcaggucgucaaagacgcccaagcucugcuacacggccucgacuucuccgaaguauccaacguccaacgccuuaugagaaaacaaagacgcgacgacuccgaccucaagcgccuaagagaccuuaaccaagcggucaacaaccucgucgaacucaaaagcacacaacaaaaguccguccuccgaguaggcacacuaaccagcgacgaccuacucguccucgccgccgaccucgagaaacuaaaaagcaaagucauccgaacggaacgcccccuauccucuggagucuacauggguaaucucucaucacaacaacuagaccaacgcagagcacuccuaaacaugaucgguaugagcggcgggaaccagggcgcacaagucggccgcgacggggucguccgcguaugggacguaaagaaugccgacaugcuaaacaaccaauucggaaccaugccaucgcugacccucgcaugccuaaccaaacaagggcaagucgaccucaacgacguaguccaagcccuaaccgaccucggccuuaucuacaccgccaaguaccccaacaccucagaccuagaccgacucgcccaaucccaccccauccucaacaugauagacacuaagaaauccagccucaacaucuccggcuacaacuucucccucggagcugccgucaaagccggugcaugcaugcucgacggaggaaacaugcucgaaacaauaaaagucuccccgcagaccauggacggaaucuuaaaaucaauccucaaaguaaagaaagcacucggcauguucaucagcgaaacacccggcgaacgcaacccauacgagaacauccuguacaaaauaugccuuuccggagacggcuggcccuauaucgccucccgaacauccaucacaggccgagccugggaaaacacuaucgucgaccuagaaagcgacggaaaaccacaaaaagcuggauccaacaacagcaacaaaagccuccaauccgccggauucacagccggacucaccuacucccaacuaaugacacuaaaagacagcaugcuccaacuggaccccaacgcaaaaaccuggauggacaucgaaggccgcccagaagauccugucgaagucgcacucuaccagccuucaucaggcugcuacauccacuucuuccgagaaccaaccgaccuaaaacaauucaaacaagacgccaaguacucacacggcaucgacgucacagaccucuucgcagcacaacccggccucaccuccgccgucaucgaagcacugcccagaaacauggucauaaccugccaaggcucagacgacauccgcaaacuccuagaaagccagggccgaaaagauaucaaauuaauagacauugugcuaaacaaaaccgacucacgcaaauacgaaaacgccgucugggaccaguacaaagaccucugccacaugcacaccgguguagugguagagaagaagaaacgcggcggcaaagaagaaaucaccccacacugcgcacuaauggacugcauaauguucgacgccgccguuagcggcggccucaaaaccaugguccucagagccguccucccgcgcgacaugguauucaggaccuccacucccaaagucguacuauag

SEQ ID NO: 3262 - RNA, 1710 nt, Artificial Sequence
  derived and/or modified CDS sequence (opt11) from Lassa virus__AIT17323__NP
augucagccagcaaagaaaucaaauccuuccuauggacacaaucacuaagacgcgaacucucaggcuacugcucaaacaucaaacuccagguggucaaagacgcccaagcccuacuccacgggcucgacuucuccgaaguaucaaacguccaaagacugaugcgcaaacaacgccgugacgacagugaccuaaagcgacuacgugaccuaaaccaggccgucaacaaccucgucgagcucaaguccacccaacaaaaaucaguccuccgcguuggcacccucacauccgacgaccuacuuguccucgccgcugaccuugaaaaacucaaaagcaaagucauccgcaccgaacggccccucagcaguggaguauacaugggaaacuuaagcucacaacagcucgaccaacgcagagcacuccuaaacaugauaggaaugagcggcggcaaccaaggcgcccaaguaggccgcgacggcguagugagagucugggacguaaagaacgccgaccuccucaacaaccaauucggcacaaugcccucccucacccuagcaugccuaaccaaacaaggucaagucgaccucaaugacgucguacaagcacucaccgaccucggccuaaucuacaccgcaaaauaccccaacacaagcgaccucgaccgacuagcacaaucacacccaauucucaacaugauagacaccaagaaaucgucccucaacaucucaggauacaacuucucucucggcgccgccgucaaagccggggccugcaugcuugacggcggcaacaugcuagaaacaaucaaagucuccccacaaacaauggacggcauccuaaaauccauacucaaagucaagaaagcacuaggcauguucauaagcgaaacacccggagaacgcaaccccuacgaaaacauccuauacaaaauaugccuauccggcgacggcuggcccuacaucgcaucccggaccucaaucacaggccgugcaugggaaaacaccaucgucgaucuagaauccgacggaaaaccacaaaaagccggcuccaacaacuccaacaaaagccuccaguccgccggcuucaccgcaggacuaacauacucacaacucaugacacuaaaagacagcaugcuccagcucgaccccaacgccaaaacauggauggacaucgaaggacgaccagaagacccagucgaaguagcccucuaccagcccagcagcggaugcuacauucacuucuuccgagagcccaccgaccucaaacaauucaaacaagacgcuaaauacucccacggcauugacguaacagaccuauucgccgcacaaccaggccucacauccgcaguaauagaagcccuaccccguaacauggucaucacaugccaaggcagcgacgauauacgaaaacuacuagaaagucagggccgaaaagacauaaaacucaucgacaucgcucucaacaaaaccgacucccgaaaauacgaaaacgcagucugggaccaauacaaagaccuuugccacaugcacaccggaguggucguagagaaaaagaaacgagguggaaaagaagaaaucaccccucacugcgcccucauggacugcaucauguucgacgcagcagucuccggcggucuaaaaacccuaguacuccgcgcaguccucccacgcgacauggucuuccgcacauccacccccaaagucguacucuaa

SEQ ID NO: 3263 - RNA, 1710 nt, Artificial Sequence
  derived and/or modified CDS sequence (opt11) from Lassa virus__AIT17325__NP
augagcgccucaaaagagauaaaguccuucuuauggacccaaucccuaagacgcgagcucucgggauacugcucuaacauaaaacuccaaguugucaaagacgcccaagcccuacuccacggccucgacuucucagaagucuccaacguccaacgacuuaugcgcaaacaacggcgcgacgacaacgaccucaaacgccuccgcgaccuaaaccaagcaguaaacaaccuggucgagcucaaaagcacccaacaaaaauccguccuccgcgucggcacccucacaucagacgaccuccuaguccucgcggcggaccucgaaaaacuaaaaucgaaagugacccgcaccgaacgcccccucagcgccggugucuacaugggcaaccuuagcucucaacaacucgaccaaagacgcgcacuccuaaacaugauaggcaugacuggcgguucccgcggggcacaagcaggaggcgacggcgucguccgggucugggacgucaaaaacgcugaccuccuaaacaaccaauucggcaccaugcccucccuaacccucgcaugucuaaccaaacaaggccaagucgaccucaacgauguaguccaagcacucacagaucuaggccuaauauacaccgccaaauaccccaacacaucggaccuagaccgacucacacaaucccaccccauacuaaacaugaucgacaccaagaaaucaucccuaaacaucuccggcuacaacuucagccucggcgccgcagucaaagcuggagccugcaugcucgacggcggaaacaugcuagaaacaauaaaaguuagcccccaaacaauggacggcauccucaaauccauccugaaggucaagaaaagccucggcauguucauaucagauaccccaggcgagcgaaaccccuacgaaaacauccuuuacaaaauaugccucagcggcgacggcuggccauauauagcaagcagaaccagcauaaccggccgggccugggagaacacaguaguagaccucgaaagcgacggcaaaccccaaaaagccggcggcaacaacuccaacaaaucacuccaauccgcuggcuucaccgcaggccucacauacagccaacugaugacgcucaaagacacaaugcuccaacucgaccccaacgcaaaaacauggauggacaucgaaggccgucccgaagaucccguagaaguagcccucuaccagcccagcucaggcugcuauauccacuucuuccgcgaacccaccgaccuaaaacaauucaaacaagacgcaaaauacagccacggcaucgacguaaccgaccucuucgccgcccaacccggccugaccuccgccgucaucgaagcccucccccguaacaugguaauaaccugccaagggucggacgacauccgcaaacuccucgaaagccaaggccgcaaagacaucaaacucaucgauaucgcucucucuaaaguagacucccgaaaauacgaaaacgcaguaugggaccaauacaaagaccuaugccacaugcacaccggaguagugguagaaaagaagaaacgcggcggcaaagaggaaauaacuccccacugcgcccuaauggacugcauaauguucgacgccgcagugucgggcggacucaacacccucguccucagagccguacucccccgagacauggucuuccgcaccagcaccccaaaagugguccuuuaa

SEQ ID NO: 3264 - RNA, 1710 nt, Artificial Sequence
  derived and/or modified CDS sequence (opt11) from Lassa virus__AIT17329__NP
augucagcuuccaaagaaaucaaauccuuccucuggacccaaucacuccgccgcgaauuauccggcuacugcuccaacaucaaacugcaaguagucaaagacgcccaagcccuccuccacggacucgacuucagcgaagucucaaacguccaaagacuaaugcgcaaagaaagacgcgacgauuccgaccuuaaacgacucagagaccucaaccaaaccgucaacaaccucguagaacuaaaaucaacccaacaaaaauccauccuccgcgucggcacccuaaccucagacgaccuacuaauccuagccgcagaccucgaaaaacuaaaauccaaaguaauccgcaccgaacgcccucucagcgcuggaguguacaugggcaaucucucaucacaacaauuagaccaacgacgcgcccuacucaacaugaucggaauguccuccggcaaucagggagcgcaagcaggcagagacggagucguccgcgucugggacgucaaaaacgccgaacuccucaacaaccaauucggaaccaugccaucccugacauuagcaugccucacaaaacaaggccagguugaccuaaacgacgcaguccaagcucuaaccgaccucggucuuaucuacaccgccaaauaccccaacaccucagaucucgaccgccucacccagucucaccccauccucaacaugauagauacaaagaaauccagccucaacauaagcggauauaacuucucccuaggcgcagcagugaaagcuggagcaugcaugcuugacggaggcaacaugcuugaaaccaucaaagucuccccacagaccauggacggcauccucaaaagcauccucaaggucaagaaagcgcucggaauguuuaucagcgacacccccggcgaacgcaaccccuacgaaaacauccucuacaaaaucugccucucaggcgacggcuggccguacauugcaucccgcacaucaaucacagggcgagccugggaaaacaccgucguagaccuagaaucagacggcaugccccaaaaagcgggaagcuccagcucaaacaaaagccugcaaucagccggauuuguagccggccuuaccuacucccaacucaugacacuaaaagacgcaaugcuccaacucgaccccaacgcaaaaaccuggauggacauagaaggccgccccgaagaccccgucgagaucgcacucuaccagcccagcuccggcugcuacauccacuucuuccgcgaacccaccgaucuaaaacaguucaaacaagacgccaaauauagccacgguauagacgucaccgaccucuucgcagcccaacccggccuaaccuccgccgucauagacgcccuccccagaaacaugguaauaaccugccaaggcuccgacgacauccguaaacuucucgaaucccagggccgaaaagacaucaaacucaucgacaucgcccugucaaaagccgacucacgcaaauacgaaaacgccgucugggaccaguacaaggaccugugccacaugcacaccggcgucgucgucgaaaagaagaaacguggcggcaaagaagaaaucacaccccacugcgcacucauggacugcauaauguaugacgccgcagucucuggaggacuaaacaccucgguccuacgcgcuguccuccccagagauauggucuuccgaaccuccacaccccgcgucguacuauaa

SEQ ID NO: 3265 - RNA, 1710 nt, Artificial Sequence
  derived and/or modified CDS sequence (opt11) from Lassa virus__AIT17333__NP
augucagccagcaaagaaauaaaauccuuccucuggacucaaucacugcgccgagagcucuccggauacugcucuaacaucaaacuccaagucgucaaagacgcacaagcccuccuacauggccucgacuucagcgaagugagcaacguccaacgccuuaugcgaaaagaacgacgggacgacaacgaccucaagcgguuacgcgaccucaaccaagccgucaacaaccucgucgagcucaaauccacacaacaaaaauccguacuaagagucggcacgcucaccuccgacgaccuccuaauccuagcagccgaccuagaaaaacuuaaguccaaaguaacccggaccgaacgcccccucucagccggcgucuacauggguaaccucucgucccaacagcucgaucaacgacgagcccuccucaacaugaucggaauguccgggggcaaccaaggcgcccgagccggccgagacggcguaguacgcgucugggacgucaaaaacgccgagcuccuaaacaaccaauucggcacaaugccgucacuaacccuugcuugucuaaccaagcaaggccaaguagaccucaacgacgcaguacaagcucucaccgaccuuggccucaucuacaccgcuaaauaccccaacacauccgaccucgaccgccuaacacaaucacaccccauacuaaacaugauagacaccaagaaaucaagccuaaacaucucaggcuacaacuucucccuaggcgcagccgucaaagcaggcgcaugcaugcucgacggcggcaacaugcuagaaaccaucaaagucucuccccaaaccauggacucaauacucaaaucaauccuuaaaguaaagaaagcacuaggcauguucaucagcgacacccccggcgaacgcaacccauacgaaaacauccuauacaaaauaugccucuccggcgacggcuggcccuacaucgccagucgcaccucaaucacaggccgcgccugggaaaacacugucgucgaccucgaaagcgacggaaagccacaaaaagccggcagcaacaacucaaacaaaucacuccaguccgccggcuucgccgcaggccuuaccuacucccaacuaaugacccucaaagacgccaugcuacaacucgaccccaacgcaaaaaccuggauggacaucgaaggccgacccgaagaccccgucgaaaucgcacucuaccaacccucauccggcugcuauauacacuucuuccgagagccaacugaucuuaaacaauucaagcaagacgcgaaauacagccacggaauugaugucaccgaucucuucgccgcacaaccaggacucaccuccgccgucaucgacgcacuuccccgcaacauggucauaacaugccagggaagugacgacauccgaaaacuccuagaaagccaagggcgcaaagacauaaagcucauagacaucgcacuaaguaaaacagauucccgaaaauacgaaaacgcggucugggaccaauauaaagaccuaugccacaugcauaccggcauagucgucgaaaagaagaaaagaggcggaaaagaagaaaucacgccacacugcgcccucauggacugcauaauguucgacgcagccguaagcggaggacuuaacacauccguacuccgcgccguacucccucgcgacauggucuuccgcacauccacgccccgcgugguauuauaa

SEQ ID NO: 3266 - RNA, 1710 nt, Artificial Sequence
  derived and/or modified CDS sequence (opt11) from Lassa virus__AIT17335__NP
augagcgccuccaaagaaaucaaauccuuccucuggacccagagccuacgccgagaacucagcggcuacugcuccaacaucaaauuacaaguagucaaagacgcccaagcccuacugcacggccuagacuucuccgaagucucgaacguccagcgccucaugcgcaaagaacgacgagacgacucagaucuuaaacgguugagagaccucaaccaggccgucaauaaccucgucgaacucaaaagcacacaacaaaaauccauacuccgcgucggcacccugaccagugacgaccuacucauacuagccgccgaccucgaaaaacucaaaucaaaagucacacgcaccgaacgcccccuaucggccggugucuacaugggcaaccuaucuucccaacaacucgaccaacggcgagcucuacuaagcaugaucggcaugucauccggcguacaaggagccagagcaggacgcgacggcgucguacgcguuugggacgucaaaaacgcugaacuacuaaacaaccaauucggcacaaugcccucacuaacccuagccugccuaaccaaacagggccaagucgaccucaacgauguaguacaagcacucacagaucucggacucaucuacaccgccaaauaccccaacacauccgaccucgaccgacuaacacaaucacacccaauucucaacaugauagacaccaagaaauccagccuaaacauaucuggcuacaacuucagccuaggcgcagccgucaaagccggagccugcaugcuagacggaggaaacaugcuagaaacuaucaaaguguccccacagacaauggacggaauccuaaaaagcauauuaaaagucaaaaaggcccuuggcauguucauauccgagaccccaggcgaacggaaccccuacgaaaacauacuauacaaaauaugccucucgggagacgguuggccauacaucgccagccggaccuccauuacaggcagagccugggaaaacaccguaguagaccuagaaucagacggaaaaccccaaaaagccggcuccaacaacuccaauaaaucccuccaaagcaccggcuucgccgccgggcuaacguacagccaacucaugacacucaaagacgccaugcuacaacucgacccaaacgcaaaaaccuggauggacaucgaaggacgacccgaagaccccguagaagucgcccuauaccaacccagcuccggcugcuacauacacuucuuccgcgaacccaccgaucuaaaacaguucaaacaggacgcgaaauacucccacggcauagauguaacggaccuguuugccgcccagcccggccucaccucagccgucaucgacgcccuuccccgaaauaugguaauuaccugccaaggcucagacgacaucaagaaacuacuagaaagccaaggacgaaaagacaucaaacugaucgacaucgcccucucaaaaaccgacucccgcaaauacgaaaacgcugucugggaccaauacaaagaccuaugucacaugcacaccggcguagucgucgagaaaaagaaacgcggcgggaaagaagaaaucacaccccacugcgcccuuauggacugcauaauguucgacgcggccgucucagggggacuaaacaccucuguccuccgcgcaguacucccgcgcgacauggucuuccgaaccuccacaccccgcgucguccucuga

SEQ ID NO: 3267 - RNA, 1710 nt, Artificial Sequence
  derived and/or modified CDS sequence (opt11) from Lassa virus__AIT17341__NP
augucagcaucaaaagaaauaaaauccuuccucuggacccaaucgcucagaagagaacuuuccggcuacugcuccaacaucaaacuccaagucgucaaggacgcacaagcccuacuacacggacuagacuucuccgaaguaucgaacguacagaggcucaugaggaaggagaggcgagacgacaacgaccucaaacgccuccgcgaccucaaccaagcagucaacaaccucguugaacucaaguccacccaacaaaagucaauccugagagucggcacccucacaucagacgaccuacucauccuagccgccgaccucgaaaaacucaaaucaaaagugacaaggacagaacggccccuaucagcaggcguuuacaugggcaaccuaaguagccaacaacucgaccaacgccgggcacuacucaacaugauaggcaugagcgguggaaaccaaggggcacgagccggccgagacggagucguacgcguaugggacgucaaaaacgcagaacugcucaacaaccaauucggaaccaugccaucccuaacacuagcaugccucaccaagcaaggccaagucgaccuaaacgacgcaguccaggcccuaaccgaccugggacuuaucuacaccgcgaaauacccuaacacaucagaccucgacagacucacccagucccaccccauccucaacaugaucgacacaaagaaauccucgcucaacaucuccggcuacaacuucagccuaggugccgcugucaaagccggagccugcaugcuagacgguggcaacaugcucgaaacaaucaaagucagcccacaaaccauggacggaauccuaaaauccauccucaaaguuaagaaagcacucggcauguucaucuccgacgcacccggcgaacgcaacccauacgagaacauccuauauaaaaucugccuaucaggcgacggauggccauacaucgcaagcagaaccuccaucaccggccgagcaugggagaacacaguagucgaccuggaauccgacggcaaaccacagaaagccgggagcaacggcagcaacaaaagccuacaaagcgccggcuucaccgccggccuaaccuacucacaacuaaugacacucaaagacgccaugcuccagcucgacccaaaugccaaaaccuggauggacaucgaaggccgccccgaagacccaguagagaucgcccucuaccaacccuccucaggcugcuauauacacuucuucagagaaccaaccgaccucaaacaauucaaacaagacgcaaaguacucccacggaaucgacgucacagaccuauucgcagcccaaccaggucucaccuccgccguaauagacgcacucccccggaacaugguaauaaccugccaaggcuccgaugacauccguaaacucuucgaaucgcaaggacgaaaagacauaaaacucauagacaucgcccucuccaaagcggacuccagaaaauacgaaaacgcagucugggaccaguacaaagaccucugccacaugcacaccggcguaguugucgaaaagaagaaaagaggcggcaaagaagaaauaacaccccacugcgcccuaauggacuguaucauguucgacgccgcgguaucuggcggacucaacaccucaguacuccgagccguccucccacgagacaugguauuccgcaccagcacccccagggucguacucuaa

SEQ ID NO: 3268 - RNA, 1710 nt, Artificial Sequence
  derived and/or modified CDS sequence (opt11) from Lassa virus__AIT17345__NP
augucggccagcaaagaaauaaaaucauuccuguggacgcaaucccuucgacgcgaacuauccggcuacugcuccaacaucaaacuacaagucgucaaagacgcccaagcacugcuccacggccucgacuucuccgaggucuccaacgugcaacgccucaugagaaaagaacgccgcgacgauaacgaucucaaacgccuacgcgaccuaaaccaagcuguaaacaaccuuguagaacucaaaagcacccaacaaaaauccauacuccgcguagguacccuaaccuccgacgaccuacugauccuggcggccgaccucgaaaaacucaaauccaaagucacacgcaccgaacgcccacucucggccggaguauacauggguaaccucuccagccaacaacucgaccaacguagagcccuacuaucaaugauaggcauguccuccggaguccaaggagccagagccggccgcgacggaguaguucgcgucugggaugucaaaaacgcagaacuucuaaacaaucaauucggcaccaugccuucucucacccuagcuugccucaccaaacaagggcaaguagaccucaacgacguaguacaagcacucaccgaccucggccucauauauaccgcaaaauaccccaacacauccgaccuagaccgccuaacacaaagccaccccauccucaacaugaucgacacaaagaaaucaucccucaacauauccggcuacaacuucucccucggcgccgcagucaaagccggcgcguguaugcucgauggcggcaacaugcuagaaaccauaaaaguaagcccccaaaccauggacggcauccucaaaucaauccucaaagucaagaaagcccucggcauguucauauccgaaaccccaggcgaacgcaaccccuacgagaacauccuauacaaaauaugccuaucaggagacggcuggccauacaucgcuagccgcacaucaaucacaggccgcgcaugggaaaacacagucguagaccucgaauccgacgggaaaccucagaaagccggaucaaacaacuccaacaaaagccuccaaagcgccgguuucacggccggccucacauacagccaacucaugacccucaaagacgccaugcuacaacuugaccccaacgcaaaaaccuggauggacaucgaaggccgccccgaagacccagucgaagucgcacucuaccaaccaagcagcgggugcuauauccacuucuuccgugaaccuacagaccuaaaacaauucaaacaagacgcaaaauacucccacggcauagaugucacagaccucuucgccgcccaacccggcuuaacaucagcagucaucgacgcgcuaccccgcaauaugguuauaaccugccaaggauccgacgacaucaaaaagcuccuagagucccaaggccgaaaagacauuaaacuaauagacaucgcccuaagcaaaaccgacucccgcaaauacgagaacgccgucugggaccaauacaaagaccucugccacaugcacacaggcgucgucgucgagaaaaagaaacgaggaggaaaagaagaaaucaccccucacugcgcccuaauggauugcauaauguuugaugccgccguaucaggcggccucaacacuuccguucuacgcgccguucucccucgcgacaugguguuucgcaccucaacaccaagagucguccucuaa

SEQ ID NO: 3269 - RNA, 1710 nt, Artificial Sequence
  derived and/or modified CDS sequence (opt11) from Lassa virus__AIT17351__NP
auguccgccagcaaagaaauaaaauccuuccuuuggacccagucacuccgacgcgaacucucaggcuacugcuccaauaucaaacuucaagucgucaaagacgcccaagcacuacuucacggccuagauuucucagaagucucuaacguccaacgacuaaugcgaaaacagcgccgagacgacggcgaccuaaaacgccuacgcgaccucaaucaggccguaaauaaccucgucgaacuaaaaagcacccaacaaaaauccguccuccgagugggaacacucacgagcgaugaccuacuaauucucgccgccgaccuagagaaacucaaaucaaaaguuauacgcacggaacgaccgcuaagcgcaggcgucuacaugggcaaccucucaucccaacaacuugagcaaagacgcgcacuccuaaacaugauaggcauguccuccggcaaccaaggcgcccgaaccggcaaagacggcgucgugcgaaucugggacgucaaaaacgccgaccuccuaaacaaccaauucggaacaaugcccucacucacccuagccugccucacaaaacaaggccaaguagaccucaacgacgucguccaagcccucacagaccucggccuaauauauaccgccaaauacccaaacaccuccgaucucgaccgucucacacaaagccacccaauccucaacaugguagacaccuccaaauccagcuuaaacaucagcggcuauaacuucucccuaggagcagcggucaaagccggagccugcaugcuugacggaggaaacauguuagaaaccauuaaagucucgccccaaacaauggacgggauccucaaauccauccucaaagucaagaaaagccucggcauguucgucucugauacccccggcgaacgaaacccauacgaaaacauacuauacaaaaucugccucagcggagacggcuggcccuacaucgccagccgaaccuccaucaccggcagagcaugggagaauacaguaguagaccucgaauccaacggcaaaccccaaaaagccggcagcaacaacuccaauaaaucacuacaauccacaggcuucaccgccggccucaccuacucacaacuaaugacccuaaaagacgcuaugcugcaacucgaccccaacgcaaaaacauggauggacaucgaaggucgccccgaagauccaguagagaucgcccucuaucaaccauccucgggcugcuacauccacuucuuccgcgaacccaccgaccucaaacaauucaaacaagacgcaaaauacagucacggaauagacguaaccgaccuauucgcggcccagccgggccuaaccucggccguaauagacacacuaccccgcaacauggucauaacaugccaagggagcgacgacauucgcaaacuccuagaaucucaaggcagaaaagacaucaaacucaucgacaucgcccuauccaaaauagacucccgcaaauacgaaaacgcggucugggaccaauacaaagaccugugccacaugcacacaggcgucguugucgagaaaaagaaaagaggcgggaaagaagaaauuacaccccacugcgcccuaauggacugcauaauguucgacgccgcaguauccgggggccugaacgccagcguccuacgcgccgugcucccacgcgacaugguauuccgcaccucaaccccacgcgucguacucuga

SEQ ID NO: 3270 - RNA, 1710 nt, Artificial Sequence
  derived and/or modified CDS sequence (opt11) from Lassa virus__AIT17359__NP
auguccgccagcaaagaaaucaaauccuuccucuggacacaaucccucagacgagaacuguccggauacugcuccaacauaaaacuacaagucgucaaagacgcccaagcccuccuacacgggcucgacuucucagaggugagcaacguccaacgucugaugagaaaagaacgccgagacgacagcgaccuaaaacgccuacgagaccugaaccaggcagucaacaaccucgucgaacuaaaauccacccaacagaaaagcauccuucgcguaggcacacuaaccucagacgaccuccucauccucgccgccgaucucgaaaaacucaagucgaaaguaacaagaaccgaacgcccccuaucagccggugucuauaugggcaaccuaucaucgcaacaacuugaccaacgucgcgcacuccugaacaugcugggcauguccggcucaaaccaaggcgcacgagccggccgcgacggcguaguacgcguuugggacgucaaaaacgcugagcucuuaaacaaucaauucggaaccaugccaagucuaacacuagcaugccucacaaaacaaggacaaguagaccucaacgacgcagugcaagcccuuacagaucucggccuaaucuacaccgccaaauacccaaacaccucagaccuagaccgccucacccagucccacccaauccuaaacaugaucgacacaaagaaauccucccucaacaucuccggauacaauuucucccuaggcgcagccguuaaagccggcgccugcaugcucgauggaggcaacaugcucgaaacgaucaaagucuccccacaaacgauggacggaauacucaaauccauccucaaagugaaaaaggcccuaggaauguucauaagcgacaccccgggagaacggaaccccuacgaaaacauccucuauaaaaucugccucuccggcgacggcuggcccuacaucgccucccgaaccuccaucacaggccgcgccugggaaaacaccguagucgaccucgaaucagacgaaaaaccccaaaaagccggcagcaacuccuccaacaaaucacuccaaucugcaggauuuaccgcaggccuaaccuacagccaacuaaugacacucaaagacgccaugcuccaacucgaccccaacgccaaaacauggauggacaucgaaggccgaccagaggaccccgucgaaauagcacucuaccaaccuagcuccggcugcuacauccacuucuuccgugaacccacagaccuaaaacaauucaaacaagacgcgaaauacucccacggcaucgacgucaccgaccucuucgccgcccaaccuggccuaaccagcgccgucaucgacgcccucccccgcaacauggucaucacaugccagggcuccgacgacauccgcaaacuauuagaaucacaagggagaaaagacauaaaacugaucgacaucgcacucuccaaaaccgacagucgaaaauacgaaaaugcagucugggaccaauacaaggaccucugccacaugcacacaggcaucguugucgaaaagaagaaacgcggaggaaaagaagaaaucacaccccacugcgcacucauggacugcaucauguucgacgccgccgucucaggcggccuaaacgcauccguccuccgagccguccucccccgcgacauggucuuccgaacaagcaccccacgcguaguccuauaa

SEQ ID NO: 3271 - RNA, 1710 nt, Artificial Sequence
  derived and/or modified CDS sequence (opt11) from Lassa virus__AIT17361__NP
augagcgccagcaaagagauaaaauccuuccuuuggacccaaucccuccgacgagaacucagcggcuacugcuccaacauaaaacuccaagucgucaaagacgcacaagccuuacuccacggccuagauuucucugaaguaagcaacguacaacgacucaugcgaaaagagcgccgagacgacucagaucucaaacgccucagagaccuaaaccaggcagucaacaaccuuguagaacuuaaaagcacccagcaaaaaucaguccuccgaguaggcacucuaacauccgacgaccuccuaguccucgcagccgaccuagaaaaacucaaaucaaaaguuacccgaacagaaaggccuuuaagcgcaggcgucuacaugggaaaccuauccucccaacaacucgaccaacgccgcgcacuacucaacaugauaggcauguccggaggcaaccaaggagcaagagccggacgcgacggcgucguccgcauaugggacgucaaaaacgccgagcuacucaacaaccaauucggcacaaugcccucccucacccuagcaugccucaccaaacaaggccaaguagaccuuaacgacgucguacaagcccuaaccgaccuagggcuuaucuauacagccaaauauccuaacacauccgaccucgaccgccucacacaaagccaccccauccucaacaugauagacacaaagaaaucaagccucaacauaaguggcuacaacuucucccucggagcugccgucaaagcaggcgccugcauguuagacggcggaaacaugcucgaaacaauaaaagucagcccccaaaccauggacggcauccucaaauccauccugaaagucaagaaagcacuaggaauguucaucagcgacacacccggagaaagaaacccauacgaaaacaucuuauacaaaaucugccucucaggcgacggcuggcccuacaucgccucccgcacaucaaucacgggacgcgcaugggaaaacacaaucguagaccuugaaagcgacggaaaaccccagaaaaccaacaacacaaacuccaacaaaucccuccaaagcgccggcuucgccgccggccucaccuacucucaacucaugacccuuaaagacgccaugcuccaacucgaccccaacgcaaaaaccuggauggacaucgagggccgccccgaagacccaguagagauagcucucuaccaacccucaagcggcugcuacauacacuucuucagagaacccacagaccuaaaacaauucaaacaggacgccaaauacucccacgggaucgacgucaccgaccuuuucgcugcccaacccggccugaccuccgccgucaucgauacucuaccccgcaacauggucauaaccugccaaggcuccgaagacauucgccgccuccucgaaucccagggacgaaaagacaucaaacucaucgacaucgcccucucaaaaaccgacucgcgaaaauacgaaaacgccguaugggaccaauacaaagaccuaugccacaugcacacaggagucgucgucgagaaaaagaagaaagguggcaaagaagaaaucacaccacacugcgcgcugauggacugcaucauguucgacgccgcaguuuccgguggccucaacacuucuguucuacgcgccguacucccccgcgacauggucuuccgcacuuccacgcccagagucguccuauaa

SEQ ID NO: 3272 - RNA, 1710 nt, Artificial Sequence
  derived and/or modified CDS sequence (opt11) from Lassa virus__AIT17365__NP
augucagccuccaaagaaauaaaaucuuuccuguggacacaaucccuacgacgcgaacuauccggauacugcucgaacauaaaacuacaagucgucaaagacgcacaagcacuucuacacggccuagacuucuccgaagucuccaacguucaaaggcucaugcggaaagaacgacgcgacgacaacgaccucaagcgacucagagaucuaaaccaggcuguuaacaaccuagucgaacucaagagcacccaacaaaaauccauccuacgcguaggaacccuaacaagcgaugaccuacucauccuagcugccgaccucgaaaaacucaaaagcaaagucacgcgaaccgaacgcccccucuccgcuggcgucuacaugggaaaccuuucaucccaacaacuagaccaacgucgcgcucuccucaacaugaucggcauguccggcagcaaccaaggcgcacaagcuggacgcgacggcgucguacgaguaugggacgucaaaaaugccgaacuccucaauaaccaguucgggaccaugccaucccucacccuagccugccucaccaaacaaggacaaguagaccuuaacgacgcaguacaagcccucaccgaccuuggccucaucuacaccgcaaaauaccccaacacgagcgaccuagaccgacucacacaaucacacccaauauuaaacaugauagacaccaagaaaagcucacugaacaucuccggauacaacuucucgcuaggcgcagccgucaaggccggcgcauguaugcucgacggcggcaacaugcucgaaaccaucaaggucucaccacaaacaauggacggcauccuaaagucaaucuuaaaagucaaaaaggcccuaggcauguucaucagcgacgcccccggugaacgcaacccauacgaaaacauccucuacaaaauuugucuaagcggcgacggcuggccauacaucgccagccgcacauccaucacaggacgagccugggaaaacaccgucguagaccucgaaagcgacggcaaaccccaaaaagcaggcuccaacggcagcaacaagucccuccaauccgcaggcuucacggccggacucaccuauagccagcucaugacacucaaagacgcaaugcuccaacuggaucccaacgccaaaacauggauggacauagaaggccgccccgaggaccccgucgaaauagcccucuaccaacccucaaguggaugcuacauacacuucuuccgcgaaccaacagaccucaaacaauucaagcaagaugcaaaauacucgcauggcaucgacgucaccgaccuguucgccgcacaacccggccugaccuccgccguaaucgacgcacucccccgaaacaugguuaucacaugccaaggcagcgacgacauacgaaaacucuucgaaucccagggccgaaaagacaucaaacuaaucgacauagcccuuucaaaaacggacucacgcaaguacgaaaacgcagucugggaccaauacaaagaccucugccacaugcacaccggcaucgucgucgagaaaaagaaacgcggcgggaaagaagaaauaacuccacacugcgcucucauggacugcaucauguuugacgccgccgucuccggaggauuaaacacaagcguccucagagcagucuuaccccgagauaugguauuccgcaccagcacccccagagucguccuauga

SEQ ID NO: 3273 - RNA, 1710 nt, Artificial Sequence
  derived and/or modified CDS sequence (opt11) from Lassa virus__AIT17371__NP
auguccgcaagcaaagaaaucaaauccuuccucuggacccaaucccuacgacgggaacucagcggauacugcucgaacaucaaacuccagguugucaaagacgcccaggcuuugcuacacggccucgacuucagcgaagucucaaacguccaacgccucaugagaaaagaacgacgagacgacaacgaccucaaaagacuccgagaccuaaaccaagccgugaacaaccuaguagaacugaaauccacccagcagaaaagcauccuccgcguaggcacacucaccucagacgaccuacuuauacuagccgcugaccucgaaaaacucaaaagcaaagucacucguaccgaacgcccccucuccgccggggucuacaugggaaaccucagcucacaacaacuagaccaacgccgagcccuacucaacaugauaggcaugagcggauccaaccaaggcgcacaagcaggacgcgacggcguagucagagucugggaugugaaaaacgcagaacuccucaacaaccaauucggcacgaugcccucacuuacccucgccugccucacaaaacaaggccaagucgaccucaacgacgcaguucaagcccucacagaccuaggacuaaucuacaccgcaaaauaccccaacacauccgaccuagaccggcucacccaaucccaccccauccugaacaugaucgacaccaagaaaucaucccuaaacauuuccggauauaacuucucccuaggcgccgcugucaaagccggagcauguaugcuggacgggggaaacaugcucgaaacaauaaaagugucaccccaaacuauggacggcauccuaaaauccauccucaaagucaagaaagcccucggcauguucaucuccgacgcccccggcgaacgcaacccauacgaaaacauacucuacaaaaucugccuaucgggagacggcuggcccuacauagccucccgcacuucaauaaccggccgcgcaugggaaaacaccguagucgaccucgaaagcgacggcaaaccccaaaaagcuggcucgaacagcagcaacaaaucucuacaaucagccggcuucacagccggccuaacuuacagccaacucaugacccucaaagacgccauguuacaacuagaccccaacgcuaaaaccuggauggacauagaaggccgaccagaagacccaguagaaauagcccuauaucaaccauccucagguugcuacauacacuucuuccgcgaaccaaccgaccucaaacaauucaaacaggacgccaaauacagccacggaauagacguaacagaccucuucgcugcccaacccggccucaccucagccguaaucgacgcccuuccacgaaacauggucaucacaugccaaggaagcgacgacauaagaaaacuguucgaaucccaaggucguaaagacaucaaacuuaucgacaucgcacucuccaaaacagacuccagaaaauacgaaaacgccgucugggaccaguacaaagaccuaugccacaugcauaccggcauagucgucgaaaagaagaaacgcggcggcaaagaagaaaucacaccccacugcgcacucauggacuguaucauguucgacgccgcggucucgggaggccucaacaccucaguucuacgagcaguccucccccgcgacaugguguuccgcacaagcacaccccgcgucguacuauga

SEQ ID NO: 3274 - RNA, 1710 nt, Artificial Sequence
  derived and/or modified CDS sequence (opt11) from Lassa virus__AIT17379__NP
augagcgcauccaaagaaaucaaauccuuccuauggacacaaucacucagacgcgaacucucuggcuacugcuccaacaucaaacuccaaguagucaaagacgcccaagcccuacuccacggccuugacuucuccgaagucuccaacguacagcgccucaugagaaaagaacgcagggacgacagcgaccugaaacgacucagggaccucaaccaagcaguaaacaaccucgucgaacuaaaauccacccaacaaaaaucaguccuccgagucggaacccucaccuccgacgaccuccuuauccucgccgcagaccucgaaaaacugaaauccaaagugacccguaccgaacgcccacugagcgcuggagucuacaugggcaaccuauccucgcaacaacucgaccaacgccgcgcccuccucaacaugaucggaaugagcuccgggaaccgcggcgcacaagccggccgcgacggagucguccgcgucugggacgucaaaaacgccgaacugcuaaacaaccaauucggaaccaugccaucccucacacucgcgugccuaaccaaacagggacaagucgaccuuaacgacgccguccaagccuuaacagaccucggacucaucuacacagcaaaauaucccaacaccucugaccuggaccgacucacacaaucccacccaauccuaaacaugguugacaccaaaaaguccucccuaaacauauccggcuauaacuucucacucggcgccgcagucaaagcgggcgccugcaugcuagacggcggcaacaugcucgaaacaaucaaggucucgccccagaccauggacggcauccugaaauccauccuaaaaguaaagaaagcccuaggaauguucauaagcgacaccccgggagaacgcaaccccuacgaaaacauccuguacaagaucugccucucgggcgauggauggcccuacauagcaagccgaaccucaauaacgggccgcgcaugggaaaacaccguagucgaccuggaauccgacggcaaaccccagaaagcuggauccaacaacagcaacaaaagccuucagucagcaggcuucgcagccggauuaacauacucccaacuaaugacccucaaggacgcaaugcuccaacuagaccccaacgccaagaccuggauggauaucgaaggccgcccagaagaccccgucgaaaucgcccuuuaccaaccauccucgggaugcuacauccacuucuuccgcgaacccaccgaccucaaacaauucaaacaagacgccaaauacucccacggcauugacgucaccgaucuauucgccgcccaacccggacuuaccuccgccguaaucgacgcacucccccgcaacauggucauuacaugccaaggauccgacgacauucgcaaacuacuagaaucccaaggccgcaaagacauaaaacucauagacaucgcccucuccaaaacggacucccggaaguacgaaaacgcugucugggaccaauacaaagaccuaugccacaugcauaccggcauagucgucgaaaagaagaaacgcggaggaaaagaagaaaucaccccacacugcgcccucauggacugcaucauguucgacgcagcagucaguggcggccucaacacaucuguccuacgggccguacucccccgcgacaugguguuccgcacaagcacgccuagagucguacuguga

SEQ ID NO: 3275 - RNA, 1710 nt, Artificial Sequence
  derived and/or modified CDS sequence (opt11) from Lassa virus__AIT17381__NP
augagcgccaguaaagaaauaaaaucauuccucuggacacaaagccuucgacgggaacucucaggcuacugcuccaacauaaaacuacaaguagucaaagacgcccaagcccuacuccacggucucgacuucuccgagguauccaacguccaacgacucaugcgcaaagaacgccgcgacgacuccgaccuaaaacgccucagagaccuaaaccaagccguaaacaaccuagucgagcuaaaauccacccaacagaaaucgguacuccgcgucggaacccucacaagcgacgaccuccuaguccuagccgccgaccuagaaaaacuaaaaucgaaaguaacuagaacagaaagaccccuauccgccggcgucuacaugggcaaccuauccucccaacaacucgaccaacgacgcgcacuccucuccaugaucggcaugucaggcgggaaccaaggcgcacgcgcaggccgagacggcguagugcgaaucugggacgucaaaaacgccgaacuccuaaacaaccaauucgguaccaugccaucacucacacuagccugcuuaacaaaacaaggacaaguagaccucaacgacgucgugcaagcacucaccgaccucggauuaaucuacaccgccaaauacccaaacaccucagaccuggaccgccucacgcaaucccacccaauccucaacaugaucgacaccaagaaauccucccuaaacauaucaggauacaauuucucccucggagccgccgucaaagccggcgcaugcaugcuagacggcggcaacaugcucgaaacaaucaaagucucuccacaaaccauggacggcauccucaaauccauccucaaaguaaagaaagcccucgguauguucauauccgacaccccaggcgagcgaaacccauacgaaaacauccucuacaaaaucugccucucuggcgacgguuggcccuacaucgccuccagaaccucuaucaccggccgcgccugggaaaacaccaucgucgaccucgaaucagacggcaaaccccagaaaaccucaaacacaaacagcaacaaaucacuacaaucagcgggauucgccgcggggcugaccuauucccaacucaugacccuaaaagacgccaugcuccaacuggacccaaacgccaaaaccuggauggacauagaaggccggcccgaggaccccguagaaauagcacucuaucaacccucauccggaugcuacauccacuucuucagagaaccaacagaccuaaaacaauucaaacaagacgcgaaauacagccacggcauugacguaaccgaccucuucgccgcccaacccggcuuaaccuccgccguaauagacgcccugccaagaaacaugguuaucacuugccagggauccgaagacauccgaaaacuccuagaaucccaaggccgcaaagacauaaaacuaauagacaucgcgcucuccaaaaccgacagcaggaaauacgaaaacgccgucugggaccaauacaaagaccucugccacaugcauaccggcgucguagucgagaaaaagaagaaaggcggaaaagaagaaaucaccccgcacugcgcccucauggacugcauuauguucgaugccgccgucagcgguggccucaacacauccgugcuacgagcaguccuaccccgagacaugguauuccggacaucaacacccagaguaguccuauaa

SEQ ID NO: 3276 - RNA, 1710 nt, Artificial Sequence
  derived and/or modified CDS sequence (opt11) from Lassa virus__AIT17389__NP
auguccgcgucaaaagagaucaaauccuucuuauggacccaaucucuccgacgagaacucaguggcuacuguuccaacauuaaacuccaaguggucaaagacgcacaagcucuacugcauggccucgacuucuccgaagugucaaacguccaaagacuaaugcgcaaacaacgacgcgacgacggcgaccucaaacgacugcgcgaccucaaccaagcagugaacaaccugguugaauuaaaaagcacccaacaaaaauccguccuacgagucggaacccuaaccagcgacgaccuccuaauccucgccgccgaccucgaaaagcuaaaauccaaagucacccgcaccgaacgaccucuaucagcaggcgucuacaugggaaacuuauccucccaacaacuggaccaacgacgcgcccuacucaacaugauuggaaugucaggaggaaaccaaggcgcccguacugggaaagauggugucguacgcaucugggacgucaaaaacgcagaccuacuaaacaaccaauucggaaccaugccuucccucacccucgcaugccucaccaaacaggggcaaguagaccuaaacgacgucguccaagcccucacagauuugggacuaaucuacaccgcaaaauaccccaacaccuccgaccucgaccgccucacccaaucgcacccaauccuaaauaugauagacaccuccaaauccucacucaacaucuccggauacaacuucucacucggagccgccguaaaagcuggcgccugcaugcuagacggaggaaacaugcucgaaaccaucaaaguaucuccacaaaccauggacggcauacuaaaaucaauccuaaaagucaaaaagucacuaggaauguucauaagcgacacaccgggugaacgcaacccauacgaaaacauccuuuacaaaaucugucucucaggcgacggauggcccuacaucgcaagccgcaccagcaucaccggccgggccugggaaaacacaguggucgaccuggaauccgacggaaagccccaaaaagccggcaguaacaacagcaauaaaucccuacagagcacuggcuucaccgccggacuuaccuauucccaacucaugacccucaaagacgccaugcuccagcucgaucccaacgcgaaaacuuggauggacaucgaaggcagacccgaagacccagucgaaaucgcccucuaccaaccaagcagcggcugcuacauacacuucuucagagaacccacugaccuaaaacaauucaaacaggacgcaaaguacagccacggaauagacguaacagaccucuuugcagcccagcccggccucaccagugccgugaucgacacacuacccagaaacaugguaauaaccugccaaggcagcgacgacauacgaaaacuacuagaaagccaagggcgcaaagacauaaagcucauagacauagcacucucaaaaaccgauuccagaaaauacgaaaacgccgucugggaccaauacaaagaccucugccacaugcacacaggagucgucgucgaaaagaagaaacgagggggcaaagaagaaauaacuccccacugcgcccuuauggacugcauaauguucgacgccgccgucagcggaggacucaacgucagcguccuccgagccguccuuccacgcgacaugguauucagaaccucaacccccaggguaguccucuaa

SEQ ID NO: 3277 - RNA, 1710 nt, Artificial Sequence
  derived and/or modified CDS sequence (opt11) from Lassa virus__AIT17399__NP
auguccgccucaaaagaaauaaaauccuuccucuggacacaaucucuccggcgugaacucaguggcuacugcuccaacaucaaacuccaaguagucaaagacgcccaagcccucuugcacggacucgacuucagcgaggucagcaacguccaacgacuaaugcgcaaacaacgacgcgacgacagcgaccucaaacgacuacgggaccucaaucaagcagucaacaaccucgucgaacucaaaucuacccaacaaaaaucaguacuaagagucggaacacucaccuccgacgaccugcuaguccucgccgccgaccucgaaaaacuaaaauccaaagugauccgaacagaaagaccacucucaagcggaguauacaugggcaaccuaagcucccaacaacuggaccaacggcgagcacuacugaacaugaucggaauguccggcggcaaucaaggcgcacaaguaggacgagacggaguaguccgagucugggacgucaaaaacgccgaccuccucaacaaccaauucggaacaaugcccucacucacacuugcaugccuaaccaaacaaggccaaguugaccuuaaugacgucguccaagcacucacggaccuaggccucaucuacaccgccaaauacccaaacaccagcgaucucgaccgccucgcgcaaucacaccccauccugaacaugaucgacacaaagaaaucuagccucaacaucuccggcuacaacuucucacucggcgcagcagucaaagccggcgcgugcaugcucgacggcggaaacaugcuagaaaccaucaaagucacaccccaaaccauggacgggauccuaaaauccauacucaaaguuaagaaagcacucggaauguucaucuccgaaacccccggcgaacgcaaccccuacgaaaacaucuuauacaaaaucugucugucgggcgacggcuggccauacauagccucccgcaccagcauaaccggccgagccugggaaaauaccguugucgaccuagaaucggacggcaaaccccaaaaagccggaaacaacaacuccaacaaaucauuacaauccgccggcuucaccgcaggccucaccuauagccaacucaugacacugaaagacagcaugcuccagcuugaccccaacgcgaaaaccuggauggacaucgagggacgacccgaagacccggucgaaguggcccucuaccaaccuuccucgggcugcuacauacacuucuuccgagaacccacagaccucaaacaguucaaacaagacgccaaauauucccacggcauagacguaacagaucucuucgccacucagcccggccucaccucagcagucaucgaagcccucccccgcaacauggucaucacaugccaaggcucagacgacauccgcaaacuacucgagucccaaggcagaaaagacauaaagcucaucgacaucgcccucaacaaaacugacucacgaaaauacgaaaacgcagucugggaucaguacaaagaccucugccacaugcacaccggcgucguuguagagaaaaagaaacgcggcggcaaagaggaaaucacgccacauugcgcacuaauggacugcauaauguucgacgcagccgucucgggaggccugaaaacccucgcccugagagccguccucccacgcgauauggucuuccgcacaucaacacccaaagucguucuauga

SEQ ID NO: 3278 - RNA, 1710 nt, Artificial Sequence
  derived and/or modified CDS sequence (opt11) from Lassa virus__AIT17405__NP
augucagucagcaaagaaguaaaauccuuccucuggacccaaucccuacggcgagaacuguccggcuacugcuccaacauaaaacuacaaguagucaaagacgcacaggcacuucugcacggccucgacuucuccgaggucucaaacguacaacgccucaugcgaaaacaaaaacgggacgacuccgaccucaaacgacuacgcgaccuaaaccaagccguaaacaacuuagucgaacucaaaagcacccaacaaaaauccauccugcgcgucggcacccucaccucagacgaccuacucacccuagccgcagaccuagaaaaacuaaaauccaaagucauacguaccgagcgcccccucucuuccggagucuacaugggcaaccuuucaacccaacaacucgaacagagacgagcccuacucaacaugaucggaauggucggcggagcacaaggaacccaaccaggccgcgacggagucguaagaguaugggacgucaaaaaucccgaccuccuaaacaaccaauuuggaacaaugcccagccugacacucgcaugccucaccaaacaaggccagguagaccuaaacgacgccguacucgcucuaacugaccuaggccucaucuacaccgccaaauacccaaacagcucagaccucgaccgucucagccaaucccacccaauccucaacaugguagacaucaaaaaguccagccucaauauauccggauacaacuucucccuaggagccgcugucaaagccggcgcuugcaugcucgacggaggaaacaugcuagaaacgauaaaaguaaccccacagacaauggacggcauccuaaaaagcauccuaaaggucaaacgcagccucgguauguucgucuccgacacacccggcgaaagaaacccauacgaaaacauccuuuacaaaaucugccucuccggcgacggcuggcccuacauagccucucgcaccuccaucgucgguagagcaugggaaaacaccaccgucgaccucgaauccgacggcaaaccucaaaaagucggcuccgccggcuccaacaaaagccuccaaucagccggauucccaacagggcucaccuauucccaacucaugacacuuaaagacuccaugaugcaacucgacccuucagccaaaaccuggauugacaucgaaggacgucccgaagaccccguagaaauagcccuauaccagccaaugaguggcugcuacauccacuucuuccgagaacccacagaccuuaaacaauucaaacaagacgccaaauacucacacggcauagacguugcagaccuuuuccccgcccaacccggccuuacaucggccguaauagaggcccucccacgcaacaugguccucaccugucaaggcagcgacgacauaaaacgccuccucgacucccaaggcagaagagacaucaagcucauagacaucgcccucucaaaagcagacucacgccgauucgaaaaugccguaugggaccaaugcaaagaccuaugccacaugcacaccggaguaguagucgaaaagaagaaaagaggcgguaaagaagaaaucacaccccacugcgcccucauggacugcauuauguacgaugccgccguaucaggaggucucaacauccccguucuccgugcaguccuaccccgcgacaugguauuccgcaccuccagcccaaaagucguacuguaa

SEQ ID NO: 3279 - RNA, 1710 nt, Artificial Sequence
  derived and/or modified CDS sequence (opt11) from Lassa virus__AIT17409__NP
auguccgccagcaaagaaguuaaauccuuucuauggacgcaaucccuacggcgcgaacucucaggauacugcagcaacaucaaacuccaagucguuaaagacgcccaagcacuacuccacggacuagacuucucagaaguaucaaacguacaacggcuaaugcgaaaacaaaaacgagacgacggcgaccucaaaagacuccgcgaccucaaccaagcugucaacaaccuaguagaacucaaaucuacucaacaaaaauccauacugcgcgucggcacucugacuucagacgaccuucuuacccucgccgcagaccucgaaaaacucaaauccaaagugauaaggaccgagagaccccuguccucaggcguauacaugggaaaccugagcacgcagcaacucgaacaaagacgagcccuguuaaacaugaucggaauggucggcggcgcccaagggacccaaccaggccgcgauggggucguacgcgucugggacgucaaaaacccagaccuccucaacaaccaauucggaacaaugcccucacucacacucgcaugccucacaaaacaaggccaaguagaccuaaacgacgccguacucgcgcuaaccgaccucggacuuaucuacacugcuaaauaccccaacagcucagaccucgaccgacucucccaaagccaccccauccuaaacaugguagacaccaagaaaucaagccuuaacaucuccggcuacaacuucagccucggcgccgccgucaaagccggcgccuguaugcuagacggaggaaacaugcuagaaaccauaaaagugacaccccaaaccauggaugggauacuuaaauccauucuaaaaguaaagaaaucccucggaauguucgucagcgacacccccggcgagcgcaaccccuacgagaacauccuauacaaaaucugccuuuccggggacggcuggccguacauagccucccgcacaucgauagugggccgcgcaugggaaaacaccacugucgaucucgaauccgacggcaaaccccaaaaaguaggcacagccggcuccaacaaaagccugcaauccgcaggcuucccaacuggccucacauacucccagcucaugacccuuaaagacagcaugaugcaacucgauccaucagccaaaaccuggauagacauagaaggacgaccagaagacccugucgaaaucgcccucuaccaaccaaugucaggcugcuacauccacuucuuccgcgaacccaccgaccuaaaacaguucaaacaagacgccaaauacagucacggcauagacgucaccgaccucuucagcgcccaacccggccugacauccgcagucaucgaagcacucccccgcaacaugguacuaacgugccagggaagcgacgacaucaaacgccuacucgacucacaaggccgacgagacaucaaacuaauagacauagcccuuaauaaagccgacucccgcagauucgaaaacgccgucugggaccaaugcaaagaccucugucacaugcacacaggaguaguagucgaaaagaagaaacgcggcggcaaagaagaaauaacaccccacugugcacucauggacugcauaauguacgacgcagcagucucaggcggccuaaacaucccaguccuacgggcaguccuccccagagacauggucuucagaaccucaagccccaaaguaguccucuaa

SEQ ID NO: 3280 - RNA, 1710 nt, Artificial Sequence
  derived and/or modified CDS sequence (opt11) from Lassa virus__AIT17413__NP
augucagccuccaaagaaguuaagagcuuccucuggacccaaucacuuagaagagaacucucaggcuacugcuccucaaucaaacuccaagucgugaaagacgcccaagcccuccuacacggacucgacuucuccgaaguaagcaacguacaacgacuaaugcgaaaacagaaaagagacgacagcgaccuaaaacgacuccgagaccuuaaccaggcggucaacaaccuagucgaacuaaaauccacccaacagaaaagcauacugcgugugggaacccugacaucagacgaccuacuaacacucgccgccgaccuugaaaaacucaaauccaaaguuaucagaaccgaacgcccccuuucaagcggagucuacaugggcaaccucagcacucaacaauuagaacaacgacgcgcacuacuuaauaugaucggcauggucggcggcgcccaaggcacccaaccaggccgggacggagucguccgcgucugggacgucaaaaacccagaccuacuuaacaaccaauucggaacgaugccaagccuaacacuagccugucucaccaaacaaggccaagucgaccucaacgacgcuguccuagccuuaacagacuuaggccuuaucuacacugccaaauaccccaacuccagcgaccucgaccgccucagccaaucacaccccauacucaacaugguagacaccaaaaagagcagccucaacaucuccggcuacaacuucagccugggagccgccguaaaagccggagccugcaugcuagacggaggcaacaugcucgaaacaaucaaagucacaccccaaaccauggacggcauccucaaaucaauccucaaaguaaagcgaagccucgguauguucgucucagacgcccccggugaacgcaacccauacgagaauauccuuuacaagaucugccucucaggcgacggcuggcccuacaucgcgucccgaaccagcauaguuggccgcgccugggaaaacaccaccguagaccucgaaucagacgggaaaccccagaaaaugggaaccgccggcucaaacaaaucccuccaaucagcaggcuuccccacaggccuaacguauucccaacucaugacacuaaaagacuccaugaugcaacuagacccaucagccaaaacuuggaucgacaucgaaggccgcccugaagaccccguagaaauagcccuauaccaacccaugucaggcugcuacauacacuuuuuccgggaaccaaccgaccuaaaacaauucaaacaagacgccaaauauucccacggcauugacguagccgaccucuucccggcucaaccaggacucaccucagccgucaucgaagcacucccacguaauaugguccuaacaugccagggcuccgacgacauaaagaaacuacucgacucccagggccgccgcgacaucaaacuaaucgacauagcccuaagcaaagcagacucgcgccgauucgaaaaugccgucugggaccaaugcaaagaccucugucacaugcacaccggcguaguaguugagaaaaagaaacgcggcggcaaagaagagauaacaccccacugugcccugauggacugcaucauguacgacgccgccguaaguggcggacucaacauccccguccuucgagccguccucccccgagacaugguuuuccgaaccucuucacccaaagucguccucuaa

SEQ ID NO: 3281 - RNA, 1710 nt, Artificial Sequence
  derived and/or modified CDS sequence (opt11) from Lassa virus__AIT17421__NP
augagcgcaagcaaggaagucaaauccuuccuauggacgcaaucgcuacgccgagaacuuucuggcuacugcuccaacaucaaacuucaagucguaaaagacgcacaagcccuucuccauggacuagacuucucagaaguauccaacguccaacgccucaugcgaaaacaaaagcgagacgacucugaccucaaacggcuccgagaccuuaaccaagcaguuaacaaccucgucgaacuaaaauccacucaacagaaaucaauccuccgcgucggaacccucacauccgacgaccuacuaacccucgccgcagaccuugaaaaacucaaauccaaagucauccgcaccgaacgcccucucucaagcggaguauacaugggcaaccuaagcacacagcaacucgaacagcgacgagcacuacuaaacaugaucggcaugguuagcggagcccaaggaacucagcccggccgagacggcguaguccgaguaugggacgucaaaaacccggaccuccuaaacaaccaauucggcacaaugcccucacucacccuagcuugccuuacaaaacaaggccaaguggaccucaaugaugccguccuagcccucaccgaccuaggccuaaucuacacagccaaauacccaaacuccuccgaccuagaucgacuuucacaaucccaucccauccuaaauauggucgacaucaagaaauccucucucaacauauccggcuacaacuucucccuaggcgccgccgucaaagccggagccuguaugcuagacggcggaaacaugcuugaaacaauaaaaguaacaccccaaaccauggacgguauccucaaaagcauccucaaagucaaacgcucccuaggcauguucguuuccgauaccccuggagaacgcaaccccuacgaaaacauccucuacaaaauaugccucucgggcgacggcuggcccuacauagccucacgcacuucgauaguaggccgagccugggaaaacacaaccgucgaccuagaaagcgacggaaagccccagaaaaugggauccgccggcagcaacaagucacuccaauccgccggauuccccaccggacucaccuacucacaacucaugacacuaaaagacucuaugaugcaacucgaccccucagccaaaaccuggaucgacaucgagggcagaccagaagacccggucgaaaucgcccuguaccaaccaaugucgggaugcuacauacacuucuuccgcgaacccaccgaccucaaacaauucaaacaagacgcaaaauacucacacggcaucgacguugccgaccucuuccccgcacaacccggucugacauccgccgugaucgaagcacugccccgcaacaugguccugaccugccaagguagcgaugacaucaaacgccuacucgacucucaaggccgccgagacaucaaacucaucgacauagcccugagcaaagcagacagucgccgcuucgaaaacgcagucugggaccaaugcaaagaccucugccacaugcacaccggaguaguugucgaaaagaagaaaaggggcggcaaagaagaaaucaccccacacugcgcgcucauggacugcaucauguacgacgcagccgucuccggcggacucaacauccccguccuccgcgccguucuccccagagacauggucuuccguaccucuagcccuaaggucguccuauaa

SEQ ID NO: 3282 - RNA, 1710 nt, Artificial Sequence
  derived and/or modified CDS sequence (opt11) from Lassa virus__AIT17425__NP
augucagccucaaaagaagucaagagcuuccucuggacccaaucauuacgucgcgaacuauccggcuacugcucaagcauaaaacuucaagucguuaaagacgcccaagcucuccuccacggacuagacuucucugaagucuccaacguacaacgccucaugagaaaacaaaaacgcgacgacagcgaccuaaaaagacuacgcgaccucaaccaagccgucaacaaccuaguagaacuaaaaagcacacaacaaaaauccauacuccgagucggcacccuaaccucagacgaccugcucacacuagcugcagaucucgaaaaacuaaaaagcaaagucauccggaccgaacgcccccucaguucugguguauacaugggaaaccucuccacccaacagcuagaacaacgucgcgcccuacucaacaugauaggcauggucggaggcgcacagggaacccaaccaggacgcgauggcgucgucagagucugggacgucaaaaaucccgaccuccucaauaaccaauucggcacuaugccaagccucacacucgcuugccuuacaaaacaaggucagguagaccuuaacgacgccguacucgcccucacggaccucggccucaucuacaccgcaaaauacccaaacucaucggaccuggaccgccucucccaaucccaccccauccuuaacaugguagacaccaagaaaagcucccucaacaucuccggauacaacuucagccucggcgccgccgucaaagccggcgcaugcaugcucgacggaggaaacaugcuugaaaccaucaaagucacaccccaaaccauggacggcauccucaaauccauccucaaagucaagaaaagccuaggcauguucguaagcgacacacccggcgaacgcaacccauacgagaacauccuuuacaaaauaugccuaucaggcgacggauggcccuacauagcguccagaacaucaauagucggacgagcaugggaaaacacaaucgucgaccuagaguccgacggaaaaccacaaaaaguagguaccgcaggcuccaauaaaagccuccaauccgccggguuccccacaggccucacuuacucucaacucaugacacuaaaagacagcaugaugcaacuagaccccuccgccaaaaccuggauagacauagaaggcaggcccgaagacccugucgaaaucgcgcucuaccaacccauguccggcugcuacauccacuuuuucagagaacccaccgaucucaaacaauuuaaacaagacgccaaauacucacacggcaucgacguagccgaccucuucccagcccaacccggccugaccuccgcagucauagaagcacucccacgcaacaugguccuaaccugccaaggaagcgacgacauaaaacgccuccucgacagccagggccgacgcgacauaaaacuaaucgacauugcgcuaucaaaagcagacucccggcgauucgaaaacgcagucugggaccaaugcaaagaucuaugccacaugcacacaggugucgucgucgagaaaaagaaaagagggggcaaagaagaaauaaccccacacugcgcccugauggacugcaucauguacgacgcagcagucucuggaggacuaaacauaccaguccuacgggccguccuaccccgcgacaugguuuuccgcaccuccagccccaaagucguccucuaa

SEQ ID NO: 3283 - RNA, 1710 nt, Artificial Sequence
  derived and/or modified CDS sequence (opt11) from Lassa virus__AIT17429__NP
auguccgcauccaaagaggucaaaucauuccucuggacccaaucacuccgucgggaacucuccggcuacugcucaaacauuaaacuccaagucguaaaagacgcccaagcgcuacuccacggccuugacuucuccgaagucagcaacguccaacgccuaaugcgcaaacaaaaacgcgacgacuccgaccuaaaaagacugagagaccuaaaccaagccguaaacaaccucguagaacucaaauccacccaacagaaaucaauacuccgcguaggcacccucaccuccgacgaccuccuaacacuugcugcagaccuggaaaaacucaaaucgaaagucaucagaaccgaacgaccccucuccucaggcgucuacaugggcaaccucucugcccaacaacucgaacaaagacgcgcgcuccucaacaugaucggaaugguaggaggcgcccaaggcacccaacccggccgugacggcgucguccgcgucugggacgucaaaaauccugaccuucucaacaaccaauucggaaccaugcccucccuaacccucgccugccucacaaaacagggacaaguagaccucaacgaugccgugcucgcacuaaccgaccuuggacuaaucuacacggccaaauacccaaacucaagcgaccucgaccgacucagccaaucccacccgauccugaacauggucgacaccaagaaaagcucccucaauauaucuggcuacaacuuuucccuaggcgccgccgucaaagcgggcgcauguaugcucgacggcggcaacaugcucgaaaccauaaaaguaacaccacaaacaauggacggcauacuaaagagcauacucaaagugaaacgaucucucggcauguucgucagcgacgcacccggcgaacgaaaccccuacgaaaacauccucuacaagauaugccucuccggcgacggcuggcccuacauagccucccgaacuagcaucgucggcagagccugggaaaacacaaccgucgaccucgaguccgacggaaaaccccaaaaagucggaaccgccggauccaacaaaucccugcaauccgcuggauuccccaccggacugaccuacucucaacuaaugacccuaaaagacuccaugaugcagcuagaccccagcgccaaaaccuggaucgacauagaaggccgcccugaagaccccgucgaaaucgcccucuaccaacccaugucaggcugcuacauccacuucuuccgagaacccaccgaccugaaacaguucaaacaagacgcaaaauacucccacggaaucgacgucgccgaccucuuccccgcacaacccggcuuaaccucagcagucaucgaagcauuaccccgaaacaugguccuaaccugccagggauccgacgacaucaaacgacuccuagacucacaaggcagacgggacaucaaacucauagacauagcccuaucaaaagccgacucucgccgcuucgaaaacgccgucugggaccaaugcaaagaucuaugccacaugcacaccggcguaguugucgaaaagaagaaacgcggagguaaagaagaaauaaccccucacugcgcacucauggacugcauaauguacgacgcagccgucucaggaggccucaacauccccguacucagagccguacucccucgagacauggucuuccgcaccagcucacccaaaguaguacucuaa

SEQ ID NO: 3284 - RNA, 1710 nt, Artificial Sequence
  derived and/or modified CDS sequence (opt11) from Lassa virus__AIT17431__NP
auguccgcguccaaagaaguaaaauccuucuuauggacccaaucacuacgccgagaacucuccggcuacugcuccaacaucaaacuccaagucgugaaagacgcccaggcacuacuacacggccuugacuucuccgaaguguccaacguccaaagacucaugcgcaaacaaaaacgcgacgacuccgaccucaaacgacuccgcgaccuaaaccaagcgguaaacaaccuaguugaacucaaaagcacacaacagaaaagcauccugcgcgucggcacucugaccuccgacgaccuucucacccuagccgcagaccucgagaaacuaaaauccaaagucauccgcaccgaacguccccuauccuccggggucuauaugggcaaccuguccacccaacaacuagaacaacgacgagcccuccucaacaugaucggaaugguaggcggcgcacaaggcacccaacccggacgcgacggcguaguacgagucugggacguuaaaaacccagaccuccuaaacaaucaauucggaacaaugccaucccugacccuggcgugccucaccaaacagggccagguagaucucaacgacgccguacucgcccucaccgaccucggccucaucuacaccgccaaauaccccaacuccuccgaccuagacaggcucucgcaaucacaccccauacucaauaugguugacacaaagaaaaguucccucaacauaucaggcuuuaauuucucucuaggcgcagcagucaaagcaggcgccuguaugcucgauggcggcaacaugcuugaaaccaucaaaguaacaccccaaaccauggacggaauacucaaaagcauccuaaaagucaagaaaucacuaggcauguucgucuccgacacgccuggcgaacgaaacccauacgaaaauauacucuacaaaaucugccuaagcggcgacggcuggccuuacauagcaucgcgcacauccaucgucggccgggcaugggaaaacacaacaguagaccuagaaucagacggcaaaccucaaaaagucggcaccgccggcucaaauaaaagccuccaaagcgccggcuucccaacaggccuaacuuacagccaacucaugacacuaaaagacagcaugaugcaacucgaccccucggccaaaaccuggaucgacauagaaggucgccccgaagacccaguagaaauagcucucuaccaacccauguccggcugcuacauccacuucuuccgcgaacccaccgaccucaaacaauucaaacaggacgccaaauacucacacggcaucgacgucgccgaccucuuccccgcacaacccggccuaaccucagccgucauagaagcccucccaagaaacaugguccuaaccugccaaggauccgacgacaucaaacgucuacuggacagccaaggacgcagggacaucaaacuuaucgacaucgcacucucuaaagccgacucacgacgauucgaaaacgccgucugggaccaaugcaaagaccucugccacaugcacacaggcgucgucgucgaaaagaagaaacgcggaggaaaagaagaaaucaccccacacugugcccuaauggacuguauaauguacgacgccgccgucagcggcggccucaacauaccgguucuccgcgccguacuaccacgagacauggucuuccgaacagcaucacccaaagucguacucuaa

SEQ ID NO: 3285 - RNA, 1710 nt, Artificial Sequence
  derived and/or modified CDS sequence (opt11) from Lassa virus__AIT17439__NP
auguccgcuucaaaagaagucaagagcuuccucuggacccaaucucugcgucgcgagcucagcggauacugcuccuccaucaaacuccaaguagucaaagacgcccaggcccuauuacacggccuugacuucuccgaagucuccaacguccaacgccucaugcguaaacaaaaacgcgacgacucagaucuaaaacgccuacgcgaccucaaccaagccgucaacaaccucgucgaacuaaaauccacccaacaaaaaucuauacuccgagucggcacccucaccucugacgaccuacucacccucgccgccgaccucgaaaaacucaaaagcaaaguaauccgcaccgaacgaccccuaucuucaggcguauacaugggaaaccuauccacacaacaacucgaacaacgacgcgcccuccuaaacaugaucggcauggucggaggagcacaaggcacccaaccaggacgagacggcguaguccgaguuugggacgucaaaaacccugaucucuuaaacaaccaauucggcaccaugcccucccucacacuugccugucuaaccaaacagggccaaguagaccucaacgacgcagugcuagcccucaccgaccucggccuuaucuacacagcuaaauaccccaacuccuccgaccucgaccgccuaucacaaagccaccccaucuuaaacauggucgauaccaagaaaucgagccugaacaucuccggauucaacuucagccucggugcagcggucaaagccggcgccugcaugcucgacggaggcaacaugcuugaaacaauaaaagucaccccacagacuauggacgguauccucaaaucaauccucaaagucaagcgaucccuuggcauguuugucagcgacacacccggcgaacgcaacccuuacgaaaacauccucuacaaaaucugccugagcggcgacggcuggcccuacaucgcaucccgcacgucaaucguaggccgcgcaugggagaacaccaccguagaccucgaaagcgacgggaaaccccagaaaaugggcacagcaggcuccaacaagucccuccaauccgccggcuuccccacgggacugaccuacucccaacuaaugacgcuaaaggacuccaugaugcaacucgauccaucagccaagaccuggaucgacauagaaggcagacccgaagauccuguagaaaucgcccuauaccaacccguaucuggcugcuacauacacuucuucagagaacccaccgaccucaaacaauucaaacaagacgcaaaguacucacacggcauagacgucgccgaccuauucuccgcccaacccggccucaccuccgccgucaucgaggcacucccaagaaacaugguccuaaccugccaaggaagcgacgacaucaaacgccuccucgacucacaaggacgccgcgacaucaaacucaucgauaucgcccucuccaaagcagacucacgccgcuuugagaacgccgucugggaccaaugcaaagaccucugccacaugcacaccggcgucgucgucgaaaagaagaaacgcggcggcaaagaggagauaacgccccacugcgcccuaauggacugcauaauguacgacgccgcaguauccgguggacucaacauccccguauuccgagccguccuuccucgggacauggucuuccgaaccagcucacccaaaguagugcucuaa

SEQ ID NO: 3286 - RNA, 1710 nt, Artificial Sequence
  derived and/or modified CDS sequence (opt11) from Lassa virus__AIT17443__NP
augucagccuccaaagaagugaaaucauuccuauggacccaaucccugcgcagagaacucucaggauacugcagcuccaucaaacuccaagucguaaaagacgcccaggcacuccuacacggacuggauuucagugaagucagcaacguacaacgacucaugcgcaaacaaaaacgagacgacucagaucucaaacgacucagagaccucaaccaagcagucaacaaccuaguagaauugaaaagcacccaacagaaaagcauacuccgcgucggcacccuaaccuccgacgacuuacucacccuagccgccgaccuggaaaaacucaaauccaaaguuauaaggaccgaaagaccccuuuccagcggcguauauaugggcaaccucagcacccaacaacucgaacaacgccgcgcccuacucaacaugaucggaaugguaggcggcgcccaaggcacacaaccgggaagagacggaguaguccgagucugggacgucaaaaaccccgaccuccuaaacaaccaauucggaacaaugccaucccucacacuagccugccuuacaaaacaaggacaaguagaccuaaaugacgccgugcuagcccuaaccgaccucggccuaaucuacaccgcuaaauacccaaacagcuccgaccucgaccgacuaagccaaagccacccaauccucaacaugguggacacuaagaaauccagccucaacauauccggcuacaacuucucccuaggcgcagccgucaaagccggagccugcaugcucgacggcggaaacaugcucgaaacaaucaaaguaaccccacaaaccauggacggcauccuaaaaagcauccuaaaagucaaacgcagccucggcauguucgucuccgacgcccccggugaaagaaacccauacgaaaacauccucuacaaaauuugucuaucaggggacggcuggcccuacaucgccagcagaacaucuaucgucggacgagccugggaaaacaccacaguagaccucgaaucagacggcaaaccacaaaaaguaggcaccgccgguagcaacaaaucccuccaguccgccggcuuccccacaggccuaaccuacucccaacuuaugacacucaaggauucaaugaugcaacucgaccccucagcaaaaaccuggaucgacauagaaggccgccccgaagacccagucgaaaucgcccuauaccaacccauguccggcugcuacauccacuucuucagagaaccaacugaucuaaaacaauucaaacaagacgcaaaauauucacacgggauugacgucgcagaccucuuccccgcccaaccaggacucacuagcgccgucaucgaagcccucccccguaacaugguccuaaccugccaaggauccgacgacaucaagaaacuccucgacagccaagggcgccgagacauaaaacucaucgacaucgcccucucaaaagccgacucuagacgcuucgaaaacgcagucugggaccaaugcaaagaccucugccacaugcacaccggcgugguagucgaaaagaagaaacgggguggaaaagaagaaaucacgccccacugcgcacucauggacugcauaauguacgacgcagcagucuccgguggccucaacauccccguccuccgagccguccucccacgcgacaugguguucagaaccagcucacccaaagucguucuguaa

SEQ ID NO: 3287 - RNA, 1710 nt, Artificial Sequence
  derived and/or modified CDS sequence (opt11) from Lassa virus__AIT17447__NP
auguccgccagcaaagagguaaaauccuuccucuggacucaaucccuacgucgcgaacucuccggauacugcucaaauaucaaacuccagguagucaaggacgcccaagcccuacuccacggauuagacuuuucagaaguuagcaacguccaacgccuaaugcgcaaacaaaaacgugacgacuccgaccuuaaacgccuaagagaccucaaccaagcaguaaacaaccucguggaacucaaaucaacucaacaaaaaucaauacuccgcgucggcacccucacauccgacgaccuccucacacucgccgcagaccuagaaaaacucaaaucaaaagucauccgaacagaaagaccccuaucaucgggaguauacaugggcaaccucucaacccaacagcuagagcaacgacgcgccuuacucaauaugauaggaaugguaggcggcgcccaaggcacccaaccgggccgcgauggcguaguucgagucugggacgucaaaaaccccgacuuacucaacaaucaauucgguaccaugccuucacuaacacuggccugccucaccaaacaaggccagguagaccucaacgacgccguccuagcccucaccgaccuuggccucaucuacacggcaaaauaccccaacuccucagaccuagaccgccucucacaaagccacccaauccucaacaugguagacaccaaaaagucaucccuuaacaucuccggcuauaacuucagccucggcgccgcagucaaagccggagccugcaugcucgacggcgguaacaugcuugaaacaaucaaggucacaccccaaacgauggacggcauacucaaauccauccuaaaggucaagaaaagccucggcauguucguaucagacacaccaggcgaacgcaaccccuacgaaaacauacucuacaaaaucugccuaucaggcgacggcuggcccuacauugccagccgaacauccaucgucggccgagcaugggaaaacaccaccgucgaccucgaaucagacggcaagccucaaaaagucggcacaacaggcucaaacaaaucgcuccaauccgccggcuucccuaccggccugacuuacucccaacucaugacccucaaagacuccaugaugcaacuagaccccuccgcaaagaccuggaucgauaucgagggacgcccagaagaccccgucgaaauagccuuauaccaaccaauguccggcugcuacauacacuucuuucgagaacccaccgaccucaaacaauucaaacaagaugccaaauacucucacggaauagacguaacagaccucuuccccgcucaaccuggacucacaagcgccguaaucgaagcacucccccgcaacaugguccuaaccugccaaggauccgacgacauuaaacgacuccucgacucccaaggacgccgcgacaucaaacucaucgauaucgccuuaucuaaagccgacucccgucgcuucgaaaacgccgucugggaccaaugcaaagaccugugccacaugcauacuggagucgucgucgaaaagaagaaaagagguggcaaagaagaaauaacaccacacugcgccuuaauggacugcaucauguacgacgcugccgucuccggcggccucaacauccccguucuacgcgcaguccugccgcgcgacauggucuuccgaaccucaucccccaaagucguacucuga

SEQ ID NO: 3288 - RNA, 1710 nt, Artificial Sequence
  derived and/or modified CDS sequence (opt11) from Lassa virus__AIT17451__NP
auguccgccagcaaagaaguuaagagcuuccucuggacccaaagccucagaagagaauuaucaggcuacugcuccaacauaaaacuacaagucgucaaagacgcccaggcccuacuccacggccucgacuucucugaagucagcaacguccaacgccucaugcgcaaacaaaagcgagaugacagcgaccuaaaaagacuacgcgaucucaaccaagccgucaacaaccucgucgaacugaaaagcacccaacagaaaagcauccuccgagucggaacacucaccucggacgaccuccucacacucgccgccgaucuagaaaaacucaagucaaaagucauccgcacagaacgaccucuauccuccggagucuacaugggaaaccucuccacccaacaacucgaacaacggcgagcacuccucaacaugaucgguaugguuggcggagcccaaggcacacaacccggacgcgacggaguaguccgcgugugggacgucaaaaaccccgaccuccuaaacaaccaauucggcacuaugccgucccuaacccucgcgugccucaccaaacagggccaaguugaccucaacgacgccguccuagcccucacugaccuuggccucauauacaccgcuaaauuuccaaacagcucugaccuagaccgacuaucccaaucacaccccauccucaacaugguagacacaaagaaaucaucacucaacauuagcggcuacaacuucagccucggcgcggcagucaaagcaggcgccugcaugcucgacggcggcaacaugcuagaaacuaucaaggugacuccccaaaccauggacggaauccuaaaauccauacuaaaagucaagaaaagccuaggcauguucgucucggacacacccggcgaaagaaaccccuacgaaaacauccuauacaaaauuugccugucgggugacggauggcccuacauagccucccguaccagcaucgucggcagagccugggaaaacacaacagucgaccucgaaagcgacgggaaaccccaaaaaguaggcaccaccggcagcaacaaaucccuacaaucugcaggauuccccaccggccucaccuacucccaacucaugacacucaaagacucaaugaugcaacucgaucccuccgccaaaacauggaucgacaucgagggccgacccgaagacccaguagaaaucgcacucuaccaaccaaugucaggaugcuacauccacuucuuccgggaacccacagaccugaaacaauucaaacaagacgcaaaguacagccacggaaucgacgucgccgaccucuucccugcacaacccggccugaccagcgccgucauagaagcacuuccacgaaacaugguccuaaccugccaaggcagcgacgacaucaaacgccuccuagacucacaaggccgacgagacaucaaacucauagacaucgcccuauccaaagccgacagccgacgcuucgaaaacgcagugugggaccaaugcaaagaccucugccacaugcacaccgggguagucgucgaaaagaagaaaagaggcggaaaagaagagauaacuccacacugcgcacuaauggacugcaucauguacgacgccgcagucucaggcggccucaacauacccguccuccgcgcaguccucccccgcgacauggucuuccgcacaagcuccccaaaagucguacucuag

SEQ ID NO: 3289 - RNA, 1710 nt, Artificial Sequence
  derived and/or modified CDS sequence (opt11) from Lassa virus__AIT17455__NP
auguccgcaagcaaagaggucaagagcuuccucuggacccaaucacuccgacgagaacucuccggcuacugcuccuccaucaaacuacagguagugaaagaugcccaggcccuccuccacggacuugacuucucggaggucucuaacguccaacgacuaaugcgaaaacaaaaacgcgacgacucagaucucaaacgccuaagagaccucaaccaagcagucaacaaccucgucgaacucaaaucuacccaacaaaaauccguacuccgcgucgguacacucacuuccgacgaccuccugacccucgccgcagaccuagaaaaauuaaaaaguaaagugauacgcacagaacgaccccuguccuccggagucuacaugggcaaccucucaacccaacagcucgaacaacgcagagcccuccucuccaugauaggcauggucggcggagcccaaggcacccaacccggcagagacggcgucguccgcguaugggacgucaaaaaccccgaccuccucaacaaccaauucggaaccaugcccucacuaacccucgccugccucaccaaacaaggccaggucgaccucaacgacgcgguccucgcacucaccgaccucgggcuaaucuacacagcgaaauacccaaacucaagcgaccuagaccgcuuaucccaaucccacccaauacuaaacauggucgacaccaagaaauccagccucaacaucucuggauacaacuucucacugggcgcagcugucaaagccggagccugcaugcucgauggcggaaacaugcucgaaacgauaaaagucaccccgcaaacgauggacggcauccugaaaucaauccucaaaguuaaacgcucccuaggcauguucguauccgacacccccggcgaacgcaacccauacgaaaacauccuauacaaaaucugccucuccggagacggauggccauacaucgcaucccgcacauccaucgucggcagagcaugggaaaacacgacaguagaccucgaguccgacggcaaaccccaaaaagucggcacagcaggcuccaacaaaucccuccaaucagcagguuucccaaccggccucacauacucacaacucaugacccucaaagacuccaugaugcaacuagaccccuccgcaaaaacauggaucgacaucgaaggacgcccggaagaccccgucgaaaucgcacucuaccaacccaugagcggcugcuacauccacuucuuccgagaaccuaccgaccucaaacaauucaaacaagacgcaaaauacucccacggcauagaugucgccgaccucuuccccgcacaacccggccuaaccucagccguaaucgaagcacucccacgaaauaugguacucacaugccaaggguccgacgacaucaaaagacuccuagacucccagggucgccgugacaucaaacuaaucgacauagcccuaaguaaagccgacucccggcgcuucgaaaaugccgucugggaccaaugcaaagaucucugccacaugcacaccggagugguugucgaaaagaagaaaagaggcggaaaagaagagauaacaccccacugcgcccuaauggacugcaucauguacgacgccgccgucucaggcggacucaacauccccguacuccgcgccguccucccccgcgacaugguauuccgaaccuccucaccaaaagucguacucuaa

SEQ ID NO: 3290 - RNA, 1710 nt, Artificial Sequence
  derived and/or modified CDS sequence (opt11) from Lassa virus__AIT17459__NP
auguccgccuccaaagaagucaaauccuuccucuggacccagucgcuccgccgcgagcuauccggcuacugcuccucaauaaaacugcaaguagucaaagacgcccaagcccuccuccacggacuagacuucuccgaagucagcaacguccaaaggcuaaugagaaaacaaaaacgcgacgacuccgaccucaaacgucuccgcgaccuuaaccaagccgucaacaaccucgucgaacucaaauccacccaacaaaaaucuauacuccgagugggaacccuuacauccgacgaccuacucacacuagcagcagaccuagagaaacuaaaauccaaagucauccguaccgaaagaccacuauccuccggagucuacaugggcaaccucuccacccaacaacuagaacaacgacgcgcccuccuaaacaugaucggaauggucggcggagcccagggcacacaacccggccgcgacggagucguccgcgucugggacgucaaaaaccccgaccuacucaacaaccaauucggaacgaugccuagccuaacccuggcaugccucaccaagcaaggacaaguagaccucaacgacgccguccucgcccucaccgaucucggacucauuuacaccgccaaauaccccaacaguucagaccucgaccgacuaucccaaagccaccccauccucaacaugguagacaccaagaaaucaucacucaacaucucaggauacaacuucucgcucggggccgccguaaaagccggcgccugcaugcucgauggcggaaacaugcucgaaacgaucaaagucaccccacaaaccauggacggaauccucaaauccauccucaaagucaaacgcagccugggcauguucgucagcgacaccccaggagaacgaaacccuuacgaaaacauccuauacaaaaucugucuuucaggcgacggcuggccauauaucgcaucacgcaccagcaucgucggccgcgcaugggaaaacacaacuguggaccuagaauccgacggcaaaccccagaaaaugggcacagcaggaagcaacaaaucccugcaauccgcuggauucccaaccggccucaccuacucacaacuuaugacucuuaaagacuccaugaugcaacuggaccccucugcuaaaacauggaucgauaucgaaggccgaccagaggacccaguggaaaucgcgcuauaccaaccagucucaggaugcuacauccacuucuuccgagaaccaacagaccucaaacaauucaaacaagacgccaaguauucccacggaaucgacguggcagaucucuuucccgcacaaccaggacuaaccucagccguuaucgaagcccucccucgaaacaugguacucacaugccaaggcuccgacgauaucaaacgccuccuagacucucaaggccgacgcgacaucaaacugaucgacauagcccucuccaaagcugacuccagacgcuucgaaaacgccgucugggaccaaugcaaggaccucugccacaugcauaccggcgucguagucgaaaagaagaaaagaggaggcaaagaagaaaucacaccacacugcgcccuaauggauugcaucauguacgacgccgccgucuccggaggacucaacauucccguacuccgcgcaguucucccucgagacaugguauuccgcacaucaagcccgaaaguaguccuauag

SEQ ID NO: 3291 - RNA, 1710 nt, Artificial Sequence
  derived and/or modified CDS sequence (opt11) from Lassa virus__AIT17463__NP
auguccgcauccaaagaagucaaauccuuccucuggacccaaagccuacgccgggaacucuccggcuacugcucaagcaucaaacuacaaguagucaaagacgcacaagcgcuacuccacggauuagacuucagcgaaguauccaacguacagcggcuaaugcgcaaacacaaacgcgacgacucggaccucaagcgccuacgagaccucaaccaagcagucaauaaccucgucgaacucaaguccacccagcagaaaagcauccuucgaguaggaacacuaacgagcgacgaucuccucacccucgcagcagaccucgaaaaacucaaaagcaaaguuauacgcacagaacgcccccuaucuucgggggucuacaugggcaaccuaucgacacaacaacuagaacaacgacgcgcccuccuaaacaugauaggaauggucggaggcgcccaauccacacaacccggccgcgacggcguaguucgagucugggacgucaaaaaccccgaucuccuaaacaaccaauucggcacaaugcccucccucacccuugccugccucacuaaacaaggccaaguagaccuaaacgacgccguauuagcccuaacagaccucggcuuaauauacacagccaaauaucccaacaguagcgaccuagaccgccucagucaaagccacccgauccuaaccauggucgacaccaagaaauccucgcucaacaucagcggcuucaacuucucccucggcgcugcagucaaagccggagcaugcaugcuugacggaggcaauaugcuugaaaccaucaaagucacaccccaaaccauggacgggauacucaaauccauccuaaaagucaagaaaucccuagggauguucguaucagacacccccggagaaagaaaccccuacgaaaacauacuauacaaaaucugccucucuggcgacggauggcccuacauagccucccgcaccuccaucguuggccgcgcaugggaaaauaccaucguagaccuagaaaccgacggcaaaccccaaaaagucggcacugcagguuccucacggagucuccaaagcgcaggcuuccccaccggacucacauacucccaacuuaugacacugaaagacagcaugaugcaacucgacccuagcgcaaaaaccuggaucgauaucgaaggacgacccgaagacccugucgaaaucgcucuuuaccaaccuauguccggcugcuacauccacuucuuccgagaacccaccgaccuuaaacaauucaaacaggacgccaaauacucccacggcauagacgucgccgaccucuuccccgcacaacccggacuaacaagcgcaguaauagaagcauuaccucgaaacaugguccuaaccugccaaggcucagacgacaucaagaaacuccucgacucacaaggaagacgcgacauaaaacucaucgacauagcacucuccaaagccgacucccgacguuucgaaaacgccguaugggaccaaugcaaagaccuuugccacaugcacaccggcgucgucgucgagaagaagaaacgaggcggaaaagaagaaauaacaccccacugcgccuuaauggacuguaucauguacgacgcagcagucucuggcggacuaaacauaccaguccuccgagccguccuucccagagacaugguauuccggaccucgucacccaaagucguacuuuaa

SEQ ID NO: 3292 - RNA, 1710 nt, Artificial Sequence
  derived and/or modified CDS sequence (opt11) from Lassa virus__AIT17467__NP
augucggccagcaaagaagucaaauccuuccuguggacacaaucccucagacgcgaacucucaggcuacugcuccucaauaaaacuacaagucguaaaagaugcacaagcacuccuucacggccuugacuucagcgaaguaucaaacguccaacgccugaugaggaaacaaaaacgcgacgacuccgaccuaaaacgacuccgcgaccugaaccaagccgucaacaaucucgucgaacugaaauccacccaacaaaaauccauucuacgagucggaacccucaccuccgacgaucuucucacgcuagccgccgaccucgaaaaacucaaauccaaagucauccgcaccgaacgaccacucuccucaggcguauacaugggcaaccucucgacgcaacaacuagagcaacgacgagcacuacucaacaugauaggaauggucggcggaacccaaggcacacaacccggacgcgacggcgucguccgcgucugggacguaaagaaccccgaccuccugaacaaccaauucggcacaaugcccucccucacacuagccugucucacaaaacaaggacaagucgaccucaacgacgccguccuagcacucacagaccucggcuuaaucuacaccgccaaguacccaaacagcuccgaccuagaccggcucagccaaucucaccccauacuaaacauggucgacaccaaaaagucaagccuaaacaucuccggcuauaacuucucccuaggcgccgcagucaaagccggcgccugcaugcuagacggcggaaacaugcucgaaacaauaaaagucacaccucaaacuauggacggcauccuaaaauccauccuuaagguaaagaaaucccuaggcauguucgucuccgacacuccaggcgaacgcaaccccuacgaaaauauccucuacaagaucugccuauccggugacggauggccauacauagcaagccgcaccagcaucguaggccgcgccugggagaacacaaccguagaccuggaaagcgacggaaaaccgcaaaaagucggcacagccggaucaaacaagucacuccaauccgccggauuccccaccggacucacauacucccaacuaaugacgcucaaagacagcaugaugcaacucgauccgagcgccaaaaccuggaucgacaucgaaggccgccccgaagaccccguagaaauagcacuguaccaaccaauguccggcugcuacauacacuucuucagagaacccaccgaccuuaaacaauucaaacaagacgcaaaguacucccacggcaucgaugucgcagaccucuuccccgcccaaccaggccuaaccucggccgucaucgaagcacucccccgcaacaugguacucacuugccaaggcagugacgacaucaaacgccuccucgauucacaaggacgccgcgacaucaaacucauagacauaucccucagcaaagccgacucacgccguuuugaaaacgccgucugggaccaauguaaagaucucugccacaugcacacaggcgucgucgucgagaaaaagaaaagaggcgggaaagaagaaaucacgccacacugcgcccucauggacugcaucauguacgacgccgccguauccggaggccuaaacaucccaguccuccgugccguccucccccgagacaugguauucagaaccuccucuccaaaagucguccuauaa

SEQ ID NO: 3293 - RNA, 1710 nt, Artificial Sequence
  derived and/or modified CDS sequence (opt11) from Lassa virus__AIT17471__NP
augagcgccucaaaggaagucaaaucauuccuauggacacaaucucuacggcgcgaacucucgggauacugcuccuccauuaaacuacagguagugaaagacgcccaagcccuauuacacggccuagacuucucggaaguaagcaacguccaaagacuaaugcgcaaacagaaaagagacgacagcgaccuaaaacgacuucgagaccucaaccaagccgucaacaaccucgucgaacucaaguccacccaacaaaaauccauacuccgagugggaacacuaaccuccgacgaccuacuaaccuuagcagcagaccucgaaaaacucaaauccaaaguaauccgcacagaacgcccccucucaagcggcguauacaugggaaaccucuccacacaacaacuagaacaacgccgcgcacuacucaacaugaucggcauggucggcggcgcacaaggaacccaaccaggccgagacggaguaguccgcgucugggacgucaaaaacccggaccuacucaacaaccaauucggcacuaugcccagccucacccucgccugccuaacaaaacaaggccaaguagaccucaacgacgcuguccucgcacuaaccgaccuaggacucaucuacaccgcaaaauacccgaacagcagcgaccuagacagacucucacaaucgcauccaauccucaacaugguagacaccaaaaagucaagccuaaacaucuccggauacaacuucucucucggagcagccguaaaagccggagccugcaugcuagauggaggaaacaugcuagaaacaauaaaaguaacaccccaaaccauggacggaauacuaaaaucgauccucaaagugaaaagaagccucggcauguucgucuccgacacccccggagaaagaaaccccuacgaaaacauucucuacaaaauaugccuaagcggagacggauggcccuacaucgcaucacgcaccucaaucguaggccgagccugggaaaacaccaccgucgaccucgaauccgacggcaagccccaaaagaugggaaccaccggauccaacaaaucccuccaaucggcuggcuucccgacaggacucacauacucacaacuaaugacucucaaagacuccaugaugcaacucgaccccuccgccaaaacauggauagacaucgaaggccgcccagaagacccaguagagaucgcccuauaccaacccaugucaggcugcuacauccacuucuuccgcgaacccaccgaccugaaacaauuuaaacaagacgcaaaguacagccacggaauagacguagcagaccucuuccccgcccaacccggccucaccucagcagucaucgaagcccucccacgcaauauggucuuaaccugccaaggcuccgacgacaucaagaaacuacuagacucacaaggccgacgggacauaaaacuaaucgacaucgcccucucuaaagcagacucucgcaaauucgaaaacgucguaugggaccagugcaaagaccucugccacaugcauaccggaguggucgucgagaaaaagaaacguggcgggaaagaagaaauaacaccccacugcgcccucauggacugcauuauguacgacgcagccguauccggcggacucaacauaccaguccuccgagccguacuaccccgagacaugguuuuccggaccucaagccccaaagucguacuauaa

SEQ ID NO: 3294 - RNA, 1710 nt, Artificial Sequence
  derived and/or modified CDS sequence (opt11) from Lassa virus__AIT17475__NP
auguccgccuccaaagaagucaaaucauuccuguggacacaaucacuccgacgcgaacucuccggcuacuguucuucaauaaagcuacaaguagucaaagacgcacaagcacuacuacacggccucgacuucucagaaguaucaaacguccaacgauugaugcgaaaacaaaaacgcgacgacuccgaccucaagcgccuccgcgaccucaaccaagccgucaacaaccucgucgaacuaaaauccacacaacaaaaauccguccuaagagucggcacccucacaagcgacgaccuacucacacucgcagccgaccucgaaaaacuaaaauccaaagucauaagaacagagcguccccucucguccgguguauacaugggcaaccuauccgcacagcagcuggaacaacgucgggcacuauuaucaaugaucggaaugguaggcggcgcccaggguacccaacccggccgcgacggcgucguccgcgucugggacgucaaaaacccagaccuccucaacaaccaauucggaaccaugcccucccucacccucgccugccuaacaaaacaaggccaagucgaccucaacgacacgguccucgcccucaccgaccucggccuaaucuacaccgccaaguaccccaacuccagcgaccuagaccgacucucucaaucacaccccauccucaacauggucgacacaaagaaauccucauuaaacaucuccggauacaacuucucacucggagcagcgguaaaagcaggagccugcaugcuggacggaggaaauaugcucgagacaaucaaagucacaccccaaaccauggacggcauccucaaaucaauccucaaaguaaaacguagccuaggcauguuugucuccgacacccccggagaacgaaauccguacgaaaacauauuauacaaaauaugccucuccggggacggcuggcccuacauagcaucccgcaccagcauagucggccgcgccugggagaacaccacagucgaccuagaauccgacggcaaaccucaaaaagucggcaccgccggcagcaacaaaucccuccaaagcgccgguuucccaaccggucuaacauauucccaacuaaugaccuuaaaagacagcaugaugcaacucgaccccagcgccaaaaccuggauagacaucgagggucgaccagaagacccaguagaaaucgcacucuaccaaccgauuucaggcugcuacauccacuuuuuccgcgaaccgaccgaccugaaacaauucaaacaggacgcaaaauauucccauggcaucgacguaaccgaccuauuuccggcccaacccggccuaaccucagccgucaucgaagcccuaccccgaaacaugguccuaaccugccaaggaucggacgacauaaaaagacuccucgacucccaaggccgacgggacauaaaaaucauagacaucgcacugagcaaagccgacucacgcagguucgaaaacgccgucugggaccaaugcaaagaccucugccacaugcacaccggagucguagucgaaaagaagaaacgaggcgggaaagaagagaucacuccccacugcgcccucauggacugcaucauguacgacgcagcagucuccggcggccucaacauaccgguacuccgcgccguacucccgcgcgacaugguguuccgaaccucaucuccaaaaguaguacuauaa

SEQ ID NO: 3295 - RNA, 1710 nt, Artificial Sequence
  derived and/or modified CDS sequence (opt11) from Lassa virus__AIT17479__NP
auguccgcuuccaaagaagucaaaucauuccucuggacccaaagccuccguagagagcucuccggcuacuguuccaacaucaaacuccaagucguaaaagacgcccaagcccuccuccacggccuagacuucucagaaguauccaauguacaacgacuaaugcgcaaacaaaaacgagacgacuccgaccuaaaacgacuccgagaccuaaaccaagcagucaacaaccucguagaacugaaauccacacagcaaaaauccguccuccgggucgguacccuaacguccgacgaccuacucacacucgccgccgaccucgaaaaacuaaaauccaaagucauccgcacagaacgcccccucuccuccggcgucuacaugggcaaucucuccacccaacagcuagaacaaagacgagcccuucuuaacaugauaggcaugguaggaggagcccaaggcacacaaccaggcagagacggcgucguccgcguaugggacgucaaaaaucccgacuuacucaacaaucaauucggcaccaugcccucccuaacccuugccugccucaccaaacagggccaagucgaccuaaacgacgcaguccucgcucuaacagaccucggacuaaucuacaccgcaaaauacccaaacuccuccgaccucgaccgacucagccagucgcaccccauccucaacaugguagacaccaagaaaagcagccuaaacaucucaggcuacaacuuuagccucggcgccgcagucaaagcaggggccugcaugcuagacggcggcaacaugcucgaaacaauaaaaguaacaccacaaaccauggacggcauucucaaaaguauacucaaagucaaacgaagccuaggaauguucguuuccgauacaccaggcgagcgaaaccccuacgaaaacauacucuacaaaaucugccuuuccggugacggauggcccuacaucgcaucccgcacaucaaucgucggccgagcaugggaaaacaccacggucgaccucgaauccgacggcaaaccacagaaaguaggcacggccggauccaacaaaucccugcaaucagccggauuccccaccggacucaccuauucccaacuaaugaccuuaaaagacagcaugaugcaacucgacccauccgcgaaaaccuggaucgacaucgaaggaagacccgaagacccagucgaaauagcccucuaccaacccauguccggcugcuacauacacuucuuucgagaacccacagaucuuaaacaauucaaacaagacgccaaauacucccacggaaucgacguagccgaccuguucccggcccaacccggacucacaucugcagucauagaagcacuuccccgcaacaugguccuaaccugccagggcuccgacgacaucaagaaacuccucgacagccaaggccgcaaagacaucaaacugauagacaucgcccucucaaaagucgacagcagacgcuucgaaaacgcuguaugggaccaaugcaaagaucuaugccacaugcacaccggugucgucgucgagaaaaagaaacgaggaggcaaagaagaaaucacaccacacugcgcgcucauggacugcaucauguacgacgccgccguauccggcggacuaaacauacccguccuccgcgcuguacuuccccgcgacauggucuuccgaaccucaucccccaaaguaguccuauaa

SEQ ID NO: 3296 - RNA, 1710 nt, Artificial Sequence
  derived and/or modified CDS sequence (opt11) from Lassa virus__AIT17491__NP
augucugccuccaaagaagucaaauccuuccucuggacccaaucccucaggcgcgaauuauccggcuacugcuccaacauaaaacuccaaguuguaaaagacgcccaagcccuacuccacggccuagacuucucagaagucagcaacguacaacggcuuaugcgaaagcaaaaacgcgacgacggcgaccucaaacgccuucgcgaccuaaaccaagccgugaacaaccucgucgaacucaaauccacccaacagaaaagcguccucagagucggcacacucacaucagacgaccuacucacccuagccgccgaccuagaaaaacucaaauccaaagucauccgcaccgaacgaccacucucuagcggcguuuacaugggaaaccucagcacccaacaacucgaacaacggcgcgcgcuacuaagcaugaucggcauggucggcggugcccguggaacgcaacccggccgcgacggcgucgugcgugucugggacguuaagaaccccgaccuccucaacaaucaauucggcaccaugccaucccucacacuagccugccuaaccaaacaaggacaaguugaccugaacgacguaguacuagcccugacggaccuaggccucaucuauacagccaaauauccaaacuccuccgaccuagaccggcuaucccaaucccaccccauccucaauaugguagacaccaagaaauccucccucaacauaagcggauacaacuucagucuaggcgccgccgucaaagcuggagccugcaugcucgacggcggaaacaugcucgaaaccauaaaaguaacaccccaaaccauggacggcauacuaaaaagcauccuaaaagugaagaaaucccucggcauguucgugagcgauacacccggagaacgcaaccccuacgaaaacauacucuacaaaauaugccuguccggagacggcuggccauacauugcaucaaggaccaguaucgucggccgcgcaugggaaaacacgaccguagaccucgaauccgacggaaaaccacaaaaagucggagcagccggauccaacaagucccuccaaucagcaggauucccaacuggacucaccuacagccaacuuaugaccuuaaaagacuccaugaugcaacuagaccccuccgccaaaacuuggaucgacaucgagggacgacccgaagacccggucgaaaucgcccucuaccaacccaugucuggcugcuacauccacuucuuccgcgaacccaccgaccuaaaacaauucaaacaagacgcaaaauacagccacggcauagacguaacagaccucuucucggcccaaccuggacucaccucagccguaaucgaagcccuaccccgcaacaugguccuaacaugccaaggauccgacgacaucaaacgacuccucgacucacaaggccgccgugacauaaaacuuaucgacaucgcacuaucaaaggccgacucccgacgguucgaaaacgcagugugggaccagugcaaagaccucugccacaugcacacaggagucgucguagaaaagaagaaacgaggcggaaaagaagaaaucacuccccacugcgcacugauggauugcaucauguacgacgccgccgucuccgguggccucaacauccccguccuaagagccguacuaccacgcgacauggucuuccgcaccucaucaccuaaaguaguacuguga

SEQ ID NO: 3297 - RNA, 1710 nt, Artificial Sequence
  derived and/or modified CDS sequence (opt11) from Lassa virus__AIT17495__NP
auguccgcauccaaggaagucaaaucauuccuuuggacccaaagccuccgccgggaauuauccggguacugcucaaacaucaaacuccaaguagucaaggacgcucaagcccuccuacacggacucgauuucagcgaaguauccaacguccaacgacugaugcgcaaacagaaacgcgacgacagcgaccuaaaacgccuccgcgaucucaaccaagccguuaacaaccucgucgaacuaaaauccacccaacagaaauccauccuaagagucggaacacucaccucggacgaccuccucacgcuagccgccgaccucgaaaaacuuaaauccaaaguaaucagaaccgaacgcccacuaagcagcggugucuauaugggaaaccucucaacucaacaacuugagcagcgacgagcccuccuaaacaugaucggcauggucggcggagcacaaagcgcccaaccuggccgcgacggggucgucagagucugggacgucaaaaaccccgaccuccucaacaaccaauucggcaccaugcccucacuaacgcuagccugccugacaaaacaaggccaaguagaccuaaacgacgccguacucgcccucacagaccucggacucauuuacaccgcaaaauaccccaacuccucagaccucgaccgccuaucccagucccaccccauccucaacaugguagacaccaagaagucaucauuaaacauaucaggcuucaacuucagccucggugcugccguaaaagcaggagcauguaugcuagacggcggaaacaugcucgaaaccaucaaagucacaccccaaaccauggacggcauccuaaaauccauccuuaaagucaaacggucccuaggcauguucgucagcgacgccccaggagagcgaaacccauacgaaaacauucuauacaaaaucugccuaucgggcgacggcuggcccuacauugcaucaagaacaucgaucgucggccgagccugggagaauaccacugucgaccuugaaucagacggaaaaccgcaaaaaguuggcaccgccggcucaaacaaaucccuacaaagcgccgguuuccccaccggccugaccuacagccagcuaaugacccuuaaagauaguaugaugcaacuagacccauccgccaagacauggaucgacaucgaaggccgaccagaggaccccgucgaaauugcccuauaccaaccaaugucaggcugcuacauccacuucuuccgcgaaccuaccgaccucaaacaauucaaacaagaugccaaauacagccacggcaucgacgucgccgaccucuuccccgcacaacccggucuaaccucugccgucaucgaagcccuaccccgaaauaugguacuaaccugccaaggcuccgaugacaucaagaaacuacuagacucgcaaggccgccgcgacaucaaacuaaucgacaucgcccuaucaaaagccgauucccgccgcuucgaaaacgccgucugggaccaaugcaaagaccuuugccacaugcacaccggcguaguggucgagaaaaagaagcgagggggcaaagaagaaaucacuccccacugcgcccuuauggacugcaucauguacgacgccgccguauccggaggacucaacauacccguccuccgagccguccucccacgagacaugguuuuccguacaucaagccccaaagucguccucuaa

SEQ ID NO: 3298 - RNA, 1710 nt, Artificial Sequence
  derived and/or modified CDS sequence (opt11) from Lassa virus__AIT17499__NP
auguccgccuccaaagaagucaagagcuuccuauggacccagucccuccgccgcgaacucucaggauacugcagcucuauaaaacuccaaguagucaaagacgcccaagcucuccuacacggacuggacuucucugaagucuccaacgugcaacgacucaugcgcaaacaaaaacgcgacgacucugaccucaagcgucuccgggaccucaaccaggccgucaacaaccuagucgaacucaaguccacccagcaaaaaucuauccucagagugggcacccuaacauccgacgaccugcuaacucucgcugccgaccucgagaaacucaaaagcaaaguaauccgcaccgaacgcccccuauccucgggcguauacaugggcaaccucagcacccagcagcucgaacaacgacgagcacuccucaacaucaucggcaugguaggaggagcccaagggacccaacccggaagagacggcguuguacgcguuugggacgucaaaaaccccgaccuacuaaacaaccaauucgguacuaugccgucacuaacucucgcuugccuuaccaaacaaggccaaguggaccucaaugaugccguacuagcccuaacggaucucggccuuauauacaccgccaaauaccccaacagcagcgaccucgauagacuaagccaaucgcaccccauccucaauauggucgacacaaagaaaagcucacucaacaucucaggcuacaacuucucccuaggugcagccgugaaagccggcgccugcaugcucgacggcggcaacaugcucgaaaccaucaaaguaacaccccaaaccauggacggcauacuaaaaucaauacucaaagucaaaagaagccuagguauguucguuuccgacacacccggcgaacgaaaucccuacgaaaacauccucuacaaaaucugccucuccggcgacggcuggcccuacaucgcaucccgaaccuccaucgucggccgcgccugggagaacacaacagucgaccuagaaucagacggcaaaccacaaaaaguaggagccgcaggauccaacaaaagccuccaaucggccggcuucccaacuggccuaacauacucacagcucaugacccucaaagacucaaugaugcaauuggacccaagugcgaaaaccuggaucgacaucgaagggcguccagaagacccaguagaaaucgcccuauaccaaccaaugagcggcugcuacauccacuucuuccgcgaaccaaccgaccuaaaacaauucaaacaggacgcaaaauacucccacgguauugacgucgcggaccuauuccccgcccagccaggccuaaccuccgcagucauagaagcacuacccagaaauauggugcuaacaugccaaggguccgacgacgucaaacgauuacuagacucgcaaggccgccgcgacauaaaacuaauagauaucgcccucagcaaagccgacucccgccgcuucgaaaacgccguaugggaccagugcaaagaccucugccacaugcacacaggcguaguaguagaaaagaagaaacgcggaggcaaagaagaaaucacaccccauugcgccuuaauggacugcauuauguaugacgcagccgucucaggcggacucaacauacccguacuacgcgcagugcuaccacgagacauggucuuccgaaccuccagccccaaagucguccucuag

SEQ ID NO: 3299 - RNA, 1710 nt, Artificial Sequence
  derived and/or modified CDS sequence (opt11) from Lassa virus__AIT17503__NP
auguccucaucuaaagaaguaaaauccuuccuauggacccaaucccuccgccgcgaacuuaguggauacugcucaagcaucaaacuccaagucgucaaggaugcucaagcccuccuccacggacucgacuucucagaaguaucaaacguacagcgccugaugcgcaaacaaaaacgcgacgacagcgaccuaaaacggcucagagaccucaaccaagccgucaauaaccuagucgaacugaaaucaacacagcagaaaagcauccuacgagucggcacccuaaccagcgacgaccuccuaacccucgccgcagaccucgaaaaacucaaaucaaaagucauacgcaccgagcgaccccucucauccggcgucuacaugggcaaccucagcgcccaacaacucgaacaacgacgagcccuacuaaacaugauagguauggucggaggcgcccagggcacgcaaccuggucgcgacggcgucguccgagucugggacgucaaaaaccccgaccuacucaacaaccaauucggcaccaugccaucccucacccuugccugccucacgaaacaaggccaagucgaccugaacgacgccguacuggcccucaccgaccucggacuaauauacaccgccaaauaccccaacuccucagaccucgacagacucucccaaucgcacccaaucuugaacaugguagacaccaaaaaaucgucccuuaacaucuccggauacaacuucucccucggcgcugcaguaaaagccggagccugcaugcuagacggaggcaacaugcuagagacaauaaaagucaccccccaaaccauggacggcauacucaaauccauacucaaaguaaaaaaaucgcuagguauguucguuucagacacccccggcgaacgaaacccauacgagaacauauuauacaaaauuugccucagcggagacgguuggccguacauagccucgcggaccuccaucgucggacgagcaugggaaaacaccacaguagaccucgaauccgacggcaaaccgcaaaaagucggcaccgcgggcuccaacaaaucccuccaauccgcaggcuuccccacuggccucaccuacucgcaacucaugacccuaaaagacagcaugaugcaacucgaccccuccgcaaaaaccuggauagacauagaaggucgcccagaagacccaguagaaaucgcccuauaccaaccgaugucaggcuguuacauccacuucuuucgggaacccaccgaccugaaacaauucaaacaagacgcuaaguacucccacggcaucgacgucgccgaccucuucccagcccaaccuggccucaccagugccguaaucgaagcucuaccccggaauaugguacucacaugccaaggaucagacgacauaaaacgacuccuagacucacaaggccgacgagacauaaaacuaauugacaucgcacuuucaaaagccgacucccgaagauucgaaaacgccgucugggaccagugcaaagaccuuugccacaugcauaccggggucgucgucgaaaaaaaaaaacguggaggcaaagaagaaaucaccccccacugcgcacucauggacugcaucauguacgacgcagcagugucaggcggccucaacauccccguacuacgcgccguucuaccacgggacauggucuuccgcacaucauccccaaaaguuguccuauaa

SEQ ID NO: 3300 - RNA, 1710 nt, Artificial Sequence
  derived and/or modified CDS sequence (opt11) from Lassa virus__AIT17507__NP
augagcgccucaaaagaagucaagagcuuucucuggacccaaucccugcgccgggaacucuccggauacugcuccaacauaaaacuacaagucguaaaagacgcccaagcacuccuccacggacucgauuucucagaaguauccaacguacaaagacucaugcgaaaacaaaaacgagacgauagcgaccucaaaagacuccgagaccucaaccaagccgucaacaaccucguagaacucaaaagcacccaacaaaaauccauacuucgcguaggcacccucacuucagacgaccuacuaacacucgccgccgaccuugagaaacuaaaaucaaaagucauacgcaccgaacgcccacucuccuccggaguauauaugggcaaccuaagcacccaacaacuugaacaacgcagagcgcuacucaaccucaucggcauggucggcggagcacaaggcacccagccgggucgagacggggucguaagagucugggacgucaaaaacccagaccuccucaacaaccaauucggcaccaugcccucacucacccucgccugccuaaccaaacaaggccaaguagaccucaacgacgccgugcucgcccucaccgaccucgggcuaauauacaccgcaaaauaccccaacuccucagaccucgacagacucucacaaagccacccaauccucaacauggucgacaccaagaaauccucccucaacaucuccggcuucaacuucucacuaggcgccgccgucaaagccggcgcuugcaugcucgacggcggcaauaugcuagaaaccaucaaagucacuccccaaaccaucgacggcauacucaagucaauccuaaaaguaaagaaaagccuaggcauguucguauccgacacccccggcgaaagaaaccccuacgagaacauccuuuacaaaaucugucucucaggggacggcuggcccuacaucgccagccgcaccuccaucgucggccgagcuugggaaaacaccaccgucgaccuagaauccgacggaaaaccccacaaaguaggcacagcgggauccaacaagucacuacaaagcgccggcuuucccacaggacuuaccuacucccaacuaaugacacugaaagacuccaugaugcaacucgacccaagcgccaaaacauggauagacaucgaaggacgcccggaagacccgguagaaaucgcccuauaccaacccauguccggaugcuacauacacuuuuuccgcgagcccaccgaccugaaacaauuuaaacaagacgcuaaauacucacacggcauugacguugccgaccuauucccggcccaaccaggauuaacaagcgccgucauagaagcccucccgcgcaacaugguacuuaccugccaaggcuccgacgacauaaaacgccuccucgacagccaaggcagacgggacaucaaacucaucgacaucgcccucucaaaaguagacagccgacgauucgaaaacgcugucugggaccaaugcaaagaccuaugccacaugcacaccgggguagucgucgagaaaaagaaacgaggcggcaaagaagaaaucacgccccacugcgcccucauggacugcauaauguacgacgcggccguaucaggcgggcucaacaucccgguacuacgcgccguacugcccagagacaugguauuccgaaccuccucaccaaaaguaguccuuuaa

SEQ ID NO: 3301 - RNA, 1710 nt, Artificial Sequence
  derived and/or modified CDS sequence (opt11) from Lassa virus__AIT17511__NP
augucagccuccaaagaaguaaaaucauuccucuggacccaaucacuucgcagagaacucucaggauacugcagcaacauaaaacuucaaguagucaaagacgcccaagcgcuccugcacggccucgacuucagcgaagucucgaacguccaaagacuaaugagaaaacagaaacgagacgacggugaccucaaacgcuuacgcgaccuaaaccaggccgugaacaaccuagucgaacucaaaucaacccaacagaaaagcauccuccgcgucggcacccugaccucagacgaccugcucacccuugcagcagaccuagaaaaacucaaaagcaaaguaauaagaacagagcgcccacuaagcucaggcgucuacaugggaaaccucagcacccaacaacuagaacaaagacgcgcccuuuuaaacaugaucggcaugguaggcggcgcccaaggcacucagcccgggcgugacggagucgucagagucugggacguuaaaaacccagaccuccucaacaaccaauucggcaccaugcccucacucacccuagccugccucaccaaacaaggacaaguugaccucaacgacgccguccucgcacuaaccgaccuaggccucaucuacaccgcuaaauaccccaacuccuccgaucucgaucgacuaucccaaagccaccccauccuuaacaugguagacaccaagaaauccucccucaacaucuccggauacaacuucucgcuaggcgccgccgugaaagccggcgcaugcaugcucgacggcggcaauaugcuagaaacgaucaaagucaccccacagaccaucgacgguauccucaaaucaauccucaaagucaagaaaucgcuaggaauguucgucucagacacccccggcgaacgaaacccauacgaaaauauacuauacaaaaucugccuaagcggcgacggguggcccuacaucgccagccgaacaagcauagucggcagagcaugggaaaacacaacaguagaccuggaaucagacggaaaaccccagaaaguaggcaccgccggauccaacaaaucccugcaauccgccggcuucccaacaggacugaccuacucacaacucaugacacucaaagacuccaugaugcaacucgacccauccgcaaaaaccuggaucgacauagaaggaagacccgaagaccccgucgaaauagcauuauaccaaccaaugucagggugcuacauacacuucuuccgcgaaccaaccgaucucaaacaauucaaacaagacgccaaauacucgcacggaaucgacgucacagaccucuucagcgcccaaccgggccucaccagcgcaguuaucgaagcacuaccacgcaacaugguccuaacgugccagggaagcgacgacaucaaaaggcuccuagacucccagggccgccgagacauaaaacuaaucgacaucgcccucucaaaagcagauucccgcagauucgaaaacgccgucugggaccaaugcaaagaccucugccauaugcacaccggcgucgucgucgaaaagaagaaaagaggaggaaaagaagaaaucacaccccacugcgcacucauggacugcaucauguacgacgccgcagucagcggcggccuaaacaucccaguccuacgcgcaguccuacccagagacaugguguucagaacuuccucaccaaaaguaguacuauaa

SEQ ID NO: 3302 - RNA, 1710 nt, Artificial Sequence
  derived and/or modified CDS sequence (opt11) from Lassa virus__AIT17515__NP
augagcgccuccaaagaaguaaaauccuuccuauggacccaaucucuccgacgggaacugucgggcuacugcucaucaauaaaacuacaaguagugaaagacgcccaagcccugcugcacggacuagacuucucagaagucucaaacguccaaagacuaaugagaaaacaaaaacgcgacgacagcgaccuuaaacgacuccgagaccucaaccaagccguaaacaaucucgucgaacucaaauccacccagcaaaaauccauccuacgcgucggcacccuaaccagcgacgaccuccucacacucgccgcagaccuagaaaaacuuaaaucaaaagucauacgcaccgagcgaccccuaucauccggagucuacaugggcaaccucuccacgcaacagcucgaacaacgcagagcccuacucaacaugaucggcauggucggcggcgcccagggcacacaaccaggccgagacggagucgugcgcguaugggacgucaaaaaccccgaccuucucaacaaccaauucggcacaaugccuucacucacacucgccugccuaaccaaacaaggccaaguagaccucaacgacgccguacuagcacucaccgaccucggacuaaucuauaccgccaaauaccccaacucaucggaccuagaccgacucucacaaucacacccgauccucaacauggucgacaccaagaaaucaucacugaacaucagcggauacaacuucucacucggagccgcagucaaagcaggcgccugcaugcucgacggaggaaacaugcucgaaaccauaaaagucacaccccaaaccauggacggcauacucaaauccauccuaaaaguaaaacgcuccuuaggcauguucguauccgauacaccaggcgaacgaaaccccuacgaaaacauucuguacaaaaucugccucuccggagacggcuggccguacauagcuucccgcaccagcaucgucgguagagcaugggagaacaccaccgucgaccuagagagcgacggaaaaccacagaaagugggagccgccggcuccucaaaaucccuacaauccgccggcuuccccaccggacuaacauacagccaacucaugacccuaaaagacucuaugaugcaacuugacccuucagccaaaacauggaucgauaucgaaggucgccccgaagaccccgucgaaaucgcucuguaucaacccgucuccggcugcuacauccacuucuucagagaaccaaccgaccucaaacaauucaaacaagacgccaaauacucccacggaauagacgucgcagaucuauuccccgcccagccaggccucaccuccgcaguaauugaagcccuaccucgcaacauggucuuaaccugccaaggcucagaugacauaaaacgacuccuagacucccaaggccgacgagacauaaaacuaauagacauugcgcuaucuaaagccgacucacgccgauucgaaaacgcugucugggaccagugcaaagaucucugccauaugcacaccggagucguaguagaaaagaagaaacgcggcggaaaagaagagauaacaccccacugcgcccuuauggacugcauaauguacgacgcagccgucuccggcggccucaacauccccguacuccgcgccguccuaccccgcgacauggucuuccggaccuccagccccaaaguaguccuuuaa

SEQ ID NO: 3303 - RNA, 1710 nt, Artificial Sequence
  derived and/or modified CDS sequence (opt11) from Lassa virus__AIT17519__NP
augucagccuccaaagaagucaaauccuuccuuuggacccaaagucuccgucgcgaacucagcggcuacugcagcaacaucaaacuccaagucgucaaagaugcccaagcucugcuccacggccucgacuucuccgagguaucaaacguccaacgccuuaugcgcaaacaaaaacgcgacgauuccgaccuaaaaagacuacgcgaccucaaccaagccgucaauaaccuagucgaacucaaaucaacacaacagaaaagcauacuccgcguaggcacgcuaacauccgacgaccuccuaacgcucgccgccgaccucgagaaacucaaauccaaagucauacgcacagagcgcccccucagcucaggaguuuacaugggcaaccucagcgcacaacaacuggaacagagacgcgcacuccuaaacaugaucggcaugguaggcggagcccaaggcacccaacccggcagagacggcguaguacgcgucugggacgucaaaaaucccgaccuccuaaacaaccaauucggcacaaugcccucccucacccuagcaugccuaaccaaacaaggccaaguagaccucaacgacgccgugcucgcacuaaccgaucuaggacuaaucuacaccgccaaauacccaaauuccucagaccucgaccgccuaucccaaagccaccccauccuaaacauggucgacaccaagaaaagcucccucaacauaucaggcuucaauuucucacucggcgccgccgucaaagccggugcaugcaugcucgacggcggcaacaugcuagaaacaaucaaagucacaccccaaaccauggacggcauccucaaauccauacugaaagucaaacgaucccuaggcauguucgucucugacacccccggagaacgcaacccauacgaaaacauccucuacaaaaucugccuaagcggcgacgguuggcccuacauugccucccgcaccuccaucgucggccgggccugggaaaacacaaccgucgaccucgaaucagacggcaaaccccagaaagucggcacggccgguagcaacaagagcuuacaaucagccggauucccaaccggucucacauacucccaacugaugacccugaaagauucaaugaugcaacuugaccccuccgcaaaaacauggaucgacauagaaggacgccccgaagacccgguagaaaucgcucucuaucaacccaugagcggcugcuacauccacuucuuccgagaacccacagaucuaaaacaauucaaacaagacgccaaauacucucacgguaucgacgucgcagaccucuuccccgcccaaccaggcuuaacguccgccgucaucgaagcccucccccgaaacaugguccuaaccugccaaggcucagacgauauaaaacgcuuacucgacucccaaggacgcagagacaucaaacucaucgacauagcccuuucaaaagccgacucacgaagauucgagaacgcugucugggaccagugcaaagaccuaugccacaugcacacuggaguagucgucgaaaagaagaaacgcggcggcaaagaggaaaucacgccccacugugcccucauggacuguauaauguacgacgccgccguauccggcggacucaacauccccguccuccgagcaguacucccacgagacaugguguucagaaccucaucccccaaagugguacuauaa

SEQ ID NO: 3304 - RNA, 1710 nt, Artificial Sequence
  derived and/or modified CDS sequence (opt11) from Lassa virus__AIT17525__NP
auguccgcaucaaaagaggugaaauccuuccuauggacacaaucucuccgccgcgaacucuccggauacugcuccucuaucaaacuccaggucgucaaagacgcacaagcccuucuccacggucucgacuucuccgaggucucaaacguccaacgacucaugcgcaaacaacgccgcgacgacuccgaccuaaaacgccuccgcgaccucaaccaagccgucaacaaccucguggaacucaaauccacccagcaaaagagcauccuccgggucggcacccucacauccgacgaccuccucacccucgccgcagaccuagaaaaacucaaauccaaggugauucgaacugaacgaccccuauccuccggagucuacaugggaaaucuauccacacaacaacuagaacaacgccgcgcccuccucaacaugaucggaauggucggcggggcccaaggaacacaaccaggccgcgacgggguaguccgcguaugggacgucaaaaaccccgaccugcucaacaaccaauucggcaccaugcccucccuaaccuuagccugccucaccaaacaaggacaagucgaccucaacgacgcgguccucgcacucacugaccuaggccugaucuacacagccaaauaccccaacuccuccgaccucgaucgacuaucacagucccaccccauccuuaacaugguagacaccaagaaauccagccucaacauuucuggcuacaacuucagucuaggcgcugccgucaaagccggcgccugcaugcuugacggcggaaacaugcucgagacaaucaaaguaacaccacaaacagucgacggcauccucaaaagcauccucaaaguaaaacgcagccuaggcauguucgucuccgacacccccggagaacggaacccauacgaaaacauccucuacaaaauaugccucucaggugacggcuggccauacaucgccuccagaacguccaucgucggacgagcaugggaaaacaccaccgucgaccucgaguccgacggcaaaccccaaaaagucggcacagcaggcucaaacaaaucacuacagagcgccggauucccuaccggacucaccuacucacaacucaugacacuuaaagacucuaugaugcaacuugaccccuccgcgaaaacauggaucgacauagagggccgccccgaagaccccgucgaaaucgcccuauaccaacccaugagcggaugcuacauccacuucuuucgcgaacccaccgaccucaaacaauucaaacaagacgccaaauacucccacggaauagacgucgcagaccucuucccuacacaacccggacuuaccuccgccguaaucgaagcccuaccccgcaauaugguccucacuugccaaggcagcgacgacaucaaacgccuacuagacucccagggacgccgcgacauaaaacucaucgacauagcacuaagcaaagcagauucccgcaaauuugaaaacgccgucugggaccaaugcaaagacuuaugccauaugcacaccggcguaguagucgagaaaaagaaacgaggcggcaaagaagaaauaacuccccacugcgcacucauggacugcaucauguacgacgcagccgucuccggcggccucaacauccccguacuucgagccguguuaccccgcgacauggucuuccguaccucuuccccaaaagucguccuauaa

SEQ ID NO: 3305 - RNA, 1710 nt, Artificial Sequence
  derived and/or modified CDS sequence (opt11) from Lassa virus__AIT17533__NP
auguccgccuccaaagaaguaaaauccuuccucuggacccaaucccuacgucgcgaacucuccggcuacugcuccaacaucaaacuccaagucgucaaagacgcacaagccuuacuacacggccuggacuucucagaagucaacaacguccaacgccugaugcgaaaacaaaaacgagacgacucagaccucaaacgacuccgagaccuaaaccaagcagucaacaaccuugucgaacucaaaagcacccaacaaaaaucaauccuccgcgugggcacccuaaccucagacgaccuacugacucuagcagcggaccucgaaaaacucaaaucaaaaguaauccguaccgaacgaccccuauccucaggcgucuacaugggcaaccucucaacccaacaacuagagcaacgcagagcccuucucaacaugauuggcauggccggcggaacacaagguacucaacccggccgcgacggcguaguccgaguaugggacgucaaaaaccccgaucuccucaacaaccaauucggaacaaugccaagccuaacccucgcaugccuuaccaaacaaggacaagucgaccucaacgacgccguacuagcacucaccgaccuggggcucauauacaccgcuaaauaccccaacuccuccgaccuagaccgccuaucccagucccaccccauacucaacaugguagauaccaagaaaagcucccuaaacaucuccggcuacaauuucucacuaggagcagccgucaaagcaggcgccugcaugcuagauggcggcaacaugcuagaaaccaucaaaguuacaccccaaaccauggacggaauacucaaaagcauacucaaagucaaacgcagccucggaauguucgucucagacacccccggugaacgaaaccccuacgaaaacauccuuuacaaaauuugccucagcggagacggauggcccuacaucgcaucccgcaccuccaucguaggccgcgcaugggaaaacaccacagucgaccuagaaucagacggaaaaccccaaaaaguaggcaccgccggcucaaacaaaucccuccaauccgcaggcuucccaacuggccuaacuuacagucaacugaugacccuuaaagacagcaugaugcaacucgaccccuccgcuaaaaccuggaucgacaucgaaggccgccccgaagacccggucgaaaucgcccuuuaccaacccauguccggcugcuacauccacuucuuccgcgaacccaccgaccucaaacaguucaagcaagacgccaaauacagccacggcaucgacguagcugaccuauucccagcgcaaccuggccucaccucugcagucauagaagcccugccccgcaacaugguccuaaccugccagggauccgaugacauaaagaaacuccucgacucccaaggacgcagagacaucaaacuuauagacaucagccucuccaaaaucgacagccgaaaauucgagaacgcagugugggaccaaugcaaagaccucugccauaugcacacaggaguaguagucgagaaaaagaaacgaggcggcaaagaagaaauaaccccacacugcgcccuuauggacuguaucauguucgacgccgccgucuccggaggucucaauauccccguccuacgcgcaguccuaccccgcgacaugguauuccguacaagcucccccaaagucguucuuuaa

SEQ ID NO: 3306 - RNA, 1710 nt, Artificial Sequence
  derived and/or modified CDS sequence (opt11) from Lassa virus__AIT17539__NP
auguccgccagcaaagaaguaaagagcuuccuguggacacaaucucuacgaagagaacuaagcggguacugcagcaacauaaaacugcaagucgugaaagacgcacaagcccugcuccacggccuggacuucagcgaaguauccaacguacaaagacucaugcgcaaacaaaaacgggacgacggcgaccucaaacgccuacgagaccucaaccaagcagucaacaaccucgucgaacucaaguccacacaacagaaaucaguacuacgcgucggaacccuaaccucggacgaccuccucauccucgccgccgaccucgaaaagcugaaaagcaaaguaaucagaacugaacgaccacuauccuccggcguauauaugggcaaccucagcacccaacaacuagagcaacgaaaagcccuccucuccaugaucggcaugguaggcggcgcccaaggcacacaacccggaagggacggcgucguacgggucugggacgucaaaaacccagaccuacuaaacaaccaauucggcaccaugccaucccugacccuagccugccucaccaaacaaggccaaguagaccucaacgacgccguacuagcccucacagaccucggccuaaucuacacagccaaauacccaaacagcagcgaccucgaccgucucucucaaagccaccccauccucaacauggucgacaccaagaaauccucacucaacauauccggauauaacuucucccuaggagcagccguaaaagccggcgcuugcaugcuugacggcgggaacaugcuagaaaccauaaaagucacaccccagaccauggacggcauacucaaaucaauacuaaaagucaaacgaucacucggcauguucgucuccgacaccccaggagaacgcaaccccuacgaaaacauccuauacaaaaucugccuuuccggagacggauggcccuacaucgcaucacgcacgagcaucgucgguagagcaugggagaacaccaccgucgaccuagaaagugacggaaaaccccaaaaagucggaagcgccggcuccaacaaauccuuacaaucagcagguuucccaacuggccucacauacucacaacucaugacgcucaaagacuccaugaugcaacuggauccaagcgccaagaccuggaucgacauugaaggccgcccagaagaccccguagaaaucgcccucuaccaaccaaugucagggugcuauauacacuucuuccgagaaccaaccgaccucaaacaguucaaacaagacgccaaauacucccacggcaucgacguaaccgaucuauucuccgcccagcccggccugaccagcgccgucaucgaagcccuaccccgcaacaugguccuaaccugccaaggcucagacgacauaaagaaacuccucgacagccaaggucgccgcgacaucaaacucauugacaucagccugggaaaggccgacucuaggcgcuucgaaaacgccguaugggaccaaugcaaagaccucugccacaugcacaccggggucgucguagagaaaaagaaacgcgguggaaaagaagaaaucacaccccacugcgcccuaauggacugcaucauguucgacgcagcuguuagcggcggccucaacauccccauacugagagcaguccucccacgcgacauggucuuccgcaccuccucccccaaagucguacuauaa

SEQ ID NO: 3307 - RNA, 1710 nt, Artificial Sequence
  derived and/or modified CDS sequence (opt11) from Lassa virus__AIT17541__NP
augagcgccuccaaagaagucaagucauuccuauggacccaaucccuacgacgcgagcucaguggcuacugcucaaacaucaaacugcaagucguaaaagacgcccaagcccuccuccacgggcucgacuucuccgaagucucaaacguacaacgacucaugagaaaacagaaaagagacgacggagaccucaaaagacuucgagaccucaaccaagcgguaaacaaccuugucgaacucaaaucaacccaacaaaaaucaguccuacgcguugguacccucucaagcgacgaccuccucacccuggccgccgaccuugaaaaacuaaaauccaaggucauccgaacagaaagaccccucucaagcggcgucuacaugggaaaccucagcucacaacaacuagaccaacgacgagcccuccucaacaugaucggaaugaccucagaccgccaaggagccuccaccggaagggacggcauaguccgagucugggacgucaagaacgcagaacuucucaacaaccaauucggcacgguacccucccucacacuagcaugccuaacaaaacaaggucaagucgaccuaaacgacgccguccaagcacucacagaccucggccucaucuacaccgcaaaauaccccaacucuucagaccucgaccgacucagccaaagucacccgauccuaaacaugaucgacacaaagaaauccucacucaacauaucaggcuacaacuucucccucggcgccgccgucaaagcaggggccugcaugcucgacggcggaaauaugcucgaaaccaucaaaguaagcccccaaaccauggacggcauccuuaaauccauacugaaaguaaaacgcuccuugggcauguucguaagcgacauccccggcgaacggaaccccuacgaaaacauccucuacaaaaucugccucuccggcgacggcuggccauacaucgcaucacgcaccucaauaaccggacgcgcgugggaaaacaccauugucgaccucgaaucagauuccaaaccccaaaaacccggaaacuccggauccaaccgaagccuucaauccgccggguuccccgccggccugaccuacucacaacucaugacccuuaaagacuccaugcuccaacuagaccccaacgccaagacauggauggacaucgaaggacgacccgacgacccagucgaaaucgcccuuuaccaaccauccucaggcugcuacauacacuucuuccgcgagccaaccgaccugaagcaauucaaacaagacgccaaauacagccauggcauugacguuggcgaccucuucgccgcacaacccggccugaccuccgcagugauagaagcucuaccccgcaacauggucauaaccugccagggcagcgaagacaucaagaaacuccucgaaucacaaggccgcaaagacaucaaacucgucgacaucuccaugucgaaaccagacucuagaaaauucgaaaacgcggucugggaccaguacaaagaccuaugccacaugcacacaggaauagucgucgagaaaaagaaacgcggaggcaaagaagaaaucacaccccacugcgcccuaauggacugcauaauguucgacgccgcagucgucggcgggcucgacgcgagaauccuaagagcaguccucccacgagacaugguauuccgcaccuccacccccaaaguaguccuauag

SEQ ID NO: 3308 - RNA, 1710 nt, Artificial Sequence
  derived and/or modified CDS sequence (opt11) from Lassa virus__AIT17545__NP
auguccgcauccaaagaagucaaauccuuccucuggacacagucacuccgccgagaacucuccggcuacugcuccaacauaaaacuucaagucguuaaagacgcgcaggcccuacuacacggccucgacuucuccgaagucuccaacguacaaagacuaaugagaaaacaaaaacgcgacgacagcgaccucaaacgccugagggaccucaaccaagcaguuaacaaccuagucgagcucaaauccacccaacaaaaauccguacucaggguaggaacccucacauccgacgaccuccuaacccuggcagccgaccucgaaaaacucaagucuaaaguaauccgcaccgaacgaccacuaucaagcggaguauauaugggcaaccuguccacccaacaacucgagcaaagacgagcgcuacucaacaugaucggcauggucggcggugcccaaggcacccaacccggacgagacggaguaguacgcguaugggacgucaaaaacccugaccuccuaaacaaccaauucggcaccaugcccucccucacacuagcaugccucaccaaacaaggccaaguagaccucaaugacgcaguacuagcacucaccgaccucggccuaaucuacaccgccaaauaucccaacagcucugaccucgaccgccuaucacaaucacaccccauccucaauaugguagacacaaagaaauccucccucaacaucucaggcuacaacuucucccucggcgcggccgucaaagcaggagccugcaugcuagacggcggaaacaugcuugaaaccauaaaagucacaccacaaaccauggacggcaucuuaaaauccauccucaaaguaaagaaaagccucggaauguucguaucugacacacccggcgagagaaacccuuacgaaaacauccuauacaaaaucugccuguccggcgacggcuggcccuacaucgcaagccgcaccuccaucguaggcagagccugggaaaacacaaccguagaccucgaauccgacggaaaaccacaaaaagucggcauagccgguagcaacaaaucccuccaguccgccggcuucccaaccggguuaacguacagccaacucaugacccucaaagauagcaugaugcaacuggaccccucagcuaaaaccuggaucgacaucgaaggucgccccgaagaccccgucgaaaucgcccucuaccaaccaaugucaggcugcuacauccacuucuuccgcgaaccaaccgaccucaaacaauucaaacaagacgccaaauacagccacggaaucgacguugccgaccucuuuuccgcccaaccaggacuaacuagcgcagucauagaagcccucccccgcaacaugguccuaaccugccagggcucagacgacaucaaacgacuccucgacucccaaggccgacgagauaucaaacucauagacauagcccuuagcaaggcugacucaagaaaauucgaaaacgccguaugggaccaaugcaaagaccuaugccauaugcacacaggugucgucgucgaaaagaagaaacgaggcggaaaagaagaaaucaccccacacugcgcccucauggacugcauaauguacgacgcugccguauccggaggauuagacauacccguacuccgcgccguccuaccccgcgacaugguauucagaacaucgucaccgaaagucguccucuaa

SEQ ID NO: 3309 - RNA, 1710 nt, Artificial Sequence
  derived and/or modified CDS sequence (opt11) from Lassa virus__AIT17549__NP
augucagccuccaaagaaguuaaauccuuccuauggacccaaagccuaagacgcgaacucagcggcuacugcagcaacaucaaacuacaagucguaaaagacgcccaagcccuacuccacggacucgacuucucugaaguuucaaacguacaacgacugaugcgaaaacaaaaacgcgacgacagcgaccucaaaagauugagagaccuaaaccaagcgguaaauaaccucguagagcugaaauccacccaacaaaaaucgauccuccgagucggcacccuaacgagcgaugaccuccucacacuggcagcagaccucgaaaaacucaaaucaaaagucaucagaacagaacgaccccuaagcagcggcgucuacaugggaaaccucagcacccaacagcuagaacaacgacgagcccuacuaaacaugaucggcauggucggaggcgcccaaggaacucaaccuggucgcgacggugugguccgagucugggacgucaaaaacccugaccuacucaacaaccaauucggcacaaugcccucacucacgcucgccugccuaaccaaacagggccaggucgaccucaacgacgucguacucgcccucaccgaccuaggccucauauacaccgcuaaauacccaaacuccagcgaccucgacagacucagccaaucccacccaauccucaacauggucgacaccaagaaauccucacucaacaucagcggauacaacuucucacucggagccgcaguaaaagcaggagccugcaugcucgacggcgguaacauguuagaaaccaucaaagucacgccccaaaccauggacgggauccuaaaaagcauccuaaaagucaagaaaagccuuggaauguucgucagcgacacccccggcgagagaaaccccuacgaaaacauccuauacaaaaucugccucaguggggacggcuggcccuacaucgccucacgcaccuccaucguagggcgggccugggaaaacaccaccguagaccuagaaucagacggcaaaccacagaagguuggcacaguaggcagcaacaaaagccuucagucagcgggauuccccaccggacuuacauacucccaacucaugacacuaaaggacuccaugaugcaacucgaccccagcgccaagacauggaucgacauagaaggccgccccgaagaccccguagaaauagcucucuaccaacccauguccggcugcuacauccacuucuucagagaaccaaccgaccucaaacaguuuaaacaagacgcaaaauacagccacggaauagacgucgcagaccucuuccccgcucaaccgggccuuaccuccgcagucaucgaagcccuuccccgaaacaugguccuaaccugccaaggcagcgacgacauaaagaaacuccuagacucacaaggccgacgcgacauuaaacucaucgacaucgcacuuagcaaagcagacucccgaaaauucgaaaacgcagugugggaccaaugcaaagaccucugccacaugcacacagguguagucgucgagaaaaagaaacgaggcggcaaagaagaaaucacaccccacugcgcccuaauggacugcauaauguacgacgccgccgucagcggcggccuaaacaucccaguacuucgcgccguacuaccccgcgauauggucuuccgcaccagcagcccaaaaguaguccucuaa

SEQ ID NO: 3310 - RNA, 1710 nt, Artificial Sequence
  derived and/or modified CDS sequence (opt11) from Lassa virus__AIT17553__NP
auguccgcguccaaagaaguaaaauccuuccucuggacccaaucccuacgccgagaacuuucaggcuauuguuccagcauaaaacuacaaguagucaaagacgcacaagcccuacuccacggucucgacuucuccgaggucagcaacguccaacgacugaugagaaaacagaaaagagacgacagugaccucaaacgacuccgcgaccucaaccaagcaguuaacaaccucguagaacuaaaaucaacccaacaaaaauccauccuacgagucggcacacucacuucugacgaucugcuuacacuagccgcugaccucgaaaaacucaaauccaaagugauacgcaccgaacgaccacucucaucaggagucuacaugggaaacuuaagcacucaacaacuagaacaaagacgcgcacuacuuaacaugauaggcauggucgguggugcccaaggcacacaaccgggacgcgacggcguaguccgcgucugggacgucaaaaacccugaccuacuaaacaaccaauucggaaccaugcccucccucacccucgcuugucuuaccaaacaaggccaagucgaccucaacgacgccguccuugcccucaccgaccucggacucauauacaccgcaaaauacccgaacucguccgaccuagaccgccuaucacaaagccaccccauccucaacauggucgacacgaagaaauccagccuuaacaucagcggcuacaacuucagccucggcgccgccgucaaagccggcgccugcaugcuagacggugguaacaugcuagagaccauaaaagucacaccccaaacaauggacggcauacuaaaauccauacucaaagucaaacgaagccuaggaauguuugucucagauaccccaggagaaagaaacccauacgaaaacauccuauacaaaaucugccucucaggagacggcuggccguauauagcauccagaacaucuaucgucgggcgagccugggaaaacaccacagucgaccucgaguccgacgguaaaccccaaaagaugggcaccgccggcucaaacaaaucacuacaaucagcuggcuuccccaccggacuaaccuacagccaacucaugacccucaaagacuccaugaugcagcuagacccgagcgccaaaaccuggaucgacauagaagggcgaccagaagaccccguagaaauagcccuauaccaacccauguccggcugcuacauccacuucuuccgagaaccaaccgaccuaaaacaauucaaacaagacgcuaaauacucccacggcaucgacgucgccgaucucuuccccgcccagcccggauuaacaagcgcagucaucgaagcacuccccagaaacaugguccucacuugccaaggauccgacgacaucaagaaacugcucgacucacaagggcgcagagacaucaaacuaaucgacaucgcccucuccaaagcagacucacgccgcuucgaaaacgccgucugggaccaaugcaaagaccucugucacaugcacacaggcgucguugucgagaaaaagaaacgcggaggcaaagaagagauaacuccgcacugcgcacucauggacugcauaauguacgacgccgccgucucaggcggacucaacauccccguacuccgcgccguccuaccaagagauaugguauucaggaccagcucacccaaagucguacuauag

SEQ ID NO: 3311 - RNA, 1710 nt, Artificial Sequence
  derived and/or modified CDS sequence (opt11) from Lassa virus__AIT17561__NP
augagcgcaagcaaagaaguaaaauccuuccucuggacccaaucacuaagaagagaacucuccggauacugcaguaacaucaaauuacaggucgucaaagacgcccaggcccuacuccacgggcuagacuucagcgaaguaucaaacguccaacgccucaugagaaagcaaaaacgagacgacagcgacuuaaaacgccugcgagaccuaaaccaagcaguaaacaaccucgucgagcucaagagcacccaacaaaaguccauccuccgcgucggaacccucaccucagacgaccuccuuacacuagcagcagaccuagaaaagcuaaaaucaaaaguaauccgaacugagaggccccucuccagcggcgucuacaugggcaaccucucaacucaacaacucgaacaacgcagagcccugcucaacaugauaggcauggucggaggcgcccaaggaacacaacccggccgggacggagugguccgagucugggacgucaaaaaccccgaccuacugaacaaccaauucggcaccaugcccucacuaacccuugccugccucacaaaacaaggccaaguagaccucaacgacgcgguccucgcucucaccgaccucggccuaaucuacacggcaaaauaucccaacaguuccgaccucgacagacugucccagucacacccaauccucaacauggucgacaccaagaaaagcagucucaacaucucagguuacaacuucagccucggugccgccguaaaagccggggcaugcaugcuagacggaggcaacaugcuagaaacaaucaaagucacgccacagacaauagacggcauccuaaaaagcauccugaaagucaagaaaagccuaggcauguucgucuccgacaccccuggcgaacgcaaccccuacgaaaacauccuauacaaaaucugccucuccggcgacggauggcccuacaucgcaucccgcaccaguaucgucggccgcgcaugggaaaacaccacuguagaccuagaaucugacggcaaaccccaaaaagucggaaccgucggcagcaacaaaucuuuacaauccgccggauuccccaccggacucaccuacagccaacugaugacccucaaagacagcaugaugcaacucgaccccagcgcaaaaacauggaucgauaucgaaggccgcccagaagaccccgucgaaaucgcccucuaccaacccaugagcgggugcuacauccacuucuuccgcgaacccaccgaccuaaaacaauucaaacaagacgccaaauacagccacggcaucgacgucgccgaucuauuccccgcacaaccaggacucaccucagcagucauagaagcccuccccaggaacaugguucucacaugccaagggagcgacgacauaaaaagacuccucgacucccaaggacgccgugacauaaaauuaauagacaucgcccuauccaaagccgacucacgcagauuugaaaacgccguaugggaccaaugcaaagaccuaugucacaugcacaccggcgucgucguagaaaagaaaagacgaggaggcaaagaagaaauaaccccacacugcgcacucauggacugcauaauguacgacgcagccgucuccggcggacuaaacauccccguccuccgcgccguccucccacgcgacaugguauuccgcaccuccucacccaaagucguccuauag

SEQ ID NO: 3312 - RNA, 1710 nt, Artificial Sequence
  derived and/or modified CDS sequence (opt11) from Lassa virus__AIT17565__NP
augucagccucaaaagaaaucaagucauuccuauggacccaaagucucagacgagaacucuccggauauugcagcuccauuaaacuacaaguaguaaaagacgcccaagcacuccuccacggccucgacuucuccgaaguaucaaacguacaacggcuaaugagaaaacaaaagagagacgacagcgaccucaaacgacuccgcgaccucaaccaagccgucaacaaccucguagaauuaaagucgacucaacaaaaguccauccucagaguuggcacacucacaucggacgaccuacuuacacucgcagcagaccucgaaaagcucaaauccaaagucauacgcaccgaacgccccuuaucauccggcguauacaugggcaaccucucaacccagcagcucgaacaacgccgcgcacuccuuaauaugaucggcaugguaggaggcgcacaaggcacccaacccggacgcgacggcgucgucagagucugggacgucaaaaacccagaccuacuaaacaaccaauucggcaccaugcccagccucacccuagcaugccucacaaaacaaggacaagucgaccucaacgacgcaguacuagcccuaacagaccucggccucauauacaccgccaaauacccgaacuccucagaccuagaccgacuaucccaaucccacccaauccucaacaugguagacacgaagaaaagcucgcucaacauauccggauacaacuucucccucggcgccgccguuaaagcaggcgccugcaugcuagacgggggcaacaugcucgaaaccaucaaaguaacaccccaaacaauggacggaauccucaaauccauacucaaaguaaaacgaucacucggcauguucguaucagacgcucccggcgagcgcaacccauacgagaacauccucuacaaaaucugccuauccggcgacggauggcccuacaucgcauccagaaccagcauagucggacgcgccugggaaaacacaaccgucgaccuagaaucagacggcaagccacaaaaaguaggcaccgcuggguccaacaaauccuugcaauccgccggauuccccacaggccuaaccuacagccagcuaaugacccucaaagacucaaugaugcaacucgacccuucagccaaaacauggaucgacaucgaaggccgacccgaggaccccgucgaaaucgcacucuaccaacccaugucaggcugcuauauccacuucuuccgagaacccaccgaccucaaacaauucaaacaggacgccaaauauucacacggaauagacguagcagaccucuucccagcccagcccggccuaacauccgcagucauagaagcacucccccgcaacaugguccuuaccugccaaggcuccgacgacaucaagcgacuccuagacagccagggacgccgugacaucaaacucauagacaucgcccucucaaaagcagacucucgcaaauucgagaacgccgucugggaccaaugcaaagaccuaugccacaugcacacaggcgucgucguagaaaagaagaaaagaggcggaaaagaagaaauaacaccccacugcgcacucauggacugcauaauguacgacgcagcagucucaggcggccuaaacauccccguccuccgcgccguccucccccgcgacauggucuuucgcaccuccucgccuaaagucguacucuaa

SEQ ID NO: 3313 - RNA, 1710 nt, Artificial Sequence
  derived and/or modified CDS sequence (opt11) from Lassa virus__AIT17569__NP
augagcgccuccaaagaagucaaaucauuccucuggacccaaucgcuucgucgagagcuaagcggcuauugcuccaacaucaaacuccaagucguaaaagacgcccaagcccuccuccacggccucgacuuuuccgaaguuuccaacguacaacgacuaaugagaaaacaaaaacgcgacgacucagaccucaaacgccuccgugaccucaaucaagccgucaacaaccucgucgaacucaaaucaacacaacaaaaauccauccuccgcguaggcacccucaccucagacgaccuacucacccuagcagccgaccucgaaaaacuaaaaucuaaaguaauccgcacagaacgcccccucuccucaggagucuacaugggcaaccuaagcacccaacaacuagagcaacgccgagcacuccuuaacaugaucgggauggugggcggagcccaagguacgcaaccaggccgcgacggugucguccgcgucugggacgucaaaaaccccgaccugcucaacaaccaauucggcaccaugcccucccucacccuagcaugccucaccaaacaaggacagguagaccugaacgacgccguacucgcccuaacagacuuaggccucaucuacacagccaaauuccccaacucaucggaccucgacagacucucgcagucacaccccauccucaacaugguugacaccaaaaaguccagccucaacaucuccggcuacaacuucucccuaggcgcagccguaaaagccggagcaugcaugcucgacggcggaaauaugcucgaaaccauaaaagucacuccccaaaccauggacggaauccucaaauccauucucaaaguaaagaaaucccucggaauguucguguccgacaccccuggagaacguaaccccuacgaaaacauccuauacaaaauaugccucuccggcgacggcuggccauacaucgccuccagaaccucaauagugggacgcgcuugggaaaacaccaccgucgaccucgaauccgacggcaaaccgcagaaagucggaacaaccggguccaacaaaucccuacaaagcgccggcuuccccacgggacucaccuauucccaacuaaugacccucaaagacagcaugaugcagcucgaccccucugcaaaaacauggaucgacaucgaaggcagaccagaagacccuguagaaaucgcucucuaucaaccaaugucaggcugcuacauccacuucuuccgcgaacccacagaccuaaaacaguuuaaacaagacgcaaaauacucccacggcaucgacgucgccgaccucuuccccgcccaaccaggacucacaucggcugucaucgaggcccuuccgcgcaauaugguccucaccugucaaggauccgacgacauaaaacgacuccucgacucccaaggccgccgggacaucaaacuaaucgacaucgcccucucaaaggccgacagccguagauucgaaaacgccgucugggaccaaugcaaagaucuuugccauaugcacaccggggucgucguagaaaagaagaaacgaggcggcaaagaggaaauaaccccacacugcgcucugauggacugcaucauguacgacgccgccguaagcggaggacucaaucuacccguacucagagccguccucccccgagacauggucuuccgcaccuccucccccaaagugguccucuaa

SEQ ID NO: 3314 - RNA, 1710 nt, Artificial Sequence
  derived and/or modified CDS sequence (opt11) from Lassa virus__AIT17573__NP
augagcgcaucaaaagaagucaaauccuuccucuggacccaaucgcuucgccgugaauuaucaggcuacugcuccaacaucaaacuacaagucgucaaagacgcccaagcccuacuccacggacucgacuucuccgaagucagcaacguccagcgacuaaugcgcaaacagaaaagagacgacuccgaccucaagcgcuuacgcgaccucaaccaagccguaaacaaccuagucgaacuaaaaucaacacaacaaaaaucaauccuacgcguaggaacacuaaccucagacgaccuacucacacucgcagcagaccuugaaaaacuaaaaagcaaagucaucagaacagaacgcccgcuaucauccggcgucuacaugggaaaccuauccacccaacagcucgaacaacgccgcgcccuccuaaacaugaucggcaugguaggcggcgcccaaggcacgcaacccggccgagacggcguaguacgaguaugggacgucaaaaacccggaccuacuaaacaaccaauucgguacuaugcccucccucacccuagccugccugacaaaacagggccaaguagaccuuaacgacgcaguacucgcccucaccgaccuaggccugauauacaccgcaaaauacccaaacuccucagaccucgaccgacucagccaaucccaccccauccuaaacauggucgacaccaagaaauccucccuaaacaucagcggcuacaacuucagccucggcgcagccgucaaagcaggcgcgugcaugcuugacggcggcaacaugcucgaaaccaucaaaguaacaccccagaccauggacggaauacuaaaauccauccucaaaguaaagaaaagccucggcauguuuguauccgauacacccggagaacguaaucccuaugaaaacauccucuacaaaaucugucucagcggcgacggcuggcccuacauagccucacgcaccucaaucgucggccgcgccugggaaaacaccaccguagaccuggaaagcgacggaaaaccacaaaaaguaggcaccgccggaagcaacaaaucccuccaaagcgccggcuucccaaccggccuaacuuacucacaacucaugacauuaaaagacagcaugaugcaacucgaccccuccgcgaaaaccuggauagacauagaaggccgacccgaagaccccgucgaaaucgcccucuaccagccaaugagcggcugcuacauacacuucuuccgcgaacccaccgaccucaaacaauucaaacaagacgccaaauacagccauggcaucgacaucgccgaccucuuuccagcccagcccggacuaacaucggccgucaucgaggcacucccccgaaauaugguccuaaccugccaaggauccgacgacaucaaacgacuccucgacucccaaggacggcgagacauaaaacucaucgacaucgcacucuccaaagccgacucccgcagguucgaaaacgcagucugggaccaaugcaaagaccucugccacaugcacaccggagucguggucgagaaaaagaaacguggcgggaaagaagaaauaacaccccacugcgccuuaauggacugcaucauguacgaugccgccgucuccgggggccucaacaucccaguccucagagccguacugccacgcgacauggucuuccgcaccucaucccccaaaguaguccuauga

SEQ ID NO: 3315 - RNA, 1710 nt, Artificial Sequence
  derived and/or modified CDS sequence (opt11) from Lassa virus__AIT17577__NP
augagcgccucaaaagaggucaaaucauuccuuuggacccaaucccuccgaagagaacucucuggcuacugcucaagcaucaaacuccaggucgucaaagaugcucaagcgcuccuccacggacuggacuucucugaagucuccaacguccaacgccucaugcguaaacagaaaagagacgacuccgaccucaaaagacuccgcgaccucaaccaagccguaaacaaccucguggaacucaaaagcacccaacaaaaaucaauccuccgcguaggaacucuaacaagcgacgauuuacucacccucgccgccgaccuagaaaaauuaaaauccaaaguaauccgcaccgaacgcccccuaagcuccggcgucuauaugggaaaccucucaacacaacaacucgaacaaagacgagcccuccuaaacaugaucggcauggucggaggcgcucaaggcacccaacccggccgcgacggcgucguacgcgucugggacgucaagaaccccgaccuacucaauaaucaauucggcacaaugcccagccuaacacucgccugccuaacaaaacaaggccaaguugaccugaacgacgcaguccucgcuuuaacagacuuaggccuuaucuacaccgcaaaauacccaaauagcuccgaucucgaccgacucagccaaucacacccaauccucaauauggucgacacaaagaaaucaagccuaaacauaagcggcuacaacuuuucacuaggcgccgccgugaaagccggagcaugcaugcuugacggcggaaacaugcuagaaacaauuaaagucacuccccaaaccauggacggcauccugaaguccauacuaaaagucaaaaggucccuaggaauguucgucuccgacaccccgggcgagcgcaaccccuacgaaaacauccucuacaaaaucugccuuuccggagacggcuggcccuacauagccucccgaaccucaaucgccggccgcgcaugggaaaacaccacgguagaccucgaguccgacgguaaaccccagaaaguaggcgcugcuggauccaacaaaucccuacaguccgccggcuuccccacaggccuaaccuauucacaacucaugacacuaaaagacagcaugaugcagcucgaccccucugccaagacauggauagacaucgaaggccgcccugaagaccccgucgagaucgcacuuuaccagccaauguccggaugcuacauccacuucuuccgagaacccaccgaccuaaaacaauucaaacaagacgccaaauacucccacggaaucgaugucgccgaccuauuccccgcccaacccggccuaacguccgccgucauagaggcccucccccgcaacaugguccuaaccugccagggcagcgacgacaucaaacgccuccucgacagccaaggacgccgugacauaaaacucaucgacauagcccucagcaaagcagacucacgccguuucgagaaugccgucugggaccaaugccgcgaccugugccacaugcacaccggcgucguagucgaaaagaagaaacgcggagggaaagaagaaaucacaccccacugcgcccuaauggacugcauaauguaugacgcggccgucuccgguggccucaacauacccguccuacgcgcaguacuaccacgugacauggucuuccgcaccuccagccccaaagucguacucuaa

SEQ ID NO: 3316 - RNA, 1710 nt, Artificial Sequence
  derived and/or modified CDS sequence (opt11) from Lassa virus__AIT17581__NP
augagcgccuccaaagaagucaaauccuuccuauggacucaaucccuccgcagagaacuauccggcuacugcucauccaucaaacuccaaguagucaaagacgcccaagcccuacugcacggucucgacuuuuccgagguaaguaacguccaacgccucaugcgcaaacaaaaacgcgacgacuccgaccuuaaacgacuccgcgaccucaaccaagccguaaacaaccuaguagaacucaaaagcacccaacaaaaguccguccuccgugucggcacccucaccuccgacgaccuccuaacucucgcagccgaccucgagaaacucaaauccaaagucauccgcacagaacgaccgcucuccagcggagucuacaugggcaaccucagcgcccaacaacuagaacaacgacgaacccuacucaacaugaucggcauggugggcggcgcccaaggcacccaaccaggcagagauggcgucguaaggguaugggacguaaaaaaccccgaccuacuaaacaaccaguucgguaccaugcccucgcucacccucgccugccuaaccaaacagggccagguagaccucaacgacgucguccucgcccuaacagaccucggccucaucuauaccgccaaauacccgaacuccuccgaccuugaccgauuaagccagucccacccaauauuauccauggucgacacaaaaaaauccagccucaacaucuccggcuacaacuucagccucggagcagccgucaaagcaggcgccugcaugcucgacggcggaaacaugcuagaaacaauaaaaguaaccccacaaacgauggacggaauacuaaaaagcauccucaaagucaaaaaaucacucggcauguucguauccgacacaccuggugagcgcaacccuuacgaaaacauacucuacaaaaucugccucuccggagauggcuggccauacaucgcaucacgcaccuccaucguaggccgcgccugggagaacacaaccgucgaucuugaaagcgacgguaaaccucaaaaagucggcaccgcaggaucaaacaaaucccuccagagcgcgggcuuccccacagggcuaaccuacagccaacuaaugacacuaaaagacuccaugaugcaacucgaccccuccgcuaaaacauggaucgacaucgaaggccgacccgaggaccccgucgaaauagcacucuaccaacccauguccggcugcuacauccacuucuuccgcgaacccaccgaccucaaacaauucaaacaagacgccaaauauucccacggaaucgauguaaccgaccuauuccccgcccaaccaggccuuacauccgcggugaucgaagcacuaccccgcaacaugguccuaacaugccaagggucggacgacauaaaacgccuccucgacucccaaggccgccgcgacaucaaacucaucgacaucgcccucucaaaagccgacucacgccgcuucgaaaacgccgucugggaccaaugcaaagaccugugccacaugcacaccggagucgucgucgaaaaaaaaaaacgcggaggaaaagaagaaauuacaccccacugcgcccucauggacugcaucauguacgacgccgccguaagcggcggccuaaacauacccguccuacgggccguacuaccccgugacaugguauucaggaccucuucccccaaaguaguccuuuga

SEQ ID NO: 3317 - RNA, 1710 nt, Artificial Sequence
  derived and/or modified CDS sequence (opt11) from Lassa virus__AIT17589__NP
augucagcaagcaaagaggucaaauccuuccucuggacccaaucacuacgacgagaacucuccggcuacugcuccucaaucaaacuccaggucguaaaagacgcucaagcccuccuccacggacucgacuucucagaaguaagcaacguccaacgccugaugagaaaacaaaaacgugacgacucagaccuaaaacgccuccgcgaccucaaccaagccgucaacaaccucgucgaacucaaauccacacaacaaaaaucuauccucagagucggcacacucacuuccgacgaccuacucacccucgccgcagaccucgaaaaacuaaaauccaagguaauccgaaccgaacgcccccuauccagcggagucuacaugggcaaccucucagcccaacagcucgaacaacgccgagcacuccucaacaugaucggcaugguaggcggggcccaaggaacacaaccaggccgcgauggcgucgugcgcguaugggacgucaaaaaccccgaucugcucaacaaccaauucgggacaaugcccucacucacccucgcuugccuaaccaagcaaggacaaguugaccuaaacgacgccguacucgcccuaacggaccucggccucauuuacacugcuaaguaccccaacuccucagaccucgacagacucucccaaucacacccgauccuaaacaugguagacaccaaaaagucgagccuaaacaucucaggguacaacuucucgcucggcgcagcagucaaagccggagccugcaugcucgacggaggcaauaugcucgaaacaaucaaggucacaccccaaaccauggacggcauccucaaguccauccugaaagucaaacgcagcuuaggcauguucgugagcgacacaccaggcgaacgcaaucccuacgaaaacauccucuacaaaaucugccucuccggugacggauggcccuacaucgccagccgcaccucaaucguaggacgcgccugggaaaacaccaccgucgaccucgaaagcgacggcaaaccacaaaaagucggcacgacaggcagcaacaaaucccuccaaucagccggcuuccccaccggccucaccuacucccagcuaaugacccuuaaagacucaaugaugcagcuugaccccucggccaaaacauggaucgacauagagggacgccccgaagaccccguugagaucgcccucuaccagccaauguccggcuguuacauccacuucuuccgcgaacccaccgaccucaaacaauucaagcaagacgcuaaauacucccacggcaucgacguagcagaccuauuccccgcccagcccggcuuaacgucugcagugaucgaggcccuacccagaaacaugguacucacuugccaaggcagcgacgacaucaagaaacuacucgacagccaaggaagacgagacaucaaacuaauagauaucgcccucucgaaagccgacucacgcaaauuugaaaacgcagucugggaccaaugcaaagaccucugccacaugcacacaggcgucguggucgagaaaaagaaacgcgggggcaaagaagaaauaaccccucacugcgcccucauggacugcauaauguacgacgccgcagucagcggcggccugaacauccccguuuuaagagccguacucccgcgagacauggucuuccgaacaucgucccccaaaguaguccucuaa

SEQ ID NO: 3318 - RNA, 1710 nt, Artificial Sequence
  derived and/or modified CDS sequence (opt11) from Lassa virus__AIT17593__NP
auguccgccagcaaagaggucaaaucauuccuuuggacccaaucccuccgccgcgaacucuccggcuacugcuccuccauaaaacuccaagucgucaaagacgcacaagcccuccuccacggccuagacuucucagaagucucaaacguccaaagacucaugcgcaaacagaaaagagacgacggagaccucaagcgacuucgcgaccucaaccaagcaguaaauaaucucguagaacucaaaagcacccaacaaaaauccauccuacgaguaggaacccucacauccgacgaccuccucacccucgccgcugaccucgaaaaacuaaaauccaaagucaucagaacagagcgcccccucagcagcggcguauacaugggaaaccuuucaucgcaacaacucgaacaacgcagagcccugcucaacaugauaggcaugguuggaggugcacaaggaacacaacccgggcgcgacggcguaguccgcgucugggacgucaaaaaccccgaccuacucaacaaccaguuuggcaccaugcccucacucacccuugccugccucaccaaacaaggccagguagaccuuaacgaugcgguccucgcccucacagaccucggccugaucuacacagccaaauaccccaacagcuccgaccucgaccgacuuagccaaucccacccaauccugaacaugguagacaccaagaaaagcucucucaacaucuccggauacaacuucucccucggcgcagccgucaaagccggcgccugcaugcucgacggcggaaacaugcuagaaaccaucaaaguaacuccacaaaccauggacggaauccucaaauccauacuaaaagugaaacgaucccuaggcauguuuguuucagacacgcccggcgaacgcaacccguacgaaaacauccucuacaaaaucugccuaucaggagacggcuggccguacaucgcuagccgcacaucaauugucggacgcgccugggaaaacacaaccguagaccucgaguccgacggcaaaccacaaaaggucggcgcagcaggaagcaccaaaucacuucaauccgccggauuccccaccggacucaccuacucacaacucaugacacuaaaggacuccaugaugcaacucgaccccagcgccaaaaccuggaucgacaucgaaggaagaccagaggacccagucgaaauagcccucuaccaacccauguccggaugcuauauccacuucuuccgcgaacccacggaccuuaaacaauucaagcaagacgcaaaauacucccacggcauagacguugcagaccuauucccagcccaacccggccucaccucugcggucaucgaagcacucccgcgaaacaugguacuaacgugccaagguuccgaugauaucaagcgccuccucgacucccaaggucgacgcgauaucaaacuuauagacaucgcccuauccaagguagacagccgacgauucgaaaacgccgugugggaccaaugcaaagaccucugccacaugcacaccggagucgucgucgaaaagaagaaacguggaggaaaagaagaaaucacaccccacugugcgcuaauggacugcauaauguacgaugcagccguuuccggaggccucaacaucccaguauuaagggccguccucccccgcgacaugguauucaggaccucuuccccaaaaguaguacuuuaa

SEQ ID NO: 3319 - RNA, 1710 nt, Artificial Sequence
  derived and/or modified CDS sequence (opt11) from Lassa virus__AIT17605__NP
augagcgcguccaaagaagucaaauccuuccucuggacacagagccuccgccgcgaacucagcggcuacugcuccuccauuaaacuccaagucguaaaagacgcacaagcccuacuacacggccucgacuucuccgaaguauccaauguccaaagacucaugcgaaaacagaaacgagacgacucagaccuaaaaagacuccgagaccuaaaccaagcugucaacaaccuuguugaacuaaaaagcacacaacaaaaauccauccuccgcguaggaacccucaccagcgacgaccuacucacccucgccgccgaccucgaaaaacucaaauccaaagucauccgcacugaacgcccccuguccucaggcguguacaugggaaaccuauccacacaacaacuagaacaacgacgcgcccuccugaacaugaucggcauggccggcggagcacaaggaacccaacccgguagagacgguguaguccgcguaugggacgucaaaaaccccgaccugcucaacaaccaguucggcaccaugcccucccucacccuugcaugccucaccaaacagggacaagucgaccucaacgacgccguccuugcucuaacagaccuaggacuaaucuacacagccaaauacccaaauucaagugaccucgacagacucagccaaucccaccccauacucaacaugguagacaccaagaaauccucucuaaacauauccggauacaacuucucccucggcgccgcagucaaagccggagccugcaugcuugacggcgggaauaugcucgaaacaaucaaaguaacaccucaaacaauggacggcauccucaaauccauccugaaaguuaagaaaucccucggcauguucgucagcgacacacccggcgaacgcaaccccuacgaaaacaucuuauacaaaaucugccucucuggagacggcuggccuuacauagccagcagaaccuccaucguaggacgagccugggaaaacaccaccguagaccucgaaagcgacggcaaaccacagaaagucggcaccgccggguccaacaaaucacuccaaucugccggguucccaaccggccuuacauacagccaacuaaugacccuaaaagacuccaugaugcaacuagacccauccgccaaaaccuggaucgacauagaaggcagacccgaggaucccgucgaaaucgcccucuaccaacccauguccggaugcuacauccacuucuuccgagaacccaccgaccucaaacaauuuaaacaagacgccaaauacagccauggaaucgacgucgcagaccucuucuccgcacaacccggccucaccuccgcagucauagaagcccucccccgcaacauggugcugaccugucaaggaucggacgacaucaaacgccuccucgacucccaaggucgacgcgacauuaaacuuauagacaucgcccuaagcaaagcagacuccagacgcuucgaaaacgccgucugggaccaaugcaaggaccucugccacaugcauaccggcgucgucgucgagaaaaagaaacgcggcgguaaagaagaaauuacaccacacugcgcccucauggacugcaucauguacgaugccgcggugagcggagggcuaaacauaccgguccucagagcaguucuacccagagacauggucuuccgcaccuccagcccaaaagucguccucuaa

SEQ ID NO: 3320 - RNA, 1710 nt, Artificial Sequence
  derived and/or modified CDS sequence (opt11) from Lassa virus__AIT17609__NP
augagcgcgagcaaagaaguaaaaucauuccuauggacccaaagccugcgcagggaacuauccggcuacugcucaagcauaaaacuccaagucgugaaagacgcccaagcccuacuacacgggcuugacuucagcgaaguauccaacguacagagacucaugcgaaaacaaaaacgagacgauagcgaucuaaaacgacuccgcgaccuaaaccaagccguuaacaaccucgucgaacuaaaaagcacccaacaaaaauccauccuccgagucggcacccucaccagcgacgaccuccucacccucgccgcagaccucgagaaacucaaaagcaaaguaauacgcaccgaacgcccccuaucauccggcguguacaugggaaaccuaagcacccaacaacucgaacaacgacgcgcccuccucaacaugaucggcauggccggcggcgcccagggcacccaaccgggccgggacggcgucgugagagugugggacgucaagaaccccgaccuucucaacaaccaauucggcacaaugcccucacucacacucgcaugccucaccaaacaaggccaagucgaccuaaacgacgcaguacuagcacugacagaccuaggccuuaucuacaccgccaaauacccaaacuccuccgaccucgacagacuaucccaaucccacccaauacuaaacauggucgacacaaagaaauccucccugaacauaagcggguauaacuucucccugggcgccgccguaaaagccggcgccugcaugcucgacgggggcaacaugcucgaaaccaucaaagucaccccacaaaccauggacggaauacuaaaauccauacuuaaggucaagcgaagccuaggcauguucgucagcgacacccccggcgaacgaaauccauacgaaaacauacucuacaaaaucugccuaagcggcgacggcuggcccuacaucgccagucgaaccuccauagucggccgcgccugggaaaacacuaccgucgaccucgagagcgauggcaagccccaaaaaguaggcgccgccggcuccaacaagucccuccaaagcgcaggcuucccaacaggccuaaccuacucccaacucaugacccuaaaagacuccaugaugcaacuagaccccagcgccaaaacuuggaucgacauagaaggcagaccugaggacccaguagaaaucgcccucuaccaaccaaugucaggcugcuacauacacuucuucagggaacccaccgaccucaaacaguucaaacaagacgcaaaauacucccacggaaucgacgucgccgaccucuucccagcacaacccggccucaccucugcaguaauagaagcacuuccccgaaacaugguccuaaccugccaagggucagacgacaucaagcgccuccucgacucccaaggccgcagagacauaaaacucauagacauugcccucagcaaagcggacucccgaagauucgaaaacgccgucugggaccaaugcaaggaccuaugccacaugcauacaggcgucgucguagaaaagaagaaacguggaggcaaagaagaaaucacuccccacugcgcacuaauggacugcauuauguacgacgccgccguauccgguggucucaacauccccguccuaagagcaguccucccacgagacaugguauuccgcaccuccucucccaaaguggugcucuaa

SEQ ID NO: 3321 - RNA, 1710 nt, Artificial Sequence
  derived and/or modified CDS sequence (opt11) from Lassa virus__AIT17613__NP
auguccgccagcaaagaagucaaauccuuccuauggacacaaagccucaggcgcgaacucagcggcuacugcucgaacauaaaacuacaagucgugaaggacgcccaagcgcuacuacacggccuagacuucagcgaagucuccaacguacaaaggcucaugcgaaagcaaaaacgcgaugacucagaccucaaaagacuccgagaccuaaaccaagcaguaaacaaccucgucgaacucaaauccacccagcaaaaauccauccuccgcguaggaacccuuaccuccgacgaccuacucacccuggccgcagaccucgaaaaacucaaaagcaagguaauccgaacagaacgaccccuauccucgggcgucuacaugggcaaccucuccacacaacaacuagaacagagacgagcacuacuaaacaugaucggaauggucggaggcgcccaaggaacgcaaccaggaagggauggcguaguccgaguaugggacgucaaaaacccagaccuacuaaacaaccaguucggcaccaugccaucccucacacuagcaugccucaccaaacaaggacaagucgaccucaacgacgccguccucgcccucacagaccucggucuaaucuacaccgccaaguaccccaacucuagcgaccucgauagacugagccaaagccaccccauacuaaacauggucgacaccaagaaaagcagccucaacaucucgggcuacaauuucagccucggggccgcaguaaaagccggagcaugcaugcucgacggcgggaauaugcucgaaacaauaaaagucaccccacaaacaauggacggcauccucaaauccauccucaaagucaaacggucacuuggcauguucguauccgacaccccgggcgaacgcaacccguacgaaaacauccucuacaaaaucugccuuagcggcgacggcuggccauacaucgccucacgcaccagcauagucggccgagccugggaaaacacaaccgucgaccucgagucagacggaaaaccccaaaaaguaggcaccgccgggucaaacaaaucccuccaaucggcaggauucccaaccggccuaaccuacucccagcuaaugacccucaaggacuccaugaugcaacuagacccuagcgcaaaaaccuggauagacaucgaaggccgccccgaagaccccguagaaauugcacuauaccagcccaugagcggaugcuacauacacuucuuccgcgaacccacggaccuaaaacaauucaaacaagacgcaaaguacucccacgggauagaugucgcggaccucuuccccgcccaacccggacucacauccgcggucaucgaagcgcuaccacgcaacaugguacuaacaugccaaggcuccgacgacaucaaacgccuacucgacagccagggacgccgcgacaucaaacucaucgacaucgcgcugagcaaaaccgacagcaggagauucgaaaacgccgucugggaccaaugcaaagaccucugucacaugcacacgggcgucguagucgaaaagaagaaacgcggcgguaaagaagaaaucacaccacacugugcgcucauggacugcaucauguacgacgccgcaguguccggaggacucaacauacccguacuacgagccguacuaccccgggacaugguauuucgaacgagcucaccaaaaguaguccucuaa

SEQ ID NO: 3322 - RNA, 1710 nt, Artificial Sequence
  derived and/or modified CDS sequence (opt11) from Lassa virus__AIT17617__NP
auguccgccucgaaagaaguaaaaucguucuuguggacccaaucucugcgucgcgagcuaaguggguacugcuccuccaucaagcuccaagucguuaaagacgcucaagcccuccuccacggccuagacuucuccgaagucuccaacguacaacgccucaugcgcaaacaaaaacgcgacgacuccgaccuaaaaagacuccgagaccucaaucaagcagucaacaaucucgucgaacuaaaaagcacccaacaaaaauccauccuacgagucggcacccuaaccagugacgaccuccuaacccucgcagcagaccuagaaaaacuaaaaucuaagguaauccgcaccgaacguccacuuuccuccggcguauacaugggcaaccucagcgcacaacaacuagaacaacgucgcgcgcuucuaaacaugaucggcauggucggcggcgcacaaggaacccaaccaggacgcgacggcguaguccgagucugggacgucaaaaaccccgaccuacuuaacaaccaauucggcaccaugccaucccucacccucgccugccuaacuaaacaaggacaagucgaccuaaaugacgccguccucgcccuaaccgacuuagggcugaucuacaccgccaaauaccccaacagcagcgaccuagacagacugucacaaucccaccccauacuuaacauggucgacaccaaaaaguccucacucaacauaagcggauucaacuucagccugggcgcagccguaaaagccggagccugcaugcucgacggcggcaacaugcucgaaaccaucaaagucacaccccagaccauggacggaauccuaaaauccauccuuaaagucaaaagaucacucggcauguucgucuccgacacaccuggagaacgcaaccccuacgaaaacauccucuacaaaaucugccuauccggcgacggauggccauacauagccucccgcacaagcaucguaggacgcgccugggaaaacaccaccgucgaccuagaaucagacggcaaaccucaaaaggucggaacagcaggcagcaacaaaucacuccaauccgccggcuucccaaccggccuuaccuacucccaacucaugacucucaaagacagcaugaugcaacucgacccgagcgccaaaacauggaucgacauagaaggccgucccgaagaccccgucgaaauagcucuguaucagcccaugagcggaugcuacauccacuucuuccgcgaacccacggaccuuaaacaauucaaacaagacgcaaaauacagccacgguaucgacguagcagaccuguucccagcgcaacccggacucaccuccgccgucauagaagcccuaccccgaaauauggugcuuaccugccaaggaucagacgacaucaaacgccuacucgauagccaaggccgccgugacaucaaacucauagacaucgcccucuccaaagccgacucccgccgcuucgaaaacgccgugugggaccagugcaaagaccuaugccauaugcacaccggcgucgucgucgaaaagaagaagagaggcggcaaagaagaaaucacgccccacugcgcacucauggacugcaucauguacgacgcagccguauccggcggccugaacaucccgguccuccgggcaguccucccccgggacaugguauuccgaaccuccucccccaaaguaguccuauaa

SEQ ID NO: 3323 - RNA, 1710 nt, Artificial Sequence
  derived and/or modified CDS sequence (opt11) from Lassa virus__AIT17621__NP
auguccgcauccaaagaaguaaaauccuuccuauggacccaaagccuccggcgcgaacuguccggcuacugcagcuccauaaaacuacaagucguaaaagacgcacaagcccuacuucacggccuagacuucuccgaaguaacaaacguacagcgacucaugcgcaaacaaaagcgagacgacucagaccugaaaagacugcgcgaccugaaucaagcaguaaacaaccucguagaacuaaaaucaacccaacaaaaauccauucuacgagucggcacccugaccuccgacgaccuacucacacucgcagccgaccucgaaaaacucaaauccaaggucauccgcacagaacgcccccuuuccucaggaguauacauggggaacuuauccacgcagcaacuagaacaacgcagagcacuccuaaacaugaucggaaugguagggggcgcacaaggcacccaacccggacgcgacggcguaguccggguaugggaugucaaaaaccccgaccuccuaaacaaccaauucggcaccaugccaagccucacacuagccugccucacaaaacaaggccaagucgaccucaacgacgccguccucgcccuaaccgaccucggacucaucuacacggccaaauacccaaacucauccgaccuugaccgacuaucccaaucccaccccauacuaaacauggucgacacaaagaaaucaucacuaaacaucucgggcuauaacuuuagccuaggcgccgccgucaaagccggcgcaugcaugcucgacgguggcaauaugcucgaaaccaucaaaguaacaccacaaaccauggacggcauacucaaaagcauacuaaaaguuaaacguucccuaggcauguucgucuccgacacacccggagaacgcaaccccuacgaaaacauccuauacaagaucugccuguccggcgacggcuggcccuacauagccucacgcacaucaauugucggcagagccugggagaacacaaccguagaccuagaauccgacggaaaaccccaaaaagucgggaucgcgggauccaacaagagccugcaguccgcaggcuuccccaccggccuaaccuauucucaacucaugacgcucaaagacuccaugaugcaacucgaccccucagccaaaacauggaucgacauagaaggccgcccagaagauccagucgagaucgcccucuaccagcccauguccggcugcuacauacacuucuuccgcgaacccaccgaccucaaacaauucaaacaagacgcuaaauauucacacggaauagacgucgcggaccucuucccagcccaaccaggccucaccucagccgucaucgaagcccucccacgcaauaugguacucacgugccaaggaucagacgacaucaaacgccuacuagacucacaaggcagacgagacauaaaacuaaucgauauagcucuaagcaaagccgacagccggaaguucgaaaaugccguaugggaccagugcaaagaccucugccacaugcacacaggcguaguaguggaaaagaagaaacgcggcggcaaagaggaaaucacgccccacugcgcacuaauggacugcaucauguacgaugcggcugucuccggcggacugaacauccccguacuacgagccguccucccacgcgacaugguauuccgcaccuccagcccaaaaguaguccuauaa

SEQ ID NO: 3324 - RNA, 1710 nt, Artificial Sequence
  derived and/or modified CDS sequence (opt11) from Lassa virus__AIT17625__NP
auguccgcaagcaaagaagugaaauccuuccuuuggacccaaagccuacgccgagaacucuccggcuauugcagcuccauaaaacuccaaguagucaaagacgcccaagcacuccuacacggccucgacuucucagagguaagcaacguacaacgccucaugcgcaaacaacgccgcgacgacucugaccuuaaacgccuccgagaccuaaaucaagccguaaacaaucucgucgaauuaaaauccacccaacaaaaauccauccuccgcguaggcacccucaccucugacgaccugcucacccucgcagccgaccucgaaaaacucaaauccaaagucauccgcaccgaacguccacucuccuccggcgucuacaugggaaaccucuccacgcaacaacuagaacagcgccgagcucuccucaacaugauagguaugguuggcggagcccaaggaacccaacccgggcgagacggcguaguccgcgucugggacgugaaaaaccccgaccugcuaaacaaccaauucggcaccaugccaagccucacccucgcaugccuaaccaaacagggacaaguagaccucaacgaugcagucuuagcccucaccgaccucggccuaaucuacaccgcaaaauacccuaacagcagcgaccucgaccgccucagucaaagccaccccauacuaaacauggucgacaccaagaaaagcucacucaacaucuccggcuacaacuucucccucggagccgcggucaaagcaggagccugcaugcucgacggaggcaacaugcucgaaaccaucaaaguaacaccccaaaccgucgacggcauccuuaaaucaauccucaaagucaaacgcagccucggaauguucgucucggacacaccaggagaacgaaauccuuacgaaaacauccucuacaaaauaugccuaucgggcgacggcuggcccuacauagcgucacgcaccuccauagucggccgcgccugggaaaacaccacaguagaccucgaaucagacggcaaaccccaaaaagucggcacagccggcuccaacaaaagccuacaguccgccggcuuccccaccgggcuaaccuacucccaacucaugacacucaaagacuccaugaugcagcuggacccauccgccaaaaccuggaucgacaucgaagggcgaccagaagacccaguggaaaucgcacucuaccaaccaauguccggcugcuacauccacuucuucagagaacccaccgaccucaaacaauucaaacaagacgccaaauacucccacggcauagacgucgccgaccucuuccccgcacaaccaggccucacaagcgccgucaucgaagcccuacccaggaacaugguacuaaccugccaaggcagugaugacauaaaacgacuccucgacucgcaaggacgccgcgacaucaaacuaaucgacauagcucucagcaaagccgacucccggaaauuugagaacgccguaugggaccaaugcaaagaccuaugccacaugcacaccggcguggucgucgagaaaaagaaacgcggcggcaaagaagaaauaacuccccacugcgcccucauggacugcaucauguacgacgccgcggucucgggcggccucaauauccccguccuacgagcaguccucccccgcgacauggucuuccgaaccucaucccccaaaguaguacuauaa

SEQ ID NO: 3325 - RNA, 1710 nt, Artificial Sequence
  derived and/or modified CDS sequence (opt11) from Lassa virus__AIT17627__NP
augucagccucaaaagaagucaaaucauuccucuggacccagucgcuccgccgagaacucuccggcuacugcagcucgauaaaacuccaagucguaaaagacgcccaagcacuacuacacggccuugacuucuccgaagucuccaacguacaaagacucaugcgcaaacaaaaacgcgacgacucagaccuaaaaagacuccgagaccuaaaccaagccguaaacaaccuagucgaacuaaaaucaacccaacaaaaauccauccuacgaguuggcacccucacauccgacgaccuacucacccuagcagccgacuuagaaaaacugaaauccaagguaaucagaaccgagcgcccacuuucuuccggaguauacaugggaaaccuuuccagccaacaacucgaacaacgacgagcacuacucaacaugauagggauggucggcggagcucaaggcacccaacccggccgcgacggcgucguccgcgucugggacgucaaaaacccagaccugcuaaacaaccaauucggcacaaugcccagccucacccucgcaugccucacaaagcaaggccaaguagaccugaaugacgccguccucgcucucacagaccuaggacuaaucuacacagccaaauaccccaacaguuccgaccucgaccgccucucgcaaucacacccaauccucaacaugguagacaccaagaaaucaucccucaacauaagcggcuacaauuucagccucggagcagcaguaaaagccggcgcgugcaugcuugacggcgggaacaugcucgagaccaucaaaguaacaccucaaacaauggacggaauccucaaauccauccuaaaaguuaaacgcucccuagggauguucgucuccgacacacccggcgaaagaaaucccuacgagaacauccuauauaaaauaugcuuaagcggcgacggcuggcccuacaucgccucccgcaccucaaucgucggccgcgccugggaaaauaccacugucgaucucgaauccgacggcaaaccccaaaaggucggcuccgccggcuccaacaaaucccuccaauccgcuggcuucccgacaggccucaccuacucacaacucaugacacuaaaagacucgaugaugcaacucgacccaucagcaaaaacauggaucgacauagaaggcagaccggaagaccccgucgaaauagcacucuaccaacccaugagcggcugcuacauacacuucuuucgcgaacccaccgaccucaaacaauucaaacaggacgcaaaauacucccauggcaucgacgucgccgaccuauuccccgcacagccaggacucacaagcgccgucauagaagcucuacccagaaacaugguacuaaccugccaaggcucggacgacaucaaacgccuccucgacucacaaggcagacgggacaucaagcucaucgacaucgcccuauccaaagcugacucccgccgauucgaaaaugccguaugggaccaaugcaaagaccuuugccacaugcauacaggcgucgucguagaaaagaagaaacguggaggcaaagaagaaaucacaccccacugcgcccucauggacugcauaauguacgacgccgcaguauccggaggccuaaacauccccguauuacgagcaguacuaccccgcgacauggucuucagaacauccucccccaaaguaguacuauaa

SEQ ID NO: 3326 - RNA, 1710 nt, Artificial Sequence
  derived and/or modified CDS sequence (opt11) from Lassa virus__AIT17631__NP
augagcgccuccaaagagaucaaauccuuccuauggacacaaucccuacgacgagaacuguccggauacugcuccuccauaaaacuccaagucguaaaagacgcccaagcacuacuccauggacucgacuucuccgaaguauccaacguccaaagacuaaugagaaaacaaaaacgugacgacucugaccuaaaacgccuaagagaccucaaccaagcaguaaacaaccucguugaacucaaaucaacccaacaaaaguccauucuccgcgucggcacccucaccucagaugaucuccucacccucgcagcagaucucgaaaaacucaaaagcaaaguaauacgaacagaacgcccacucuccucaggcguuuacaugggcaaccucagcacccaacaacuagaacaaaggcgcgcccuacucaacaugauaggcaugguaggcggagcacaaggcacacaacccggaagggacggcguaguccgagucugggacguaaagaaccccgaccuacucaacaaucaauucgggaccaugcccucgcuaacccuagcaugccucaccaaacaaggccaagucgaccugaacgacgccguccucgcccucacagaucuuggccucaucuacacagccaaauaccccaacuccucugaccuugaucgacuaucccaaucacaccccauacuaaacauggucgacaccaagaaaagcucccuuaacauuuccgguuacaacuucucacucggagccgcagucaaagcgggcgccugcaugcucgacggcggcaacaugcuagagaccauaaaagucacaccccaaaccauggacggcauccuaaaaucgauccucaaaguaaaacggucacucggcauguuuguaucagacgcacccggcgagcgcaaccccuacgaaaacauccucuacaaaauaugccuauccggugauggcuggccguacaucgccucccgaacaucaaucgucggcagagccugggaaaacacaaccguagaccucgaaucagacggcaaaccacaaaaagucggaacagccggcucaaacaaaucccuccaauccgccggcuuccccaccggccucacauacucccaacucaugacccuuaaagacagcaugaugcaacuagaccccuccgcaaaaacuuggaucgacauagaaggccgccccgaagaucccgucgaaaucgcccuauaucaaccuaugagcggcugcuacauccacuucuuccgagagcccaccgaccuaaaacaauucaaacaagacgccaaauacucccacggaauagacguggccgaccuauucccagcccaacccggccucacauccgccgucaucgaggcccuaccccgcaacaugguacuaacaugccaaggauccgacgacaucaaaagacuccucgacucacaaggccggcgcgacauaaaacuaauagacaucgcacucucaaaagccgacucccgccgauuugaaaacgccgucugggaccagugcaaagaucucugccacaugcacacaggcgucgucgucgaaaagaaaaagcgagguggaaaagaagaaauuacaccacacugcgcccucauggacugcaucauguacgacgcagccgucucagguggccuaaacaucccaguccuaagagccguccugccccgcgacauggucuuccgaacuagcagccccaaagucguccucuag

SEQ ID NO: 3327 - RNA, 1710 nt, Artificial Sequence
  derived and/or modified CDS sequence (opt11) from Lassa virus__AIT17635__NP
auguccgccuccaaagaaguaaaauccuuccucuggacccaaagccugcgacgcgaacuaucaggauacugcucaaacaucaaacuccagguagucaaagacgcccaagcccuccuacacggccucgacuucuccgaagucuccaacguccaacgccuaaugcgaaaacaaaaacgcgacgacaacgaccuaaaacgccucagagaccucaaccaagccgugaacaaccucguagaacuaaaauccacccaacaaaagucaauccuccgcguaggcacccucaccucagacgaccuccuaacccucgccgcugaucucgaaaaacuaaaaagcaaaguaauucguaccgaaagaccccuauccagcggcgucuacaugggcaaucucaacacccagcaacuagaacaaagacgagcccuacucaacaugaucggaauggucggaggcgcucaaggcacccaacccggcagagacggaguaguccgagugugggacguaaagaaccccgaccuccuaaacaaccaauucggaaccaugcccucacucacacucgccugccucaccaagcaaggccaggucgaccucaacgacgccguccucgcccucaccgaccuaggauuaaucuacaccgcaaaauaccccaacuccucagaccuagaccgacucucccaaagccaccccauacuaaacauggucgacacaaagaaauccagccuaaacauaagcggcuacaacuucucgcucggcgccgcgguaaaagcuggagccugcaugcuagacgguggcaacaugcucgaaaccaucaaagucacuccccaaaccauggacggcauccuaaaaucaauucuuaaaguaaagaaaucgcuaggcauguuuguaucagacacccccggcgaacgaaaccccuacgaaaacauucucuacaaaaucugccugucaggcgauggauggccauacauugccucaagaaccucaauaguaggccgcgcgugggaaaacaccaccguagaccucgaaucagacggaaaaccacaaaaaguagguaccgccggauccaacaaaucacuccaguccgccggauuccccaccggauuaacauacucccaacucaugacacugaaagacagcaugaugcaacucgacccuagcgcaaaaacuuggauagacaucgaaggacgacccgaagaccccguggaaaucgcccucuaucagccaaugucaggcugcuacauccacuucuuccgagaaccuaccgaccucaaacaauucaaacaagacgccaaauacucccacggaaucgacgucgcagaccucuuccccgcacaaccaggacucacauccgccgucaucgaagcacucccacgcaacaugguccuaacaugccaaggcuccgacgacauaaaacgacuacucgacucccaaggaagaagggacauaaaacuuaucgacaucgcacucagcaaagcagacucgcgccgauucgaaaacgcuguaugggaccaaugcaaagaccucugccacaugcacacaggcgucguaguggagaaaaagaaacguggcggcaaagaagaaaucacaccccacugcgcccuaauggauugcaucauguacgacgcagcaguauccggcggccuaaacauccccguccuaagggccguacuaccccgcgacauggucuuccgcaccagcucacccaaagucguccucuaa

SEQ ID NO: 3328 - RNA, 1710 nt, Artificial Sequence
  derived and/or modified CDS sequence (opt11) from Lassa virus__AIT17639__NP
augagcgccagcaaagaagucaaguccuuccucuggacacaaucacuccgacgcgaacucuccggauacugcucuaacaucaaacuccaagucguaaaagacgcccaggcucuauuacacggucucgacuucucugaaguaagcaacguccaacgccugaugcgcaaacaaaaacgcgacgacagcgaccuaaaacgacuccgagaccuaaaucaagcagucaacaaccuggucgaacuaaaauccacccaacaaaagagcauccuccgaguaggcacccuuaccuccgacgacuuacugacccuagcagcagaccucgagaagcucaaaucuaaaguaauccgaacggaacgcccccucagcucgggcgucuacaugggaaaccucagcacacaacaacucgaacaaagacgagcacuccuaaacaugaucggaauggucggcggcgcccaaggcacccaaccaggcagagauggcgucguccgcgucugggacgugaaaaaccccgaccuucuaaacaaccaauucggaacaaugcccagccuuacgcuagccugccuaaccaaacaagggcaagucgaccugaacgacgccguccucgcccucaccgaccucggucucauauacaccgccaaauaccccaacagcuccgaccuagaccgccugucccaaucacaccccauucugaacauggucgacaucaagaaaucaucacugaacauauccggcuacaacuucucccuuggcgccgcggucaaagccggcgcaugcaugcucgacggcggcaacaugcuagaaacaauaaaagucaccccacaaaccauggacggcauccugaaauccauccuuaaaguaaaacgaagccucggcauguucguguccgacaccccaggcgaacgcaaccccuacgagaauauccucuauaaaaucugccucagcggcgacggauggccauauaucgccagccgcacauccaucgucggcagagcaugggaaaauaccaccguugaccuggaauccgacggcaaaccccaaaaaguaggcuccgccggauccaacaaaucacuucaauccgcaggcuuccccaccggccucaccuacagccaacucaugacccuaaaagacucaaugaugcaauuagaccccuccgccaaaaccuggaucgacaucgaaggacgacccgaagaccccguugaaauugcccuauaccaaccaauguccggaugcuacauccacuucuucagagagcccacagaccucaaacaauucaaacaagacgcaaaguacucccacggcaucgacgucgccgaccuauuuccagcccaacccggccucaccucagccgucauagaagcccucccuaggaacaugguccuuaccugccaaggcagcgacgacauuaaacgccuccucgacucccaaggcagacgagacaucaaguuaauugacauagcucucucgaaggcugacucccgacgcuucgaaaaugcagucugggaccaaugcaaggaccuuugccacaugcauaccggcgucgucgucgagaaaaagaaacgcggaggaaaagaagaaauaaccccacacugcgcccucauggacugcaucauguacgacgcugccguauccggaggacucaacaucccggugcuccgcgccguccuaccccgcgauauggucuuccgcaccucaucccccaaagucgugcucuaa

SEQ ID NO: 3329 - RNA, 1710 nt, Artificial Sequence
  derived and/or modified CDS sequence (opt11) from Lassa virus__AIT17643__NP
augucagccuccaaagaagucaaaucauuccucuggacccaaucccuccgacgagaacuauccggcuacugcuccaauauaaaacuccaagucguuaaagacgcccaagcccuacuccacggccuggacuucuccgaaguauccaacguccaacgccuaaugagaaaacaaaaacgggacgacagcgaccucaaaagacuaagagaccuuaaccaggccgucaacaaccucguagaacucaaaaguacgcaacagaaaucgauacuaagagucggaacacucaccagcgacgaccuccuaaccuuagccgccgaccucgaaaaacucaaaagcaaagucauccguacagaacgaccccuaucaucaggcgucuacaugggaaaccucagcgcccaacaacuagaacaacgcagagcccuccucaacaugaucggcauggucggaggagcacaaggcacgcaacccggccgugacggagucguacgaguuugggacgucaaaaacccagaccuccucaacaaccaauucggcaccaugcccucacucaccuuagccugccuaaccaaacaaggacaagucgaccucaacgacgccguacucgcucuaaccgaccuuggccucaucuacacagccaaauacccuaacuccuccgaccuggaccgccuaagccaaucacaccccauccuaaacauggucgacacgaagaaaucaucccucaacauauccggauacaacuuuagccugggagccgcagucaaagcgggagcaugcaugcucgacggaggcaacaugcuagaaaccaucaaagucaccccacagacaauggacgguauucuuaaaucuauccucaaaguaaagaaaagccucggaauguucgucagcgacacccccggcgaacgaaaccccuacgagaacauccucuacaaaaucugccuauccggcgacggcuggcccuacaucgccagcagaaccucaauagucggacgcgccugggaaaacacaacagucgaccucgagucagacggaaaaccccaaaaagucggaaccgcaggcuccaauaaaucccuccaaucagccggcuucccaaccggucucaccuacucacagcuaaugacacuaaaagacagcaugaugcagcucgaccccuccgccaaaacuuggaucgacaucgaaggccgacccgaagacccagucgaaaucgcacuauaccagcccaugagcggcugcuacauacacuucuuccgagaaccaacagaccucaaacaguucaaacaagacgccaaauacucccacggcauugacguggccgaucucuucccagcccaaccaggucuaacauccgccgucaucgaagcacucccccguaacaugguccucaccugucagggcuccgacgacauaaaacgccuccuagacucccagggccgccgcgacaucaaacuuaucgacaucgcacuuuccaaagccgacucucgccguuuugagaacgccgucugggaccaaugcaaagaccucugccacaugcacaccgguguagucguagagaaaaagaaaagaggcgguaaagaagaaaucacaccccacugugcccucauggauugcaucauguacgacgcagcaguaucaggaggccucaacauuccaguccuccgcgcaguccuaccccgcgacauggucuucaggacaagcagccccaaagucguacuauaa

SEQ ID NO: 3330 - RNA, 1710 nt, Artificial Sequence
  derived and/or modified CDS sequence (opt11) from Lassa virus__AIT17651__NP
augagcgccucgaaagaggucaaauccuuccucuggacccaaucccuacgucgagaacuauccggauacugcucaucaaucaaacuccaaguuguaaaagacgcacaagcccuccuccacggccucgauuucagcgaagucuccaacguccaacgacucaugcgaaaacaaaagcgagacgacuccgaccucaaacgacuccgcgaccucaaccaagccguuaacaaccucgucgaacucaaauccacccagcaaaaauccguacuacgagucggaacacucaccuccgacgaccuccuuacccucgcugccgaccuagaaaaacuuaaaagcaaaguaauacgaaccgaacgcccccucuccucuggcgucuacaugggcaaccucuccgcccaacaacucgaacaacgacgcgcccuacuaaacaugauaggaauggucggcggcgcccaaggaacccaacccggacgcgacggggucguacgcgucugggacgucaaaaacccagaccuccugaacaaccaauucggcaccaugcccagccuaacccucgcaugccucaccaagcaaggccaaguagaccuaaacgacguaguccuggcccuaaccgaccuaggccuaaucuacaccgcaaaauaccccaauuccagcgaucucgaccgacucagccaaucccacccaauccuaaacauggucgacacaaagaaaucaucccuaaacaucucaggauacaacuuuucccucggcgcggcagucaaagccggagccugcaugcuugacggaggcaacaugcuagaaacaaucaaagucacaccccaaaccauggacggcaucuuaaaauccauccucaaagucaagaaaucccucggaauguucgucucagacacgcccggcgaacgaaacccauacgagaacauacucuacaaaaucugucucuccggagacggauggcccuacauagcaagccgcacaucuaucgucggcagagcgugggaaaacaccaccguagaccucgaguccgacggcaagccccaaaaaguagguaccgccggcagcaacaaaucacuacaguccgccggcuucccaacaggacuaacauacucccaacuaaugacacucaaagacuccaugaugcagcuagacccauccgccaaaaccuggauugacauagaaggacguccagaggaccccgucgaaaucgcacucuaccaacccauguccggcugcuacauacauuucuuccgagaacccacagaccucaaacaguucaaacaggacgccaaauacucccacggaaucgacgucaccgaccuauuuuccgcccaacccgggcuuacuagcgccguuauagaggcccuaccaagaaacaugguccuaacaugccaggggucagacgacaucaaacgcuuacucgacucccaaggccggcgugacaucaagcucauagacaucgcgcuaagcaaggccgacuccagacguuucgaaaacgccguaugggaccaaugcaaagacuugugccacaugcacacaggggucguagucgagaaaaagaaacgcggaggaaaagaagaaauaaccccucacugcgcccucauggauuguauaauguacgacgcugccgucucaggaggccucaacauccccguccuccgagccguccucccccgagacaugguauuccguaccuccucacccaaagucguacucuaa

SEQ ID NO: 3331 - RNA, 1710 nt, Artificial Sequence
  derived and/or modified CDS sequence (opt11) from Lassa virus__AIT17655__NP
auguccgccuccaaagaagucaaaucauuccuauggacacaaucccuccgccgugaacuauccggcuacugcucgaacauaaaacuccaaguggucaaagacgcccaagcccuccuccacggacucgacuucuccgaggucagcaacguucaacgcuuaaugcgaaaacaaaaacgcgacgacagcgaccuaaaacgccuacgcgaccuaaaccaagccguaaacaaccucgucgaacucaaaucuacacaacaaaaaucaauccuccgcguaggcacacucacaagcgacgaccuccugacacuagcagccgaccuagaaaaacuaaaaagcaaagucauccgcacagaaaaaccacuauccagugguguguacaugggcaaucuuucaacacaacaacuagaacaaagacgcgcccuccuaaacaugaucggaauggucggcggcgcccagggcacacaacccggccgcgacggcgucguccgcgucugggaugucaaaaacccagaccuacucaacaaucaauucgguaccaugcccucccucacccuggccugucuaaccaaacaaggccaaguagaccucaacgacgcagugcuagcacuaaccgaccuaggccucaucuacaccgcaaaauuccccaauucauccgaccucgaccgccucucccaaucccaucccaucuuaaacaugguagacaccaagaaauccucccuaaacauaagcggcuacaacuucucccuaggagccgccgucaaagccggggccugcaugcucgacggcggcaacaugcuugaaacaaucaaagucacaccccaaaccauggacggcauacucaaauccauccuaaaagucaagaaauccuuaggcauguucgucagcgacacccccggcgaacgaaaucccuacgaaaacauacuguacaaaaucugccuauccggcgacgguuggcccuacauagcaucccgcaccuccaucgucggccgcgcaugggaaaacaccacaguagaccucgagucagacggcaaaccccaaaaagucggcacgacuggauccaacaaaucacuacaauccgccggcuuccccacaggccuaacuuacucacaacuuaugacccuaaaagacuccaugaugcagcucgacccaucagccaaaaccuggaucgacaucgaaggaagaccagaagaccccguagaaaucgcccuauaccaacccaugucaggaugcuacauccacuucuuccgcgaacccacagaccuaaaacaauucaaacaagacgcuaaauacucccacggaaucgacgucgccgaccuuuuccccgcccagccuggccuaaccagcgccguaauugaggcacuaccucgaaacaugguacuaacaugucaaggguccgacgacaucaaacggcuccuugacucucaaggccggcgagacauaaaauuaauagacaucgcgcucucaaaagcagacucccgaagauucgaaaacgcagucugggaccaaugcaaagaccucugccacaugcauacaggagucguagucgagaaaaagaaacgaggaggaaaagaagaaaucaccccacacugcgcucuuauggacuguauaauguacgacgcugccguaagcggcggccucaacauccccguccuacgcgccguccucccucgcgacaugguuuuccgaaccuccucccccaaagucguuuuauaa

SEQ ID NO: 3332 - RNA, 1710 nt, Artificial Sequence
  derived and/or modified CDS sequence (opt11) from Lassa virus__AIT17659__NP
auguccgcgagcaaagaagucaaaucauuccuuuggacccaaucccuccgacgagaacucuccggcuacugcuccagcaucaaacugcaagucguaaaagacgcucaggcccuccuacauggccuagacuucagcgaagucucaaacguccaacgacuuaugcggaaacaaaaacgcgacgacuccgaccucaaacgccuacgcgaccucaaccaggccguaaacaaccuugucgaacucaaaucaacacaacaaaaauccguacucaggguuggaacgcucacaucagacgaccuccugacacuagccgcugaucuagaaaaauugaaguccaaagucauccgcacagaacgcccucuuuccagcggcgucuacaugggaaaccucuccacacagcaacuagaacaacgccgcgcacuacuaucuaugaucggcaugguagguggcgcccaaggcacacagcccggccgagacggcgucgucagagucugggacguuaaaaauccugaccuccucaacaaccaguucgguaccaugcccucccugacgcuggcgugccucacaaagcaaggacagguagaccucaacgacgcaguacucgcccucaccgaccucggacuaauuuacaccgccaaguacccaaacuccuccgaccuagacagacuaucacaaucccaccccauacucaacauggucgacaccaagaaauccucccucaacauauccggcuacaacuucucccucggagcagcagucaaagccggagccugcaugcuagacggaggcaacaugcucgaaacaaucaaaguaacaccucagaccauggacggcauacuaaaaucgauccucaaaguaaaaagaucacucggaauguucgucucugacaccccaggagaacgcaaccccuacgaaaacauacucuauaaaaucugccuaagcggcgacggcuggcccuacaucgccuccagaaccagcaucgucggccgcgccugggaaaacacaacaguagaccucgaaucugacggcaaaccacaaaaagucggaacagcaggaucuaacaaaucacuacaaucagccggcuuccccaccggacucacauacucccagcucaugacccucaaagacuccaugaugcaacucgacccaagcgccaaaaccuggaucgacauagaaggaagaccagaagaccccguagaaaucgcccuauaccaaccuauguccgggugcuacauccacuucuuccgcgagcccaccgaccuaaaacaauucaaacaagacgccaaauacucccacggcaucgacguagccgaccuauucccagcacaaccaggacuaaccuccgccgucaucgaggccuuaccccgcaauaugguccuuaccugccagggcagcgacgacaucaaacgccuccucgacagccaaggccgccgcgacauaaaacuaauagacauugcccugaacaaagcagacucccggagauucgaaaacgccgucugggaccaaugcaaagaccuaugccacaugcacaccggcgucgucgucgaaaagaagaaacgcggaggcaaagaagaaaucacaccacacugcgcccucauggacugcaucauguacgacgcugccgucuccggaggacuuaacaucccgguccuccgcgcaguccuaccccgagacaugguauuccgaaccucauccccaaaagucguacuguaa

SEQ ID NO: 3333 - RNA, 1710 nt, Artificial Sequence
  derived and/or modified CDS sequence (opt11) from Lassa virus__AIT17663__NP
augagcgccucuaaagaaguaaaaucguuccuuuggacacaaucacuccgccgcgaacucagcggcuacugcuccuccauaaaacuccaaguagucaaagacgcccaagcccuccuccacggacuagauuucucggagguauccaacguccaacgacugaugcgaaaacaaaaacgcgacgacagcgaccucaaacgccuccgagaucuaaaccaagccgucaacaaccucgucgaacucaaaagcacacaacaaaaauccauccuucgcguuggaacccucacgagcgaugaccuacucacacucgccgcagaccucgaaaaacugaaauccaaagucauccgaacagaaagaccccucuccuccggcgucuacaugggaaaccucaguacccaacagcucgaacaacgccgcgcccuacucaacaugaucggaauggucggaggcgcccagggcacacaaccaggccgcgacggagucguccgcguaugggaugucaaaaacccugaccuacucaacaaccaauuuggcaccaugcccucccuaacccuggccugccuaacaaaacaaggacaaguagaccucaacgacgccguacucgcccucacugaccucggccugaucuacaccgcaaaauaccccaacuccagcgaccuggaccggcucucacaaucgcaccccauccucaacauggucgacaccaagaaaucaagccucaacauaucaggcuacaacuucucccuaggagccgccguaaaggcuggagccugcaugcucgacggcggaaacaugcucgaaaccaucaaggugacuccccaaaccauggacggcauccucaagagcauccucaaagucaaaagaucccugggcauguucgucucagauaccccaggcgaaagaaaccccuacgaaaacauccuauacaaaaucugccucuccggcgauggcuggccguacaucgccucccgaaccucaaucgucggccgcgcaugggaaaauaccaccguugaccucgaaucugacgggaaaccccagaaagucggcacagcaggaucuaacaaaucccuacaaucagccggcuucccaaccggccuaacauacucccaacuaaugacccucaaagacucaaugaugcaacucgaucccucggcaaaaacauggaucgacauagaaggacgaccggaagaccccguugaaauagcccucuaccaacccauguccggcugcuacauacacuucuuccgugaacccaccgaccucaaacaauucaaacaagacgcgaaauacucccacggaaucgacgucgccgaccucuuccccgcccaacccggucucacauccgccgucauagaagcucuaccacggaauaugguccucaccugucagggcuccgacgacauaaagaaacuccucgacucccaagggcgaagagacauaaaacugaucgacaucgcacucuccaaagccgacucacgacgauucgagaacgccgucugggaucaaugcaaagaucucugccacaugcacacaggugucguuguagagaaaaagaaacgcggcggcaaagaagaaaucaccccacacugcgcucucauggacugcaucauguacgacgccgccgucuccggcggccucaacauacccguccuacgcgccguccucccacgcgacauggucuuccgcaccucaagcccaaaaguuguguuauaa

SEQ ID NO: 3334 - RNA, 1710 nt, Artificial Sequence
  derived and/or modified CDS sequence (opt11) from Lassa virus__AIT17667__NP
augagcgccuccaaagaagucaaauccuuccuguggacccaaucacuccgccgagaacucuccggauacugcuccucaaucaaauugcaaguagucaaagacgcgcaagcccuacuacacggacucgacuucuccgagguauccaacguccaacgucucaugagaaaacagaaacgcgacgacuccgaccucaaacgacugcgcgaccugaaucaagccgucaacaacuuagucgaacucaaaagcacacaacaaaaauccaucuuacgugucggcacccucaccuccgacgaccuacucacccucgccgcagaccuagagaaacugaaaucuaaagucauacgaacagaaaggccccucuccucaggcgucuauaugggcaaccucagcacgcaacaacucgaacaaaggagagcccuccuaaacaugauaggaaugguaggcggagcccaaggcacccaaccaggccgagacggagucguccgcgucugggacgugaaaaaccccgaccuccucaacaaccaauucggcaccaugcccagccuuacccuagcaugucuaacaaagcaaggacaaguugaccuaaacgacgccguccuggcacucaccgaccuagggcuaauauacaccgcuaaauaccccaacucaagcgaccuugaucgccucucacagagccaccccauccuaaacaugguagacaccaagaaauccagccucaacauaagcggcuacaacuucucccucggagccgcagucaaagccggcgccugcaugcucgacggcgggaauaugcuugaaacaaucaaagucacaccacaaacaauagacggaauccucaaaucaauccucaaagucaagaaaagccucggcauguucgucucagacacaccaggcgaacgcaaccccuacgaaaacaucuuauauaaaaucugccugagcggcgacggcuggccauacaucgcaucuagaacaagcaucgucggacgcgccugggaaaacaccacagucgaccucgaguccgacggcaaaccccaaaaagucggaacaaccggcuccaacaaaucccuacagucagccggcuuccccaccggccuaaccuacagccaauuaaugacacuaaaagacuccaugaugcaacuagaccccagcgccaaaacauggaucgacauagaaggcagaccagaagaccccgucgaaaucgcccucuaccaacccauguccggcuguuacauacacuucuuccgcgaaccaaccgaccuaaaacaauucaaacaagacgcaaaauacagccacggaaucgaugugaccgaccucuuccccgcacaacccggacucaccuccgccgugaucgaagcccucccacgcaacaugguccugaccugccaaggcagcgaagacaucaaacgccuccuugacucgcaaggccgacgagacauaaaacuuaucgacaucgcucuauccaaagccgacucgcgucgauucgagaacgccguaugggaccaaugcaaagaccucugccacaugcacaccggcgugguagucgaaaagaagaaacgcggaggcaaagaagaaauaacaccacauugcgcacuaauggacugcauuauguacgacgccgccgugagcggcggccucaacaucccaguacuucgcgcaguccucccuagagacaugguauuccgaaccuccagccccaaaguaguacuauaa

SEQ ID NO: 3335 - RNA, 1710 nt, Artificial Sequence
  derived and/or modified CDS sequence (opt11) from Lassa virus__AIT17671__NP
augucggcauccaaagaaguaaaaucauuccuauggacccaaucgcucagacgugaacuauccggcuacugcuccucaaucaaacuccaagucgucaaagacgcccaagcccuccuccacggucuagacuucuccgaagucuccaacguacaacgccuaaugcgaaaacaaaaacgagacgacuccgaccucaaacgacuccgagaccuaaaccaagcagucaacaaccucguugaacuaaaauccacccaacaaaaguccguccucagagucggcacacucacauccgacgaccuacucacacuagcagcggaccuagaaaaacucaaaagcaaggucauacgcaccgagagaccacucuccuccggcgucuacaugggaaaucucucgacucaacagcuagaacaacgacgcgcccuccuaaacaugauaggcaugguaggcggagcgcaaggaacccaacccggcagagacggcgucguccgaguaugggacguuaaaaaucccgaucuccugaacaaccaguucggcaccaugcccucgcuaacccuagccugccuaacaaaacaaggucaaguggaccugaacgacgucguccucgcccucaccgaccucggccucaucuacacagccaaauaucccaacagcucggacuuagaccgacucucacaaucccacccaauccucaacauggucgacacaaagaaauccagccucaacauauccggcuacaacuucucccuaggagccgccgucaaagcaggagcuugcaugcucgacggcggcaauaugcuagaaacaaucaaaguuaccccacaaaccauggacggcauccucaaauccauccucaaaguaaagaaaucauuagguauguucgucagcgacacacccggcgagcgaaaccccuacgaaaacauccucuacaaaaucugccugucuggcgacggauggccauacauagccucccgcaccucaaucguaggccgagccugggaaaacaccaccgucgaccuggaauccgacggcaaaccacaaaaaguuggaacagccggcagcaacaaaagccuccaauccgccggcuuccccacaggccuaaccuacagccaacuaaugacacucaaagacuccaugaugcaacucgacccgagcgccaaaaccuggaucgacauagaaggcagacccgaagacccagucgaaauagcccucuaccaaccuaugagugguugcuacauacacuuuuuccgcgagccgaccgacuugaaacaauucaaacaagacgcgaaauacucacauggcauagacgugaccgaccuguuccccgcucaacccggucucacauccgccgucaucgaagcccuuccccgaaacaugguacugacaugccaaggcagugacgacauaaaacggcuccuagacucacaaggacgccgagacaucaaacucaucgacauugcacucucaaaagcugacucacgacgauucgaaaacgccgucugggaccagugcaaagaccucugccacaugcacacuggaguagucguugaaaagaaaaagcgaggaggcaaagaagaaaucacaccucacugugcccucauggacugcaucauguacgacgcagcaguauccggcggcuugaacaucccuguccugcgcgccguccucccccgcgacauggucuucagaaccucuucuccaaaaguaguccuauaa

SEQ ID NO: 3336 - RNA, 1710 nt, Artificial Sequence
  derived and/or modified CDS sequence (opt11) from Lassa virus__AIT17675__NP
auguccgcauccaaagaaguaaaaucauuccucuggacccaaucccuccgacgagaacucuccggcuacuguucaagcaucaaacuucaaguagucaaggacgcccaagcacuccuccacggccucgauuucuccgaagucuccaacguacaacgccucaugcgcaaacaaaaacgagacgacucagaccucaaacgauuacgcgaccucaaccaagcaguaaacaaccuagucgaacucaaaaguacacaacagaaaagcguccuccgcgucggaacacugaccagcgacgaccuacucacccucgccgccgaccuagagaaacucaaauccaaaguaaucagaacagaacgcccauugagcuccgggguguacauggggaaccucuccacacaacaacuagaacaacgacgagcccuacucaacaugauaggaauggucggcggcgcacaaggaacccaacccggacgcgacggcguaguaagagucugggacgugaaaaacccagaccuguuaaacaaccaauucggcaccaugcccucacucacucuggcaugccuaaccaaacaaggccaagucgaccucaacgacgccguccuagcccuaacugacuuaggccuaaucuacacggccaaguacccaaacuccucagaccucgaccggcuaucccaaucucacccaauacucaacauggucgacaccaagaaaucaucccucaacaucucaggauacaacuucucucucggcgccgccguaaaagccggcgcauguaugcucgacggcggaaacaugcuagagaccauuaaaguaacgccccaaacgauggacgguauccucaaauccauacuaaaagucaagaaaagccucggcauguucgugagcgacacaccaggcgagcgaaaccccuacgagaacauccucuacaaaauaugccuauccggcgacggauggcccuacaucgcuucccgcaccuccauuguagggcgcgcuugggaaaacaccaucgucgaccuagaaagcgacggcaaaccucaaaaagucggaaccgcaggcuccaacaaaucccuccaaucagcuggauuccccaccggccuuacauacucacaacuuaugacccucaaagacagcaugaugcaacucgaucccagcgccaaaacguggauagacaucgaaggacgcccagaagaccccguagagauagcacuuuaccaaccaauguccgguugcuacauccacuuuuuccgagaaccaaccgaccuuaaacaauucaaacaagacgcaaaauacucccacggcaucgacguagcagaccucuucccagcccaacccggacucaccagcgcagucaucgaagcccuacccagaaacaugguacuuaccugccaaggcagcgacgacauaaagcgacuccuugacucacaaggcagacgagacaucaaacucauagacaucgcacuaucaaaagccgacagccgcagauucgaaaacgccgucugggaccaaugcaaagaccuuugccacaugcauaccggaguugucgucgaaaagaagaaacgaggagguaaagaagaaaucaccccacacugcgcccuaauggacugcaucauguacgacgccgccgucagcggcgggcucaacaucccaguccuacgcgccguccucccccgggacauggucuuccgcaccuccucuccaaaagucguccuauaa

SEQ ID NO: 3337 - RNA, 1710 nt, Artificial Sequence
  derived and/or modified CDS sequence (opt11) from Lassa virus__AIT17679__NP
augucggcaagcaaagaagucaaauccuuccucuggacccaaucuuuacgacgcgaacucuccggcuacugcuccucaaucaaacuacaaguaguaaaagacgcccaggcccuacuccacgggcuggacuucuccgaaguaucaaacgugcaacgccugaugcgcaaacaaaaacgugacgacuccgaccuaaaaagacuccgugaccugaaccaagccgucaacaaucucgucgaacucaaaucaacccaacaaaaaucaauccuccgcguaggaacccucaccagcgacgaucuacucacacuagcagccgaccuagaaaaacuaaaauccaaagucauacgcacagaaaggccccucuccuccggcgucuacaugggcaaccucucgacccaacaacucgaacaacgacgagcccuacuaaacaugaucggcauggucggcggcgcacaauccacacaacccggacgcgacggcgucguccgaguaugggacgucaaaaacccugaccuccuaaacaaccaauucggcaccaugcccucccucacccuugccugccucacaaaacaaggccaaguagaccucaacgaugccguccucgccuuaacggaccucggccuaaucuacacugcaaaauacccaaacucauccgaccucgaccgucuaucccaaagccacccaauccucaacauggucgacaccaagaaauccagccucaacauaaguggcuacaacuucuccuugggcgccgccgucaaagccggugcgugcaugcucgacggaggcaacaugcucgaaacuaucaaaguaacaccccagaccauggacggaauccucaaauccauccucaaagucaaacgaucacucggcauguucguguccgacacccccggcgaacgaaaccccuacgaaaacauacuauacaaaaucugccucuccggcgacggauggcccuacauugccucccgcaccuccauagucggucgcgccugggaaaacacaaccgucgaccucgaauccgacggcaaaccacaaaaagucggcacagccggcagcaacaaaucacuacaauccgccggguuccccacuggccuaaccuacucgcagcucaugacccuuaaagacuccaugaugcaacucgaucccagcgccaaaacauggaucgacaucgaaggccgccccgaagaccccguagaaaucgcccucuaccaacccaugucaggaugcuacauccacuucuuccgggaacccaccgaccuaaaacaauucaaacaagacgcaaaauacagccacggcaucgacguagcagaccuauucccagcccaaccuggacuuacauccgccguaaucgaagcacuccccagaaacauggucuuaaccugccaaggaucagacgacauaaaacgacuccuagacucucaaggccgacgagacaucaaacugaucgacauagcccucagcaaagccgauagcagaagauucgaaaacgcagucugggaccaauguaaagaccuaugccacaugcacaccggagucguaguugagaaaaagaaacgcggcggcaaagaagaaauuacaccccacugcgcccuaauggacugcaucauguacgacgccgccgucagcggaggacucaacaucccaguccuacgcgccguccugccaagagacaugguauuccggaccucaucgcccaaaguagugcucuaa

SEQ ID NO: 3338 - RNA, 1710 nt, Artificial Sequence
  derived and/or modified CDS sequence (opt11) from Lassa virus__AIT17683__NP
auguccgcauccaaagaagucaaaucauuccuauggacccaaagccuccgccgagaacucuccggcuacugcagcaacaucaaacuccaagucgucaaagacgcccaggcacuccuccacggccuagacuucucagaagucagcaacguccaacgccuuaugcgaaaacaaaagcgcgacgacucagaccucaaacgccugcgcgaccuaaaccaagcagucaacaaccucgucgaacucaaguccacacaacagaaaagcauccugcgcgucggcaccuuaacauccgacgaccuccucacacucgccgcagaccuagaaaaacuaaaaaguaaagucauccgaaccgagcgaccacuauccagcggcguguacaugggaaaccucucaacacagcaacucgaacaacggcgcgcacuccuuaacaugauaggcaugguagguggcgcacaaggcacccaacccggccgagacgggguggucagaguuugggacgucaaaaacccugaccuccucaacaaccaguucggaacgaugccaucucuaacacuagcaugccuaacaaaacagggacaaguagaccucaacgacgccguacucgcacuaaccgaccuaggacucauauacaccgccaaauaccccaacuccuccgaccuagacaggcucagccaaucccacccaauccugaacauggucgacaccaagaaauccucacugaacaucuccggauucaacuucagucucggagcagccgucaaagccggagccugcaugcuagacggcggaaacaugcuagagaccaucaaaguaacaccccaaaccauggacggaauccucaaauccauucucaaagucaagaaaagccucggcauguuuguaagcgacacucccggcgaacgcaaucccuacgaaaacauccucuacaaaauaugucucagcggagacggcuggcccuacaucgccucacguacauccauuguuggccgcgcaugggagaacaccaccgucgaccucgaguccgacggcaaaccccaaaaagugggcaccgcaggcaguaacaaaucccuccagagcgcuggauucccuaccggccucaccuacucacagcucaugacacucaaagacagcaugaugcaacucgaccccuccgccaaaacuuggaucgacauagaaggccgccccgaagacccaguagaaaucgcccuauaccagccaaugucaggaugcuacauacacuucuuccgagaacccacagaccuaaaacaauucaaacaagacgccaaauauucccacggcauugacgucgcagaccuauucccggcacaacccggccuaacaagcgcuguaaucgaggcccucccacggaacaugguccugaccugccaaggguccgacgacaucaaacgccuccucgacucacaaggccgccgagacaucaaacucaucgacaucgcccuaucaaaggcagacagccgccguuucgaaaacgcagugugggaccaaugcaaggaccucugccacaugcacaccggagucgucguagaaaagaagaaacgaggaggaaaagaagaaauaaccccacacugcgcccucauggacugcaucauguacgacgccgccguauccggcggccucaacauaccaguacuccgcgccguacuaccgagagacauggucuucagaaccucauccccuaaagucguccuguaa

SEQ ID NO: 3339 - RNA, 1710 nt, Artificial Sequence
  derived and/or modified CDS sequence (opt11) from Lassa virus__AIT17687__NP
augagcgcaagcaaagaagucaaauccuuccuauggacccaaucacuacgaagagaacuaagcggauacugcucguccauaaaacuacaagucgucaaagaugcccaagcccuacuccacggacucgacuucucggaggucucaaacguccaacgacucaugcgcaaacaaaaacgagaugacucagaccucaaacgccuccgagaccuuaaccaagccguuaacaaccuagucgaauuaaaaagcacacaacaaaaaucaauacuacgcgucggcacccucaccucggacgaccuucuaacacucgccgccgaccuggaaaaacucaagucaaaaguaauccgcacagaacgcccccuauccuccggcguauacauggguaaucucagcgcacaacaacucgaacaacgacgcgcccuccucaacaugaucggcauggucggcggcgcccaaggcacacagcccggccgagacggcgucguccgcguuugggaugucaaaaaccccgaccuccucaacaaccaauucggcaccaugccaucacugacccuggccugucuaacuaaacaaggacaagucgaccucaacgacgcaguacucgcccucaccgaccuaggacucauauacaccgcgaaauaccccaacagcuccgaccucgaccgacugagccaaagccaccccauacucaacauggucgacacaaagaaaucaucacucaacaucuccggauacaacuucagccuaggagcagccgucaaagcaggcgcaugcaugcuugacggcggcaacaugcuggaaaccauaaaaguuaccccacagaccauggacggcauccucaaaucaauccucaaaguuaaacgcucacuaggcauguuugucuccgacaccccaggcgaacgcaaccccuacgaaaacaucuuauacaaaauaugccuaucaggcgacggauggccuuacaucgcaucacgaacuucaaucgucggacgcgcgugggaaaacacuaccgucgaucucgaaucagauggcaaaccacaaaaagucggcacagccggcuccaacaaaucccuccaauccgcaggcuuccccaccggccuaaccuacucacaacucaugacacucaaagacucaaugaugcaacucgaccccuccgcaaaaaccuggaucgacaucgaaggcagacccgaagacccagucgaaaucgcauuauaccaacccauguccggcugcuacauacacuucuuccgugaacccacagaccucaaacaauucaaacaagacgccaaauacagccacggcauagacguagccgaccuuuuucccgcccaacccggacucaccuccgcagucauagaggcccugccccggaacaugguccucacaugccaaggaucggacgacauaaaaagacuacuagacucacaaggccgccgugacaucaaacuuaucgacauagcacuauccaaagcagacucacgacgauucgaaaacgccgucugggaccaaugcaaagaccuaugucacaugcacaccggggucgucguagaaaagaagaaacgcggcggcaaagaagaaauaaccccacacugcgcccucauggacugcaucauguacgacgccgccguaagcggcggacucaacauccccguacuacgcgccgugcucccccgugacauggucuuccgcaccagcucccccaaaguaguacucuga

SEQ ID NO: 3340 - RNA, 1710 nt, Artificial Sequence
  derived and/or modified CDS sequence (opt11) from Lassa virus__AIT17695__NP
auguccgccagcaaagaagucaaaucauuccuguggacccaaagccuccgccgagaacuaucuggcuacugcagcaacaucaaacuccaaguagucaaagacgcacaagcccuacuccacggccucgacuucuccgaagucucaaacguccaacgccuaaugcgcaaacagaagcgagacgacucagaccugaagcgccuacgggaccucaaccaagcagucaauaaccucgucgaacuaaaauccacccaacagaaaagcauacuacgagucggaacacucaccucggacgaccuacuaacccucgcugcagaccuagaaaagcuaaaaagcaaagucauccgcacggaaagaccccucucaucgggcgucuacaugggcaaccucucgacucaacaacuagaacaaagacgagcccuccucaaccuuaucgguaugguaggcggcgcacaaggcacacaaccaggccgagacggcguaguccgcguaugggacgucaaaaaccccgaccuacuuaacaaccaauucggaacgaugccaagccucacucucgccugccuaaccaaacaaggacaagucgaccucaacgacgucguccucgcccucaccgaccucggccucaucuacacggcaaaauacccaaacucgucagaucuagaccgacuaagccaaagccaccccauccucaacaugguagauacaaagaaaaguucccucaacaucucagguuucaacuucagccucggcgcagcugucaaagccggugcaugcaugcuagauggcggcaacaugcuggaaaccaucaaagucacaccccacaccauggacggcauacucaaauccauccuaaaagucaagaaauccuuaggaauguucgucucagacacacccggcgaacgcaacccguacgaaaacauacucuacaaaaucugccuuagcggcgacggcuggccauacauagcuucacguaccaguauagucggccgcgccugggaaaacacuaccgucgaccuagaaagcgacggcaaaccccacaaagucggaaccgccggcuccaacaaaucccuacaaagcgccggauuccccacgggccucaccuacucacaacuuaugacacucaaagacucaaugaugcaacuugacccaucggccaaaacauggauagacauagagggacggccagaagaccccgucgaaauugcccucuaccaacccaugucaggaugcuacauccacuucuuccgcgaacccacagaccuaaaacaauucaaacaagacgcaaaauauagccacggcauagacgucgcagaccucuuccccgcacaacccggccuaacaagcgccgucauagaggcacugccacgcaacaugguccuuaccugccaaggcucggacgacaucaaaagacucuuagacucacaaggucggcgcgacaucaaacucaucgauaucgcccucuccaaagccgacucccgccgauucgaaaacgccgucugggaccagugcaaagaccucugccacaugcacacaggagucguugucgagaaaaagaaacgcggcggcaaagaagaaauaacaccccacugcgcccucauggacugcaucauguacgacgcugccguuuccggaggacucaauauccccguacuacgcgccguccucccccgagacauggucuuccgcaccucaagcccaaaagucguccucuaa

SEQ ID NO: 3341 - RNA, 1710 nt, Artificial Sequence
  derived and/or modified CDS sequence (opt11) from Lassa virus__AIT17705__NP
augagcgccuccaaagaaguaaaauccuuccucuggacccagucccuacgccgagaacucagcggcuacugcuccaacauaaaacuccaaguugucaaagacgcacaagcacuccuccacggccucgacuucuccgaaguuucaaacguccaacgccucaugaggaaacagaaacgggacgacucagaccuuaaacgacuacgcgaccuaaaccaagccgucaacaaccucguugaacugaaauccacccaacagaaauccauccuccgcgugggcacgcucacauccgacgaccuccuaacccucgccgcugaccuagaaaaacucaaauccaaaguaaucagaacagaacgcccccuuuccuccggcgucuacaugggcaaccuauccacccaacaacuagaacaacgucgcgcccuacucaaccuuaucggcaugguaggcggcgcucaaggcacacagcccgggcgcgacggcgucguucgagucugggacgucaaaaaccccgaccuauuaaacaaccaauucggcaccaugcccucccucacccucgccugccucacaaaacaagggcaaguagaccuaaacgacgccgucuuagcccucaccgaccucggccucauauacaccgccaaauacccaaacucaagcgaccuugaccgacucucccaaucccacccaauccucaacauggucgacaccaaaaaguccucacuaaacauaucaggcuucaacuuuucacucggggccgccgucaaagccggcgcuuguaugcucgacggaggaaacaugcucgaaacuaucaaagucacaccccaaaccauggacggcauccucaaaucuauccuaaaagucaagaaaagccucggcauguucguauccgacacccccggagaacguaaccccuacgaaaacauccucuacaaaaucugccuaucaggcgacggcuggcccuacaucgccucacgaaccuccauaguaggacgagccugggaaaacaccaccgucgaccuugaauccgacggaaaaccccacaaagucggcacagccggcuccaaccgaucacuccagagcgcaggcuucccaaccggccucaccuacucccaacucaugacauugaaagacagcaugaugcaacucgaccccagcgccaaaaccuggaucgacaucgaaggccggccugaagaccccguagaaauugcacucuaucagccaauguccggcugcuauauccacuucuuucgugaaccaacagaccucaagcaauucaaacaggacgccaaauacucccacggaauagacguagcagaccucuuccccgcccaaccaggacucaccuccgcaguaaucgaagccuuaccacgaaacaugguccuuaccugccaaggcuccgacgacauaaaaagacuccucgacucccaagggcgacgcgacaucaaacucauagacaucgcccuuagcaaagccgacucgcgccgcuucgaaaacgccgucugggaccaaugcaaagaccuaugccacaugcauaccggcguaguagucgagaaaaagaaaagaggaggcaaagaagaaaucacgccccacugcgcgcucauggacugcaucauguacgacgcugccgucuccgguggucuaaacauacccgugcuccgcgccguccucccccgggacaugguuuuccgcaccuccagccccaaaguaguacucuaa

SEQ ID NO: 3342 - RNA, 1710 nt, Artificial Sequence
  derived and/or modified CDS sequence (opt11) from Lassa virus__AIT17711__NP
auguccgccuccaaagaggucaaaucauuccuguggacccagucacucagacgcgagcuaucaggcuacugcuccaacauuaagcuacaggucgucaaagacgcccaggcccuacuacacggccucgacuucagugaagucagcaacguccaacgccucaugcgcaaacaaaaacgagacgauucagaccucaaacgccuccgcgaccucaaccaagcugucaacaaccuaguagaacugaaauccacacaacaaaaaucaauccuccgcguaggcacgcucaccuccgacgaccuucuuacacucgccgcagaucuagaaaaacucaaaagcaaagucauccgcacagaaagaccacucuccagcggcguauauaugggaaaccucuccacccaacaacucgaacagcgacgcgcccugcuuaaccuaaucggcaugguaggcggugcacaaggcacacaacccggccgcgacggagucguucgcgucugggacgucaaaaacccagaccuacucaacaaccaauucggcaccaugcccucccugacccucgccugccucacaaagcagggacaagucgaccuuaaugacgcaguccuagcccucaccgaccucggacucauauacaccgccaaauaucccaacuccucagaccuugacagacuaucccagucccacccaauccucaacaugguugacaccaagaaauccagccucaacaucuccggauucaacuucucgcuaggcgccgccgucaaagcaggagcuugcaugcucgacgggggcaacaugcucgaaaccauaaaagucaccccacaaaccauggacggaaucuuaaaaucaauccucaaagucaagaaaucccucggaauguuugucucagauacccccggagaacgcaacccauacgaaaacauccucuacaaaaucugccucuccggcgacggcuggcccuacauagccucccgcaccuccauaguaggccgagccugggaaaauaccaccguagaccuugaauccgacggcaaaccccacaaaguaggcaccgcaggcucaucaaaaucgcuccaaucagcaggauucccaaccggccucaccuauucccaacuuaugacacucaaagacuccaugaugcaacuagacccaucagcaaaaaccuggaucgauauagaaggccggcccgaggaccccgucgaaaucgcacucuaccaacccauguccggcugcuacauccacuucuuucgagaacccaccgaucucaaacaauucaaacaagacgcaaaauauagccauggcauagacgucgccgaccuguucccggcccaacccggacuaaccucggccguuaucgaagcccuaccccgaaacaugguccucacaugccaaggcagcgaugacauaaaacggcuccucgacucacaaggaagacgcgacauaaagcuaauagacauagcacucucaaaggccgacucccgccgcuucgaaaacgccguaugggaccagugcaaagaccuaugccacaugcauacaggcgucgucguagaaaagaagaaacgcggcggcaaagaggaaauaaccccacacugugcacuaauggacugcauaauguacgacgcagcugucucaggaggacucaacauccccguacuacgcgccguccuccccagagacaugguuuuccguaccuccagcccaaaagucguccucuaa

SEQ ID NO: 3343 - RNA, 1710 nt, Artificial Sequence
  derived and/or modified CDS sequence (opt11) from Lassa virus__AIT17713__NP
augagcgccagcaaagaaguuaaaucauuccuuuggacccaaucccuccgacgcgaacuauccggcuacugcagcaauaucaaacuacaagucgucaaagacgcucaggcccuccuccacgggcucgacuucuccgaagucucuaacguccaacgccucaugcgcaaacaaaaacgcgacgacucagaccucaaacgacuccgcgaccuaaaccaagcugucaauaaccucgucgaacugaaaucaacccagcagaaaagcauacugcgcgucggcacacucaccucggacgaccuacucacacuugcagccgaccucgaaaaacucaaauccaaaguaauccgaaccgaaagaccacuaucauccggcgucuacaugggcaaccuuucuacccaacaacucgagcaacgccgggcacuccucaacaugaucggaauggucggcggagcccaaggaacgcaaccagggcgagacggaguaguccggguaugggacgucaaaaacccagaucuccuaaacaaccaauucggcacaaugcccucccucacacucgccugccuaaccaaacaaggccaaguagaccuaaacgacgcaguacuagcacucaccgaccuggggcucaucuacaccgccaaguacccaaacagcucagaccuagaccgccuaucccaaagccacccaauccuaaacauggucgacaucaagaaaagcucacucaacaucuccggauacaacuucucacucggggccgccgucaaagccggcgcaugcauguuagacggcggaaacaugcucgaaaccauaaaggucacgccccaaaccauggacggaauccuuaaauccauccucaaagucaaaaagucacucggcauguucgucuccgacacccccggggaacgaaaucccuacgaaaacauacucuacaaaauaugucuauccggagaugguuggcccuacaucgccucccgcaccuccauaguaggccgcgcaugggaaaacaccacagucgaccucgaauccgacggcaaaccccaaaaggugggcaccgccggaucaaacaaaagucugcaaucugccggauucccaacagggcuaacuuacucccaacugaugacacuaaaagauuccaugaugcaacucgacccaucugcgaaaacguggauagacaucgaaggccgaccagaagaccccguagaaaucgcccuauaccaaccaaugucagguugcuacauacacuucuuccgagaaccaacagaccucaaacaauuuaagcaagacgccaaauacucccacggaauagacgucgccgaccuauucccagcacaacccggccuaacaucagcaguaauagaagcacuaccccgcaacaugguccuaaccugccaaggcuccgacgacauaaaacgacuccucgacucgcaaggccgaagggacaucaaacucauagacaucgcccucaacaaagccgacucacgcagauucgaaaacgccgucugggaccaaugcaaggaccugugccacaugcacacuggcgucguagucgagaaaaagaaaaggggaggaaaagaggaaauuacaccccacugcgcacucauggacugcaucauguacgacgcggcggucuccggcggccuaaauauucccguccuccgcgcaguccuacccagagacaugguauuccgcaccuccaguccaaaaguaguacuauaa

SEQ ID NO: 3344 - RNA, 1710 nt, Artificial Sequence
  derived and/or modified CDS sequence (opt11) from Lassa virus__AIT17719__NP
auguccgccaguaaagaagucaaaucauuccuguggacccaaagccucaggcgcgaacucuccggcuacugcuccagcauaaaacuacaaguagucaaagacgcccaagcccuccuccacggccucgacuuuuccgagguuagcaacguccaaagacuaaugcgcaaacaaaaacgcgaugacucagacuuaaaaagacuccgcgaccuaaaccaagccguaaacaaccucgucgaacuaaaaucaacacaacaaaaauccauacucagagucggcacucucacauccgacgaccuacucacccucgcagccgaccuagaaaaacugaaauccaaagucauacgcaccgaacgcccacuauccucaggagucuacaugggaaaccucuccacccaacaacucgaacaacgccgcgcccuccucaauaugaucggcaugguauccggcgcacaaggcacccaaccuggccgugacggcgucguccgagucugggacgucaaaaaucccgaacuucucaauaaccaauucggaacaaugcccucacuuacacucgccugccucaccaaacaaggccaaguugaccucaacgacgccguacuagcccucacagaccuaggcuuaauauacaccgcgaaauacccaaacagcuccgaccucgaccgccucucccagucccaccccauccuuaacauggucgacaccaagaaaagcucucucaauaucagcggcuacaacuucucacucggagccgccgucaaagcuggcgcaugcaugcucgacggaggcaacaugcucgaaaccaucaaagucaccccacaaaccauggacggaauccuaaaaagcauacucaaaguuaagaaaucccucggcauguucguaagcgacacacccggagaaagaaaucccuacgaaaacauccucuacaaaaucugucucaguggcgacggcuggcccuacauagcaucccgcaccuccaucgucggccgagccugggaaaacaccaccgucgaucuggaaagcgacggaaaaccacaaaaagucggaacugccggaucaaacaaaucccugcagagcgccggauucccaacaggacuaaccuacucccaacucaugacccuaaaagacucuaugaugcaacuagaccccagcgcuaaaaccuggauagacaucgaaggacgcccagaagacccaguagaaaucgcccucuaccaaccaaugagcggcugcuacauccacuucuuccgagaaccaaccgaccugaaacaauucaagcaggacgcaaaauacucccacggaaucgacguagcagaccucuucccggcacaacccggacuaacaucagccgugaucgaagcccuaccgcgcaacaugguacucacaugccagggcuccgacgacaucaaacgccuccucgacucccaaggccggcgcgacaucaaacuaauagauaucucccucucaaaagccgacuccagacgcuucgaaaacgcagucugggaccagugcaaagaccucugccacaugcacaccggcguaguagucgaaaagaagaaacgcggcgggaaagaggaaauaaccccacacugcgcccuuauggacugcaucauguaugacgccgcagucuccggcggccuaaacauccccguucuacgagccguacuacccagagacaugguauucagaaccagcucaccaaaaguaguccuuuaa

SEQ ID NO: 3345 - RNA, 1710 nt, Artificial Sequence
  derived and/or modified CDS sequence (opt11) from Lassa virus__AIT17725__NP
augucagcuucaaaagaagucaaaucauuccuauggacccaaagccuccgccgcgagcucuccggcuacugcuccaacauaaaacuccaggucgucaaagaugcccaagcccuccuccacggccucgacuucuccgagguaagcaacguacaaagacuaaugagaaaacagaaacgagacgacuccgaccucaaacgucuccgagaccucaaccaggccguaaacaauuuagucgaacuaaaauccacccaacaaaaauccauccuacgcguuggaacacucacaagcgaugaccuccuaacacucgccgcugaccucgaaaaacucaaaucaaaagucauacgcaccgaacgcccacucagcuccggcguuuacaugggaaaccucagcgcacaacaacuagaacagcgacgcgcacugcuuaacaugaucgggauggucggcggagcccagggaacccaacuaggacgcgacgguguagugcgcgugugggacgugaaaaacccagaccuacuuaacaaccaauucggcaccaugccaagccucacccuggccugccucaccaaacaaggccaaguagaccucaacgacgcagugcuagcccucaccgaccucggccucaucuacaccgcaaaauaccccaacagcagcgaccucgaccgccucucacaaucccacccaauauuaaacaugguagacaccaagaaauccucucuuaacauaagcggcuacaacuuuucccugggcgccgcuguaaaagccggcgccugcaugcucgacggcggcaacaugcucgagaccaucaaaguaacaccccaaaccauggacggcauccuaaaauccauccuaaaaguaaagaaaucacucggaauguucgucuccgacaccccgggagaacgcaacccauacgaaaacauucuguacaaaauaugccuauccggcgacggcuggccauacaucgcaucacgaaccucaaucgucggccgggccugggagaacaccaccguagaccucgaauccgacggaaaaccccaaaaagucggcaccgcagguuccaacaaaucacuccaaucagcaggauuccccaccggucuaaccuacucacaacuuaugacccuaaaagacagcaugaugcaacucgaccccagcgccaaaacauggaucgacauagaaggaagaccggaagaccccgucgaaaucgcguuauaccaaccaaugagcggaugcuacauccacuuuuucagagaacccacugaucuaaaacaauucaagcaagacgcaaaauacucccacggcaucgacgucgcagaccucuuccccgcacaacccggccucacaucagcagucauagaagcccucccacgcaacauggucuuaaccugccaaggcuccgaagacauuaaaagacuccucgacucacaaggacgccgugauaucaaacucaucgacauagcccucuccaaagcugacucccgcagauucgaaaacgccgucugggaccaaugcaaagaccucugccacaugcacaccggaguugucguagagaaaaagaaaagaggugguaaagaagaaauuacaccccacugcgcacuuauggacugcauaauguacgacgccgcaguaagcggcggacucaacauccccguccuccgugcaguccucccccgcgacauggucuuccgaaccucaagucccaaaguagucuuauaa

SEQ ID NO: 3346 - RNA, 1710 nt, Artificial Sequence
  derived and/or modified CDS sequence (opt11) from Lassa virus__AIT17729__NP
augucagcguccaaagaggucaaauccuuccucuggacccaaagccuaagacgagaacuaagcggcuacugcucguccauaaaacuacaaguagucaaagacgcacaagcacuacuacacggucuagacuucagcgagguaagcaacguacaaagacucaugcgcaaacagcgacgcgacgauuccgaccucaaacgccuccgcgaccugaaccaagccgucaacaaccucgucgaacuaaaguccacucaacaaaaaucuauccuacgcguaggcacccucaccuccgacgaccuccucacccucgccgcugaccucgaaaaacuaaaauccaaaguaauaagaacagagcgcccccuaucaagcggcgucuacauggguaaccuuucaacccaacaacucgaacagagacgagcacuccuaaauaugaucggaaugguaggcggcacacaaggcacgcaacccggaagagacgggguaguaagagucugggacgucaaaaaucccgaccuccucaauaaccaauucggaacaaugccaagccugacccucgcaugccucaccaaacaaggccaagucgaccucaacgacgcaguccuggcacucaccgaucugggccucauauacaccgcaaaauaccccaacagcuccgaccuugaccgacucucacaaucgcaccccauccuaaacauggucgacaccaagaaaucaagccucaacaucagcggcuacaacuucucccuaggcgccgccguaaaagccggugcaugcaugcucgacggcggaaauaugcucgaaaccaucaaaguaacaccacaaaccauggacggcauacuaaaaagcauccucaaagucaaacggucgcugggcauguucgucagcgacacacccggagaaagaaaccccuacgaaaacauacucuacaaaaucugccucucaggcgacggauggccauacaucgcaagccgaacaagcaucgucggcagagcaugggaaaacacgacagucgaccucgaaagcgacgggaaaccccaaaaagucggaacugcaggguccaacaaaucacuccaaucagcaggcuuccccacaggccucaccuacucccaacugaugacccucaaagauagcaugaugcaacucgaccccuccgccaaaacuuggaucgacaucgagggaagaccagaggaccccgucgaaaucgcacuauaccaaccaaugucaggaugcuacauccacuucuuccgcgaacccaccgaccucaaacaauucaaacaagacgcaaaauacagccacggcauagacguagcggaucuauucccggcccaacccggccucaccuccgcaguaauagaagccuuacccagaaacaugguccuaacuugccaaggaucagacgacaucaaaagacuacucgacucacaaggcaggcgcgacaucaaacucauagauaucgcccuguccaaagccgacucacgaaaauucgaaaacgccgucugggaccaaugcaaagaccucugccacaugcauaccggcgucgucgucgaaaagaagaaacguggcggcaaagaggaaauaaccccacacugcgcccucauggacugcauaauguacgacgccgccgucucgggcgggcucaacauacccguccuccgcgccguacucccacgagacaugguauuccgaacaucaagcccgaaaguaguacucuaa

SEQ ID NO: 3347 - RNA, 1710 nt, Artificial Sequence
  derived and/or modified CDS sequence (opt11) from Lassa virus__AIT17733__NP
augagcgcauccaaagaaguaaaaucguuccucuggacccaaagccuucgccgcgagcugucaggauacugcuccaacaucaaacuccaagucguaaaggacgcacaagcccuccuccauggacuugacuucagcgagguauccaacguccaacgauuaaugagaaagcagaaaagagacgacuccgaccuaaaacgacuccgcgaccucaaccaagcagucaacaaucucgucgaacucaaaagcacgcaacaaaaauccauccuccgcguuggaacccucaccagcgacgaccuccucauccuugccgcagaccuagaaaagcucaagucaaaaguaauccgcaccgaacguccccucagcucagggguauacaugggaaaucucagcacacaacaacuagaacaacgacgagcccuccucaacaugaucggcaugguaggcggcgcucaaggcacccagcccggccgggacggaguugucagagucugggaugucaaaaauccggaccuacuaaacaaccaauucggcacaaugcccucgcuaacacuagccugccugacaaaacaaggccaaguagaucuaaacgacgcaguccucgcccucacugaccucggccucaucuacacagcaaaauaccccaacucgagcgaccuagaccgacucucccaaucacaccccauccugaacauggucgacacuaagaaauccuccuuaaacaucuccggcuacaacuucucacucggagccgccgucaaagcaggagccugcaugcucgacggcggcaacaugcuagaaaccaucaaagucacaccccaaaccauggacggcauccucaaaucaauacuaaaaguaaagaaaagccucggcauguucgucuccgacacccccggcgaaaggaaccccuacgaaaacauccuauacaaaaucugccuauccggcgacggcuggccauacauagccucccgaaccuccauugucggccgagccugggaaaauaccaccgucgaccucgaaagcgacggcaaaccccaaaaagucggcacugccggauccaacaaaagccuccaaagcgccggcuucccaacugggcuaaccuacucccaacucaugacucuaaaagacuccaugaugcaacuagacccauccgccaaaacauggaucgacaucgaaggccgccccgaagaccccgucgaaauagcccuauaccaaccaauguccggcugcuacauccacuucuuccgcgaaccaaccgaccuaaaacaauuuaagcaagacgcaaaauacagccacggcaucgacgucgccgaccucuucccggcacaaccaggccuuaccucagcaguuauagaggcacuaccaagaaacauggucuuaaccugccaaggaagcgacgacaucaaacgccuacuagacucacaaggccgccgcgacauaaaacugauagacaucgcccucuccaaagccgacuccagacgauucgaaaacgccgucugggaccaaugcaaagaccucugucacaugcacacaggggucguuguagaaaagaagaaacgcgguggcaaagaagaaaucaccccacacugcgcacucauggacugcaucauguaugacgcugccgucucaggcggccucaacauacccgugcuccgagccguccuaccgcgcgauaugguauuucgcaccuccagcccaaaaguaguccucuaa

SEQ ID NO: 3348 - RNA, 1710 nt, Artificial Sequence
  derived and/or modified CDS sequence (opt11) from Lassa virus__AIT17745__NP
augucugccaguaaagaaauuaaaucuuuccuuuggacacagucguuacgacgcgaacucagcggauacugcuccagcauaaaacuucaaguaguuaaagacgcccaagcccuccuccacggccucgacuucagcgaaguauccaacguccaacgccucaugcgcaaacaaaaacgcgacgacuccgaccucaaacgccuccgagaccucaaccaagcaguaaacaaccuaguggaacucaaaagcacccaacaaaaguccauccucagagucggcacacuaaccagcgacgaccuccuuacccuagccgcagaccuagaaaaacucaaauccaaaguuauccgcacagaacgcccccuaucuucuggcgucuacaugggcaaccugucaacccagcaacucgaacaacguagagcccugcuaaacaugaucggaauggucggcggcgcccaagggacacaaccgggaagagacggcguuguccgcguaugggacgucaaaaaccccgaccuacucaacaaccaauucggcaccaugccaucacucacacucgcgugccuaacaaaacaaggacaggucgaccucaacgacgccguacucgcacugacagaccucggccuaaucuacacggcuaaauacccaaauagcagcgaccuagaccgccuaagccaaucacaccccauccucaacauggucgacaccaagaaauccagccuaaacaucagcggauauaacuucucccucggcgccgcaguaaaagcaggagcuugcaugcuagacggcggcaacaugcuagaaacaaucaaagucacaccacaaacaauggacgguauacucaaauccauacuaaaaguaaaacgcucacucggcauguucguaucagaugcaccaggagaacgcaaccccuacgaaaacauccucuacaaaaucugccucagcggagacggcuggcccuacaucgcaucccgcaccuccaucgucggccgcgccugggaaaacaccaccguugaucucgaaucagacggcaaaccccaaaaagucggcaccgccggaucaaacaaaucccuccaauccgccggguuccccacuggccucaccuacucacagcucaugacccuaaaagacucaaugaugcaacuagacccgucagcaaaaacauggaucgacaucgagggccgccccgaagacccgguagaaauagcacuauaccaaccaauguccggaugcuacauccacuucuuccgagaacccaccgaccuaaaacaauucaaacaagacgccaaauauagccaugggaucgacgucgcagaccuguuccccgcccaacccggccuaaccuccgccguaaucgaggcucucccaagaaacaugguacuuaccugccaaggcuccgacgacaucaaaagacugcucgacucccaaggucgccgcgacauaaaacucauagacauagcacucuccaaagucgacagccgccgcuucgaaaaugcaguaugggaccaaugcaaagaccucugccacaugcacacgggcguagucgucgaaaagaagaaacgaggcgggaaggaagaaauaaccccacacugcgcccugauggacugcauaauguacgacgccgccgucucaggcggacucaacauucccguccuacgagcaguccucccccgcgauauggucuuccgcaccagcagcccgaaaguaguacucuaa

SEQ ID NO: 3349 - RNA, 1710 nt, Artificial Sequence
  derived and/or modified CDS sequence (opt11) from Lassa virus__AIT17753__NP
augagcgccucuaaagaagucaaaucauuccucuggacccaaagccuacgccgcgaacuaucuggcuacugcagcucaauaaaacuacaagucguaaaagacgcacaagcccuccuccacgggcuggacuucuccgaaguauccaacgugcaacgccuaaugagaaaacaaaaacgcgacgacucagaccucaaacgccuacgcgaucucaaccaagcugucaacaaccucgucgaacuuaaauccacacagcaaaaaucaauccuccgagucggcacccucacaucagacgaccuacuaacacuugcagccgaccucgaaaaacucaaaucgaaaguaauuaggacggagagaccacucucuucuggcgucuacaugggcaaccuauccacacaacaacucgaacaacgacgcgcacuccucaacaugauaggaauggucggcggcgcccaaggaacccaaccaggcagagacggcguuguccgcgucugggaugucaaaaauccggaucuacuaaacaaccaguucggcaccaugcccucgcugacccuugcaugccuaaccaaacaaggccaaguagaccucaacgacgcgguacucgcacugacagaccugggccuaaucuacaccgccaaauaccccaacuccuccgaccuagaccgccugucccaaagccacccaauacuuaauaugguagacaccaagaaaucaucccuaaacauauccggcuacaacuucucacucggcgcagccgucaaagccggcgcaugcaugcuagacggcggcaauaugcucgagaccaucaaagucaccccacaaacuauggaugggauccuaaaaucaauacugaaagucaaacgcucccucgguauguuugucuccgacacccccggggaacgcaaccccuacgaaaacauccuauacaaaauuugccucuccggcgacggauggcccuacauugccagccguaccuccauaguuggccgcgccugggaaaacaccacagucgaucuagaaagcgacggcaaaccacaaaaagucgggacaacaggaucaaacaaaucccuccaauccgcaggcuuccccaccggccucaccuacucccaacucaugacccuaaaagacagcaugaugcagcuagaccccucggccaaaaccuggaucgauaucgaaggccgcccugaagaccccguagaaaucgcccucuaccaacccaugucaggcugcuacauccacuuuuuccgcgaacccacagaccugaaacaauucaaacaagacgcuaaauacucccacggcaucgacgucgccgaccucuucccagcccaaccaggccucaccucggccgugaucgaagcccucccccguaacaugguccuaaccugccaaggcuccgaugacauuaaacgccuccucgacucccagggaagacgagacauaaaacucaucgacaucgcacucucuaaagcugacucccgcagauucgaaaacgccgucugggaccaaugcaaggaccucugccauaugcacaccggcgucgucgucgaaaagaagaaacgcggcggaaaagaagagauuacaccccacugcgcccucauggacugcaucauguacgacgccgccgucuccgggggacucaacaucccaguacuacgcgccguucucccacgagacauggucuuucgcaccuccuccccgaaagucguccucuaa

SEQ ID NO: 3350 - RNA, 1710 nt, Artificial Sequence
  derived and/or modified CDS sequence (opt11) from Lassa virus__AIT17763__NP
auguccgccuccaaagaaguuaagagcuuccucuggacacaaagccuccgacgagaacucagcggcuacugcuccagcaucaaacuccaagucgugaaagacgcacaagcccuccuacacggccucgacuucucugaaguaagcaacguccaacgccucaugcgaaaacaaaaacgcgacgacuccgacuuaaaacggcuacgcgaccucaaccaagcagucaacaaccuagucgaacuuaaaagcacacagcagaaaagcauacuccgcguaggcacgcucaccagcgacgaccugcucacccuagccgcugaccucgaaaaacuaaaaucgaaagucauacgcaccgaacgcccccucuccuccggagucuacaugggcaaccuaucuacccaacagcucgaacaacggcgcgcccuacuaaacaugaucggaauggucggcggcgcacaagguacgcagccaggccgagacggcgucguccgugucugggacgucaaaaaucccgacuuacucaacaaccaauucggaacaaugcccucccucacccuagccugccuuacgaaacaaggacaaguagaucucaacgaugcaguacuagcccucaccgaccuaggccuuaucuacaccgccaaauaccccaacucaucggaccuagacagacucucacaaucacacccaauacuaaacauggucgacaccaagaaaucaucgcugaacaucucaggauacaacuucagccucggcgccgcggucaaagccggcgccugcaugcuagacggcggcaacaugcucgaaacaaucaaaguaaccccacaaacaguagacggcauucucaaaucaauacuaaaagucaaacgcucacuaggaauguucgucagcgacacccccggcgaacgcaaucccuacgagaacauccuguacaaaaucugccucuccggcgacggcuggccauacauagccucgcgcacaucaauuguaggacgagcaugggaaaacacuacagucgaccucgaaucugaugaaaaaccccaaaaaguaggcgccgcaggcuccaacaaaucccugcaauccgccggcuuuccaacuggccucacuuacagccaacucaugacauuaaaagacuccaugaugcaacuagaccccagcgcaaaaaccuggaucgacaucgaaggacgacccgaagaccccguagaaaucgcccuauaccaaccaauguccggaugcuacauacacuucuuccgcgagccaaccgaccucaagcaauucaaacaagacgccaaauauucccauggcaucgacgucaccgaccucuuccccgcccaaccaggccucaccuccgcagucauagaagcacucccccgcaacaugguacuuaccugucaaggcucagacgacaucaagcgacuccuagacucacaaggccgccgggacaucaaacuaaucgacaucgcccucagcaaagcugacagccgcagauucgaaaacgcagucugggaccaaugcaaagaccucugccacaugcacacaggcguaguggucgaaaagaagaaacgcggaggaaaagaagaaaucacaccccacugugcccucauggacugcaucauguacgacgcagccgucucaggcggucuuaacauccccguucuacgcgcgguacuaccacgcgacaugguguuccgcaccucaaguccgaaagucguccucuaa

SEQ ID NO: 3351 - RNA, 1710 nt, Artificial Sequence
  derived and/or modified CDS sequence (opt11) from Lassa virus__AIT17771__NP
augagcgcuucuaaagaaguuaagucauuccucuggacccaaagccuccgacgcgaacucagcggauacuguucauccauaaaacuacaagucgucaaagacgcacaagcccuacuccacggauuagacuucagcgaagucuccaacguccagagacucaugcguaaacaaaagcgcgacgacagcgaccuaaagcgccuacgagaccuaaaccaagccguuaacaaucuaguagaacucaaguccacacaacagaaaagcauccuccgcguaggaacacucacaucagacgaccuccucacacuggccgcagaucucgaaaaacuuaaauccaaagucaucagaaccgaacgcccucuaagcucaggcgucuacaugggcaaccuuuccacccaacaacuagaacaacgccgugcccuccuaaacaugaucggcauggucggcggcgcccaaggcacccaacccggacgagacggcguaguucgagucugggacgucaaaaacccagaccuacuaaacaaccaauucggcaccaugccaagccucacccucgccugccugaccaaacaaggccaaguugaccuaaacgacgccguccucgcccuuaccgaccucggacucaucuacaccgcaaaauacccaaacuccucagaccucgacagacucucccaaucccaccccauacucaacauggucgacacaaagaaauccucacucaacauauccggauacaacuucagcuuaggcgcagccgucaaagccggcgcauguauguuagacggcggcaacaugcucgaaaccaucaaagucacaccccaaaccauggacggaauccucaaauccauccucaaagucaagcgaucccuaggcauguuuguguccgacaccccaggagaaagaaaccccuacgagaauauccucuacaaaauaugucucucaggagacggauggcccuacaucgcaucacgcaccuccaucgucggacgugcaugggaaaacacaaccgucgaccucgaaagcgacggaaaaacacaaaaagucucaacugccggcuccaacaaaucccuccaauccgcaggcuucccaaccggccucaccuacagccaacucaugacacugaaagacucaaugaugcaacuagaccccagcgccaagaccuggaucgacaucgagggucgccccgaggaucccguagaaauagcacuauaccaacccaugucaggcugcuacauccacuucuuccgcgaacccacugaccucaaacaauucaaacaagacgccaaauacagccacggcauugacgucaccgaccucuucccagcccaacccggccucaccuccgccgucaucgaagcccucccgcgcaacaugguccuaaccugccaaggcucagacgacaucaaacgacuccucgacucucaaggccgccgcgacauaaaacucaucgacaucgcccucagcaaagcagacuccagaagauucgaaaacgccguaugggaucaaugcaaagaccuaugccacaugcacacaggcguuguagucgagaaaaagaaacgcggagguaaggaagaaauaacuccacacugcgcccucauggacugcaucauguacgacgcagccgucuccgguggacucaacauccccguacuccgagcaguccuaccacgagacauggucuucagaaccuccucccccaaaguaguccucuaa

SEQ ID NO: 3352 - RNA, 1710 nt, Artificial Sequence
  derived and/or modified CDS sequence (opt11) from Lassa virus__AIT17779__NP
auguccgccagcaaagaggucaagagcuuccuauggacccaaucacuccgccgcgaacucucagguuacugcagcaauaucaaacuacagguugucaaagacgcacaagcccuccuacauggccuggacuucucugaagucucaaauguccagcgacucaugcgaaaacagaaacgagacgacggcgaccucaaacgccuccgcgaccuaaaccaagccguaaacaaccuuguagaacuaaaaucaacccaacaaaaaucaauacuccgcgucggcacacuaaccagcgacgaucuccucacccucgcagccgaccucgagaaacuaaaaucaaaaguaauccgcacagaacguccccucucauccgguguauacaugggaaaccuaucaacacaacaacuggaacaaagacgagcacuacucaacaugaucggcaugguaggcggugcccaaggaacccaacccggcagagacggcgucguccgcgucugggaugucaaaaaccccgaccuacucaacaaccaauucggaaccaugcccucccuaacacucgccugccucaccaaacaaggccaagucgaccuaaaugacgcaguccucgcccuaaccgaccugggccugaucuacacagccaaauaccccaacagcagcgaccucgaccgccuaagccaaucacaccccauccugaacauggucgacacaaagaaauccucccucaacauauccggcuacaacuucagccucggcgccgcagucaaagccggagcaugcaugcuagaugggggcaacaugcuagagaccaucaaagucaccccgcaaacaauggacggcauccucaaaagcauccuaaaagucaaaaagagcuuagguauguucgucucagacaccccaggggagcgcaaccccuacgaaaacauacucuauaaaaucugccuauccggagacggcuggcccuacauagcaucccgcaccuccaucguaggccgcgccugggaaaacacuaccgucgaccucgaaucagacggcaaaccacaaaaagugggaaccgccggcuccaacaaaucgcuacagagcgccggcuuccccacaggccucaccuacucccaacuaaugacacucaaagacagcaugaugcaacuagacccaagcgcaaaaacuuggaucgacaucgaaggccgaccagaagacccaguagaaaucgcccuauaccagcccaugagcggaugcuacauccauuucuuccgagaaccaaccgaccuaaaacaauucaaacaagacgccaaauacucacacgggaucgacgucacggaccucuucuccgcacagcccggacucaccuccgccguaauagaagcccucccgcguaacaugguacuuaccugccaaggauccgacgacauaaaaagacuccuugacucacaaggccgccgcgacauaaaacuaauagauaucgcccuaucaaaaaccgauucccgucgauucgagaacgccguaugggaccaaugcaaagaucuaugccacaugcacaccggcgucguagucgagaaaaagaaacgaggcggaaaagaagaaauaacaccccacugcgcccucauggacugcaucauguacgacgccgccgucuccggcggccucaacaucccaguccugagagccguacuacccagagacauggucuuccgaacaucguccccaaaagugguccucuaa

SEQ ID NO: 3353 - RNA, 1710 nt, Artificial Sequence
  derived and/or modified CDS sequence (opt11) from Lassa virus__AIT17783__NP
augucagcauccaaagaaguaaaauccuuccuauggacacaaucccuacgcagagaacugagcggauacugcuccaacauaaaacuccaagucgucaaagacgcacaagcacuacuccacggccucgacuucucagaaguaucaaacguccaacgccucaugcgaaaacaaaaacgcgacgacagcgaucuuaaacgccuccgagaccuaaaccaggcgguaaacaaccuaguagaacuaaaauccacccaacaaaaauccauccuccgcguaggcacacucaccagcgacgaccuccucacccucgcagcagaccucgaaaaacuaaaauccaaagucauaaggacggaaagaccccuaaguagcggcgucuacaugggaaaccucuccacccaacaacuggaacaacgccgcgcccuacucaacaugaucggaauggucggcggcgcccaaggaacacaaccaggaagagacggcguagucagagucugggaugucaaaaaccccgaccuccucaacaaccaauucgguacaaugcccucacucacacucgcaugccuaacaaaacaaggccaagucgaccucaacgacguaguccucgcccucaccgaccugggccugaucuacacagccaaauaccccaacucaucugaccuagaccggcuaagccaaagccaccccauccucaacaugguggacacaaagaaaagcagccucaauaucagcggcuacaacuucucccuaggugccgcagucaaagccggcgccugcaugcuagacgguggaaacaugcuagaaaccaucaaagucacgccccagaccauggacggcauccuaaaaaguauccucaaagucaagaaaucccuaggcauguucgucagcgacacaccgggagaacggaaccccuacgaaaauauccuuuacaaaauaugccucucaggcgacggcuggccauacauagccagcagaacuucaaucgucggccgcgcaugggaaaauacgacaguggaccucgaaagcgacggaaaaccacaaaaagucggcacagcaggaucgaacaaaagccuacaguccgccggguuccccacaggacucacuuacucacaacucaugacccucaaagacucaaugaugcagcucgacccaucagcaaaaacuuggaucgacaucgagggccggcccgaagacccaguagaaaucgcccuauaucaacccguaucaggcuguuacauccacuucuuccgcgaaccaaccgaccugaaacaauucaaacaagacgcaaaauacagucacgggaucgauguggcggaccucuucccagcccaacccggccuaaccagcgcgguaaucgaagcacuaccccgcaacaugguacuaaccugccaaggcuccgaugacaucaaacgacuacucgacucccaaggacgacgcgacaucaaacucaucgacaucgcacucuccaaagccgacucccgccgcuucgaaaacgccgucugggaccagugcaaagaccucugccacaugcacaccggcguaguaguagagaaaaagaaacgaggaggcaaagaagaaauaacgccgcacugcgcacucauggacugcaucauguacgacgccgccguaucaggcggccucaacauacccguccuaagagccgugcuaccccgcgauaugguauuccgcaccagcucgcccaaagucgugcuuuaa

SEQ ID NO: 3354 - RNA, 1710 nt, Artificial Sequence
  derived and/or modified CDS sequence (opt11) from Lassa virus__AIT17787__NP
augucggcuuccaaagaagucaaauccuuccucuggacccaaagccuccgccgcgaacuauccggauacugcucgaacaucaaacuacaaguaguaaaagacgcccaagcacuacuccacggacucgacuucuccgaaguauccaacguccagcgccucaugcgcaaacaaaaacgagacgacggcgaccucaaacgccuccgcgaucuaaaccaagccgucaacaaccuaguagaacuaaaauccacccagcaaaaauccauccuucgagucggcacccucaccuccgacgaccuuuuaacacuagccgccgaucucgaaaaacuaaaaagcaaagucauccgcacggaacguccacugagcuccggagucuauaugggaaaccucucaacccaacaacucgaacaacgccgcgcccuccucaacaugauaggaaugguaggaggugcccaaggaacccaacccggacgagacggugucgucagagucugggacguuaaaaacccagaucuacuaaacaaccaauuuggcacaaugcccagccucacccucgccugccuaaccaaacaaggacaaguagaccucaacgacgcagucuuagcacucaccgaccuaggccucaucuacaccgcuaaauaccccaacuccucugaucucgaccgacucucccaaucacaccccauccucaacauggucgacaccaagaaauccagccucaacauaucaggguacaacuucucccucggugcagccgucaaagccggagccugcaugcucgacggcggaaauaugcuggagaccauaaaagucacaccccaaacaauggacggcauacucaaaucaauccucaaagucaagaaaucacuaggaauguucguauccgacacccccggcgaacgcaaccccuacgaaaacauccucuacaaaaucugccugucaggcgauggcuggcccuacauugcaucccgcacuuccauagucggccgcgcaugggagaacacgaccgucgaccucgaaucugacggcaaaccacaaaaagucggcaccgccggauccaacaaaucccuacaaucagccggcuucccaacaggccucaccuacucacaacucaugacacucaaagacuccaugaugcaacucgaccccagcgccaaaacguggauagacauagagggucgacccgaagacccagucgaaaucgcacucuaccaaccaauguccggaugcuacauccacuucuuccgugaacccacagaccucaaacaauuuaaacaagaugccaaauacucacacggcauagacgucaccgaccuauucuccgcacaacccggccuaaccagcgccgucaucgaagcccucccccgcaacaugguccucacaugccagggaucugacgacaucaaacgacuccucgacagccagggccgacgcgacauaaaacuaauagacaucgcauuaucgaaaguagacucacggcgauucgaaaacgccgucugggaccaaugcaaagaccucugccacaugcacacagggguagucguagagaaaaagaaacgaggcgggaaagaagaaaucaccccacacugcgcccucauggacugcaucauguacgacgccgcuguaucaggcggccucaauauccccguccuccgcgcgguccuaccccgggacauggucuuccgcacguccucaccaaaagucguccucuaa

SEQ ID NO: 3355 - RNA, 1710 nt, Artificial Sequence
  derived and/or modified CDS sequence (opt11) from Lassa virus__AIT17803__NP
augagcgccagcaaagaaauaaaauccuuccucuggacucaaucacuaagacgcgaacucuccggcuacugcucgaacauaaaacugcaagucgucaaagaugcgcaagcccuacuacacggccuagacuucucagaaguauccaauguucagcgacucaugcgaaaagaacguagagacgacaacgaccucaaacgccuacgagaccuaaaccaagccgucaacaaccucguagagcuaaaaagcacccaacagaaaagcauccuccgagucggcacccuaacgucagacgaccuccuaauccuagcugccgaucucgaaaaacucaaaaguaaaguaaucagaaccgaacgcccgcucucagccgggguauacaugggcaaccucuccucacaacaacucgaccaacgacgcgcccuccucuccaugauaggcaugucaggcggaucccaagaagcaagagccggccgcgacggugucguaagagucugggacguuaaaaacgcagaacuccucaacaaccaguucggaaccaugccaucacuaacgcucgccugucuaacaaaacaaggccagguagaccucaacgaugccguccaagcucucaccgaccucggccucaucuauaccgcuaaauauccgaacaccuccgaccuagaccgacuaacacaaucccaccccauacucaacaugauagacacgaagaaaucgucccucaacauauccggauacaacuucucccucggcgccgcuguuaaagccggcgccugcaugcuggacggcggcaacaugcucgaaaccaucaaagucucaccccaaaccgucgacggcauccucaagucaauccuaaaggucaaaaaggcccuggguauguucauaagcgacacccccggagaacgcaauccauacgagaacauccuauacaaaaucugccucuccggcgauggcuggcccuacauagccucccguaccuccaucaccggcagggcaugggaaaacaccguagucgaccucgaauccgacggcaaaccccaaaaagccggcucaaacaacuccaacaaaucccuacaaagugcuggcuucaccgccggccuuaccuacucccagcucaugacccuaaaagacgcaaugcuacaacuagaccccaaugccaaaaccuggauggauaucgaaggccggccagaagacccugucgaaauugcacucuaccaacccuccucaggcugcuacauacacuucuuccgagaaccaaccgaccuuaaacaauucaaacaagacgcaaaauacucccacggaaucgacguuaccgaccuauucgccgcucaaccagggcucaccuccgccgucauagacgcccucccccgaaacauggucauaacaugccagggcucugacgacauccgcaaacuccuugaaucacagggccgaaaagacaucaaacuaaucgacauagcccuauccaaaaccgauucacgcaaauacgagaacgccgucugggaccaauacaaagaccuaugccacaugcacaccggcgucgucgucgaaaagaaaaagaaaggaggaaaagaggaaaucacaccccacugcgcccucauggacugcauaauguucgaugccgccguaagcggcggacuaaacacaagcguacuccgcgcaguacucccacgcgacaugguauuccgaaccuccacaccccgcgucgucuuguaa

SEQ ID NO: 3356 - RNA, 1710 nt, Artificial Sequence
  derived and/or modified CDS sequence (opt11) from Lassa virus__AIT17811__NP
auguccgcgucuaaagaaaucaaaucauuccucuggacacagucacuucgccgcgagcucucuggcuauugcucgaacaucaaacuacaagugguaaaagacgcacaagcacuccuccacggacucgacuucuccgaggucuccaacguccaacgccucaugcggaaagaacgccgagacgacaacgaucucaaacgccuccgugaccucaaccaagcgguaaacaaucuagucgaacucaaaagcacacaacagaaauccauacuacgcgucggaacucucaccagcgacgaccucuuaauccucgcagcugaccuagaaaaauuaaaaucaaaaguaacccgaacugaacgcccccucucagccggcgucuacaugggaaaucuguccucccaacaacucgaccaacgacgcgcccuucugaacaugaucggaauguccggcucuaaccaaggcgcacgcgccggcagagacggcgucguacgcguaugggacgucaaaaacgcagaacuccucaauaaccaauucggaaccaugcccucucuaacacucgccugccucaccaaacagggccaaguagaucuaaacgacgcaguacaagcgcucacugaccucggcuugaucuacaccgccaaauaccccaacacaagcgaccuagauagacuaacccagucccaccccauccugaauaugaucgacaccaagaaaucuagccugaacaucucaggcuacaacuucucacuaggggcagcagucaaagccggggccugcaugcucgaugggggcaacaugcuagaaaccaucaaaguauccccacaaacaauggacggaauacucaaaucaauccucaaagugaagaaagcacuuggcauguucaucagcgacacaccaggcgaacgcaaccccuacgaaaacauacucuacaaaaucugccucuccggugacggauggccauacauagcaagccgaaccucaaucacaggccgagcaugggaaaacacaguaguagaccucgaauccgacggaaaaccccaaaaagccggcucaaacggaagcaacaaaucccuccagagcgcaggcuucaccgccggccuaaccuacucacaacuuaugacacucaaagaugccaugcuacaacuagaccccaacgcaaaaacuuggauggacauagaaggccggcccgaagaccccgucgaaaucgccuucuaccaaccauccuccggcugcuacauacacuucuucagagaacccaccgaucucaaacaauuuaaacaggacgccaaauacucccacggcauagacgucaccgaccucuucgcagcacaacccggccuaaccucagcagucaucgacgcccuccccagaaaccucgucauuaccugccaaggaucagacgacauccguaaacuauucgaaucacaaggccgcaaagacaucaaacucauagacaucgcgcuauccaaaacagacucacgaaaauacgaaaacgcaguaugggaccaauacaaagaccucugccacaugcacaccggaauuguaguugagaaaaagaaacggggcggaaaagaagaaaucacaccccacugcgcccuaauggacugcaucauguucgacgccgccgucagcggcggacugaacgcaucgguccucagagccguacuaccccgcgacauggucuuccgcaccuccacuccccgcguaguacuauaa

SEQ ID NO: 3357 - RNA, 1710 nt, Artificial Sequence
  derived and/or modified CDS sequence (opt11) from Lassa virus__AIT17815__NP
auguccgccuccaaagaaaucaaaucauuccuauggacgcaaucacuacgacgcgaacuuuccggcuacugcagcaacaucaaacuucaaguaguaaaagacgcccaggcacuccuccacggacucgacuucagugagguaagcaacguccaacgccucaugcgcaaagagcgucgcgacgacaacgaccucaagcgucuacgcgaccucaaccaagcggucaacaaucuaguagaacuaaagagcacacagcaaaagucaauacuuagagugggaacacucacauccgacgaccuccugauccuagccgccgauuuagaaaaacucaaaucgaaagugacacgcaccgaacgcccgcuuagugccgguguguacaugggcaaccucagcucccaacaacucgaccaacgacgcgcgcuccuagacaugauaggcaugagcggcucaaaccaaggcgccagagcaggacgagacggcgucguacgcgucugggacgucaaaaacgcagaacuccucaacaaucaauucggcacaaugccaagccugacacuagccugccucacaaaacaaggucaaguagaccuaaacgacgccguccaagcacuaaccgaccucggcuuaaucuauaccgccaaauaccccaauacuucggaccucgacagacucacacaaucgcacccaauacucaacaugaucgacacaaagaaaucaucccuuaacaucucaggcuacaacuucucccuaggagcagcagucaaagcuggagcgugcaugcuagacggcggcaacaugcucgaaaccauuaaagucuccccacaaaccauggacggcauacucaaauccauccucaaagucaagaaagcccuaggcauguucaucuccgacgccccuggagaacgcaacccauacgaaaacauccuauacaaaaucugccucuccggagacggcuggcccuacaucgccucccgcacuuccaucacaggcagagccugggaaaacaccgucguagaccuagaaagcgacggcaaaccccaaaaagccggguccaacggaagcaacaaaucacuccaguccgccggauucacggcuggacucaccuacagccaacuaaugacacucaaagacgcaaugcuacaacuagaccccaacgcuaaaacauggauggacaucgaaggacgaccugaagaccccguagaaaucgcccuuuaccaacccucauccggcugcuacauccacuucuuccgggaacccaccgaccucaaacaauucaaacaagaugccaaauauucccacggcaucgacgucaccgaccucuuugcagcacaaccaggccuaaccucagccgucauagacgcccucccccgaaacauggucauaaccugccaaggcuccgacgacauacggaaacuuuucgaaucccaagggcggaaagacauaaaacugaucgacauagcucucuccaaaacagacucccgcaaguacgaaaacgcggucugggaccaguacaaggaccucugccacaugcacaccggaaucgucgucgagaaaaagaaaagaggcggcaaagaagaaauaacaccccacugcgcacuaauggacugcaucauguucgacgcagccgucagcggcggccuaaacaccagcguccuaagggccguccucccacgcgacauggucuuccggaccuccaccccacgaguuguccuauaa

SEQ ID NO: 3358 - RNA, 1710 nt, Artificial Sequence
  derived and/or modified CDS sequence (opt11) from Lassa virus__AIT17821__NP
augucagcauccaaagagaucaaaucauuccucuggacccaaucccuccgccgagaacucucagguuacugcucaaacaucaaacuacaaguugucaaagacgcgcaagcacuccuccacggacucgacuucucagaaguaagcaauguccaacgccugaugagaaaagagcgcagagacgacaacgaccucaaacgccuacgcgaccucaaccaagccgucaacaaccuagucgaacucaaaagcacccaacagaaaucgauccuccgagucggcacacucaccagcgacgaccuccucauacucgcugccgaccuugaaaaacuaaaaucgaagguaauccgcaccgaacgaccacuuuccgcuggggucuacaugggaaaccugaguucacaacaacuggaccaacgacgcgcgcuccuaagcaugaucgggauguccggcggcaaccaaggagcccgagccggcagggacggcgucguccgggucugggacgugaaaaacgcagaacugcuaaacaaccaauucggcaccaugcccucccucacacucgccugccucaccaaacaaggacaaguagaccuaaacgacgccguccaagcacucaccgaccucggccucaucuacacagccaaauacccaaacaccucagaucucgaccgucuaacgcagucacacccaauacucaacaugaucgacaccaaaaagucgagccuaaacauuuccggcuacaacuucucacuaggagcagccgucaaagcaggagcaugcaugcucgacggcggaaacaugcuagaaaccaucaaggucagcccccagaccguagacggcauacuaaaaucuauacuaaaaguaaagaaagcacuaggcauguucauaagcgacaccccgggagagcgcaaccccuacgaaaacauacuuuacaaaauaugccucuccggcgacggauggccauauaucgcaagcaggaccagcaucacaggccgagcuugggaaaacaccgucguagaccucgagagcgauggcaaaccccagaaaacgggauccaacaacagcaacaaaucgcuccaaucagccggcuucacugccggccucacauacucccaacucaugacccuuaaagacgccaugcuccaacuagaccccaacgcaaaaacauggauggacaucgaaggccgccccgaagaccccgucgaagucgcgcuauaccaaccaagcagcggcugcuacauccacuucuuccgcgaacccaccgaccucaaacaauucaagcaagacgcaaaauacucccacgguauagaugucaccgaccuauuugcagcgcaaccaggacuaaccucagccgugauagacgcccucccccgcaacauggucauaaccugccagggcagcgaugacauccgcaagcuccuggaaucccaaggacgcaaagacauaaaacucaucgauauugcccucucgaaaaccgacagcagaaaguacgagaacgcugucugggaccaauacaaggaccuaugccacaugcacaccggcgucgucgucgagaaaaagaaaagaggcgguaaagaagaaaucacaccccauugcgcccuuauggacugcaucauguucgacgcagcagucucaggaggccuaaacaccuccguccuaagggcaguccucccccgagacaugguguucagaaccuccacaccccgcgucguacuauga

SEQ ID NO: 3359 - RNA, 1710 nt, Artificial Sequence
  derived and/or modified CDS sequence (opt11) from Lassa virus__AIT17837__NP
augucaaacucaaaagaaaucaaauccuuucucuggacacaaucccuucgccgcgaacucucaggcuacugcuccaacaucaaacuccagguugugaaagacgcccaagcccuacuccacggccuagacuucuccgaagucuccaacguccaacgccucaugcgcaaacaaaaacgcgacgacgcagaccucaagcgucuccgagaucucaaccaagccgucaacaaccucgucgaacuaaaauccacacaacaaaagaacguuuuacgagucggcaccuuauccuccgacgaccucaucacccuagcagcugaccucgaaaaacucaaauccaaagucauccgaaccgaacgaccacucagcuccggcgucuacauggggaaccuaucuucccaacaacucgaccaacgccgcgcccuccucagcaugaucggaaugagcggcggaccacaaggaaaccgcaccgggggcgacggcgucguccgcgucugggacguuaaaaacgccgaacuucugaauaaccaauucggaacaaugccgagccucacccucgcuugccuaaccaagcaaggccagguagaccucaacgacgccguccaagcccucacagaccucggauuaaucuacacagccaaauaccccaacagcucggaccuggacaugcucacacaaucccacccaauccucggcaugguggauacaaagaaaagcucacucaacaucucaggauacaacuucucacuaggcgccgccguaaaagccggagcaugcaugcucgacggcggcaacaugcuagaaacgauaaaaguuucgccacaaacgauggacggcauacuaaaauccauacuaaaagucaaacgaagucucggcauguucaucucagacaccccaggcgaacguaaccccuacgaaaauauacuuuacaaaaucugccucagcggcgaaggauggccauacaucgccucccgaaccucgaucacaggacgcgccugggaaaacacucucgucgaccuagaaucagauaacaaacccccaaaacucaacucagccggcuccaacaaaucccuacaggccgccggacuaaacgccggacuaaccuacucccaacucaugacccucaaagacugcaugcuccaacucgacccguccuccaaaaccuggaucgacaucgaaggccgcccggaagaccccguagaaaucgcacucuuccaaccuucaagcgggugcuacauccacuucuucagagaacccaccgaccucaaacaauucaaacaagacgccaaguacucccacggcaucgacgucacagaccuauucuccacacaacccggacuuacauccgccgucauagaagcccugccacgcaacauggucuuaaccugccaggggucagacgacaucaagaaacuccucgagucccaaggacgaagagacaucaaacucauagacaucucacucuccaaagcagacucccgaaaauucgaaaacgccgucugggaccaauauaaagaccucugccacaugcauaccggagucgucguugaaaagaagaaacgcggaggcaaagaagaaaucacaccccacugcgcccuacuugacugcaucauguucgacgccgccaccaccggcucgcuaaacaucaccacccucagagccguccuuccccgugacauggucuuccgaaccagcacccccaaagucguccuuuaa

SEQ ID NO: 3360 - RNA, 1710 nt, Artificial Sequence
  derived and/or modified CDS sequence (opt11) from Lassa virus__AIT17841__NP
augagcgcauccaaagaaauaaaauccuuccucuggacucaaagccucagacgcgaacucuccggauacugcucaaacaucaaacuccaaguagucaaagacgcacaagcccuacuccacggccucgauuucuccgaagucagcaacguccaacgacugaugagaaaagaacgccgagacgauaacgaccuuaaacgccuccgcgaccuaaaccaagcgguaaacaaccucgucgagcuaaaauccacccaacagaaaagcauacuccgagucggcacccucacauccgacgaccuccuuauccucgccgccgaccucgaaaagcuaaaauccaaaguaacacgcacagagcgcccucucuccgccggcgucuacauggggaacuuauccucccaacaacucgaccaaaggcgcgcacuccuaaacaugaucgggauguccggcuccaaccaaggcgcucgcacaggccgagacggcgucguccgcgucugggacgucaaaaacgcagaacugcucaacaaccaguucggcaccaugcccucacuuacacucgccugccuaaccaaacaagggcaaguagaccuaaacgaugccguacaagcccugacagaccuaggccucaucuacacagcaaaauaccccaacaccucugaccuagacagacucacccaaucccaccccauuuugaacaugauagacacgaagaaaagcagcuugaacaucagcggcuacaacuucucccucggcgccgccgucaaagccggagcaugcaugcuagacgggggcaacaugcucgaaacaaucaaagucagcccucagaccauggacggaauccuaaaaagcauccucaaagucaagaaagcccucggaauguucauuuccgacgccccaggcgaacgcaacccauacgaaaacauccucuacaaaauaugccuaagcggagacggcuggccguacaucgcaagccgaaccuccauuacuggccgcgccugggaaaacaccguaguagaccuugaauccgacggaaaaccccaaaaagcaggcagcaacggaagcaacaaaucgcuacaaagcgcaggcuucacagcaggcuuaaccuacagccaacucaugacacucaaagacgccaugcuccagcuagacccaaacgcaaaaaccuggauggacaucgagggacgacccgaagacccaguagaaaucgcacuuuaccaacccuccucaggcugcuacauccacuucuuccgcgaaccuaccgaccuaaaacaauucaaacaagaugccaaguauagucacggaauagacgucacugaccuguucgccgcacaaccaggccucaccuccgccguaauagacgcccucccccgcaacauggugauaaccugccaaggaagcgacgacauccgaaaacucuucgaaucccaaggcagaaaggacauaaaacucauagacaucgcacucagcaaaaccgacucacguaaauacgaaaacgccgucugggaccaauacaaagaccucugccacaugcacacgggaauaguaguagaaaagaagaaacgaggcggaaaagaagaaauaacuccacacugcgcccucauggacugcaucauguucgacgcagccguaucaggcggccuaaacaccucaguacuacgagccguacuaccacgagacaugguauuccgcacaucaacaccccgcgucgucuuauaa

SEQ ID NO: 3361 - RNA, 1710 nt, Artificial Sequence
  derived and/or modified CDS sequence (opt11) from Lassa virus__AIT17845__NP
augucagccagcaaagaaaucaaauccuuucuauggacgcagucccuacgccgugagcuauccggauacugcagcaacauaaaacuucaaguagugaaagacgcccaagcccuacuccacggacuagacuucucagaagucuccaacguccaacgacuaaugcgcaaagaaaggcgagacgacaacgaccucaaaaggcuacgcgaccucaaccaagcaguaaacaaccucgucgagcucaaauccacacaacagaaauccauacugcgugucggcacccucacauccgacgaccuacuaauccucgccgccgaccucgaaaaacucaaaagcaaagugacccgaacugaacgcccacucuccgccggcguauacaugggaaaccucagcagccaacaacucgaccaaagacgcgcccuacuaaacaugaucggcaugucagguagcaaccagggggcacagacaggaagagacggggucgugcgcgucugggacgugaaaaacgcagagcuacucaacaaccaauucggcaccaugcccagccuaacccucgcaugccuaacaaaacaaggacaaguggaccuuaacgacgccguccaagcccuaacagaccuaggccucaucuacaccgccaaauacccaaacaccucagaccucgaucggcucacgcaaucccacccaauacucaacaugaucgacacaaagaaaucuucccuaaacauaagcggauacaacuucucacucggcgcagccgucaaagccggcgcaugcaugcucgacggaggcaacaugcucgaaaccauaaaagucucgccacaaaccauggacggaauccuaaaauccauccuaaaagucaagaaagcccucggcauguucauaagcgacgcaccgggcgagcgcaacccauacgagaacauacucuacaaaaucugccucucaggagacggauggccauacaucgcgucacgcacuucgaucaccggacgcgcaugggaaaauaccguagucgaccuagaauccgacggcaaaccucaaaaagccggaucaaacggaaguaauaaaagccuccaaucagcaggauucacagccggccuaacauacucccaacucaugacacuuaaagacgcaaugcuccaacucgaccccaaugccaaaacauggauggacauagagggccgccccgaagacccagucgaaauagcccuauaccaacccucaucaggaugcuacauccacuucuuccgagaacccacagaccucaaacaauucaaacaagacgccaaauacagccacggcaucgacguaaccgaccucuucgcagcccaaccaggacuaacauccgccgucauagacgcacucccccgcaacauggucauaaccugccagggauccgacgacauccgcaaacuauucgaaucacaaggccgcaaagacaucaagcucauagacaucgcgcucuccaaaacagacagccgaaaauaugagaacgcagucugggaccaauacaaagaccucugccacaugcacacaggcauaguagucgaaaagaagaaaaggggcggaaaagaggaaauaaccccgcacugcgcccuaauggacugcauaauguucgacgcugccgucuccggaggccugaacaccaguguucugcgagcaguucugccaagagacaugguguuccgcaccagcacaccccgggucguccuauaa

SEQ ID NO: 3362 - RNA, 1710 nt, Artificial Sequence
  derived and/or modified CDS sequence (opt11) from Lassa virus__ANH09723__NP
augucagccuccaaagaaaucaaauccuucuuauggacacaaagccuacgcagagaacucagcggguacugcuccaacauuaaacugcaagucgucaaagacgcgcaggcccuuuuacacggccucgacuucuccgaagucuccaacguccaacgccuuaugcgcaaacaacgaagagaugacaacgaccuaaaacgacuacgagaucucaaccaagcagucaacaaccucgucgagcuuaagagcacccagcaaaaaucaguccuccgagucggcacacucacauccgacgaccuccuaacccucgccgccgaccuagaaaaacucaaauccaaaguaaccagaaccgaacgcccacuaacagccggcgucuacauggguaaccucuccucucaacagcucgaccaacgccgcgcccuccugaacaugauaggaaugucgggcggcaaccaaggcgcccggaccggaagggacggcgucguccgagucugggacgucaaaaacgccgaacuacucaacaaccaauucggcaccaugccaucacucacucucgcaugccucaccaaacagggacaagucgaucuaaacgacgucguacaggcgcucaccgaccuaggccuaauauacacugcaaaauaccccaacaccuccgaccucgaccgccucacccagucccacccuauacucaacaugauagacacuaacaaauccucucucaacaucucaggcuacaauuucucccuaggagcagccguaaaggccggcgccugcaugcuagacggaggaaacaugcucgaaaccaucaaaguaagcccccaaaccauggacgggauccucaaaagcauacuaaaagucaagaaaucauuaggcauguucauauccgacaccccaggcgaacgcaaccccuacgaaaacauccuuuacaaaaucugccucuccggcgacgguuggccauacaucgccucgagaaccuccauaacaggccgcgccugggaaaacaccgucguagaccucgaauccggcggcaaaccccagaaagcaggcuccaacaacagcaacaaaucccugcaaucagccggcuucgccgcaggacuaaccuacucccaacuaaugacccucaaagacgccaugcuacaacuugacccgaacgccaaaaccuggauggacaucgagggccgccccgaggauccagucgaaaucgcccucuaccaacccauaucaggaugcuacauccacuucuuccgagaacccacagaucuaaaacaauucaaacaagacgccaaauauucgcacggaauagacgucaccgaccucuucgcugcgcaaccaggacucacaagcgccgucauagaagcacucccccgcaacauggucauaaccugccaaggcuccgacgacauccgcaaacucuucgagucacaaggccgcaaagacaucaaacucaucgacaucgcacucucaaaaacagacucacgaaaauacgaaaacgccgucugggaccaauacaaagaccucugccacaugcacacgggcgucgucguagagaaaaagaagaaaggcgguaaagaagaaaucacaccacacugcgcccuaauggacugcauaauguucgacgccgccgucucaggcggccuaaacacccucgugcuccgugcaguucucccccgugacauggucuuccgcaccucaaccccaaaaguaguacucuga

SEQ ID NO: 3363 - RNA, 1710 nt, Artificial Sequence
  derived and/or modified CDS sequence (opt11) from Lassa virus__ANH09725__NP
augucagccuccaaagagaucaaauccuuccucuggacccaaagccuccgcagagaacuauccggcuacugcagcaacaucaaacuccaggucgucaaagacgcgcaagcucuccuacacggccuggacuucagugaaguuuccaacguccaacgacucaugcgaaaacagcgccgcgacgacaacgacuuaaaacgccuacgcgaccucaaccaggcaguaaacaaccucgucgaacucaaauccacucaacaaaaaucuguccuucgaguaggaacccucacaagcgacgaccuccucauacuagcggcagaccuagagaaacuaaaaagcaaagugacccguacggaacgcccccucuccgccggcguuuacaugggaaaccuaucgucacaacagcuggaccaacgccgggcacuccucaacaugaucgguaugucaggaggcaaccaaggagcccgcgcaggacgcgacggcguuguacgagucugggacguuaaaaacgccgaccuccucaacaaccaauucggcaccaugccaagccuuacacuggcuugccucacaaaacaaggacaaguagaucucaacgacgucguccaagcccucaccgaccuaggccuaauuuauacagcaaaauacccgaauaccuccgaccucgaccgacuaacacaaagccaucccauacuaaacaugauagacaccaacaaaagcagccuaaacaucagcggcuacaacuucucccucggcgcggccgucaaagccggcgccugcaugcucgacggcggaaacaugcucgaaacaaucaaaguaucaccccaaacaauggacggaauccucaagagcauccuaaaagucaagaaaucacucggaauguucaucuccgacaccccaggcgaacgcaaccccuaugagaacauccucuacaaaauaugccucuccggcgacggauggccauacauagcaucccgcaccuccauaaccggacgcgcuugggagaauacagucgucgaccuugaaucuggaggaaaaccucaaaaagccggauccaacaacuccaacaaaagccuacagucggcuggcuucgccgcuggccucaccuacagccaacuaaugacccucaaagacgccaugcuccaacuagacccaaacgcaaaaaccuggauggacaucgaaggccgccccgaagaccccguagaaaucgcccucuaccaacccauauccgggugcuacauccacuuuuuccgcgaaccaacagaccucaaacaauucaaacaggacgcgaaauacucacacggcauugacgucacagaccuauucgcagcccaacccggccuuacguccgccguaauagaagcacucccccgcaacauggucaucacaugccaaggcucagacgacaucagaaaacucuuagagagccaaggccgcaaagacaucaaacucauugacaucgcccucuccaaaacagacucacgcaaauacgaaaacgcagucugggaccaauacaaagaccugugccauaugcacacaggcgucgucguugaaaagaagaaacgcggcggaaaagaagaaaucacaccccacugcgcacuaauggacugcauaauguucgacgccgccguaagcggaggacucaacacacucguacuccgcgcaguccuaccucgcgacauggucuuccguacauccacccccaaagucguacuauaa

SEQ ID NO: 3364 - RNA, 1710 nt, Artificial Sequence
  derived and/or modified CDS sequence (opt11) from Lassa virus__ANH09729__NP
auguccgcgagcaaagaaaucaaauccuuucuauggacccaaucccuccggcgcgaacuuuccggauauugcucgaauaucaaacuacaaguaguaaaagacgcccaagcucuacuccacggccucgacuucagcgaaguauccaauguccaacgccucaugcgaaaacagcggcgugacgacuccgaccuuaaacggcuccgcgaccugaaccaagccgucaacaaccucgucgaacucaaauccacccaacagaaaagcguccugcgcgucggcacccucaccuccgacgaccuacucacacuagccgccgacuuagaaaaacuaaaaucaaaaguaacacgaaccgaaagaccgcucuccgccggcguauacaugggcaaccucuccucacaacaacuagaccaacgccgagcccuccuaaacaugauaggcauguccggcggaaaccaaggcgcccgcaccggucgcgacggagucguccgagucugggacgucaaaaacgcagaccuccuaaacaaccaauucggcacaaugccaucacuaacacuggcgugccuaacaaaacaaggucaaguagaccucaacgacgucgugcaagcccucacagaucuaggccuaauauauaccgccaaauacccaaacacuuccgaccucgacagacucacacaaucccaccccauccuaaacaugauagacaccaacaaaagcucccucaacauauccggauacaacuucucacugggugccgcggucaaggcaggcgcaugcaugcucgacggcggcaacaugcuggaaaccaucaaaguaucaccccaaaccauggacggcauccuuaaauccauacucaaagucaagaaaagccucgguauguucaucagcgacacucccggcgagcgcaaccccuacgaaaacauccuguacaaaaucugucucucaggggacggauggcccuacaucgcaagccgcaccuccaucacgggccgagcaugggaaaacaccguagucgaccucgaauccgggggaaaaccccaacgcgcgggaucaaacaacuccaacaaaucccuucaauccgccggcuucgcagcaggacuaaccuacucacaacucaugacccuaaaagacgccaugcuacaacucgaccccaacgccaaaacauggauggacauagaaggccgccccgaagaccccguagagauagcacuauaccaaccaaccucagguugcuacauccacuucuuccgcgaaccaaccgaccucaaacaauuuaaacaagacgccaaauacucacacggaauagacgucacagaccucuucgcagcccaacccggccuaaccuccgcaguuauagaagcccucccccgcaacauggugauaaccugccaaggcagcgacgacauccgcaaacugcuugaaucacaaggacggaaagacaucaaacuaauugauaucgcccucucaaaaaccgacucccgcaaauacgagaacgcagucugggaccaauacaaagaccuaugccacaugcacaccggcguaguagucgaaaagaagaagaaaggaggaaaagaagaaaucacaccccacugcgcccuaauggacugcaucauguucgacgccgccgucagcggaggacuaaacacccucguacuccgcgcuguacucccccgagacauggucuuccguaccuccacccccaaaguaguacucuag

SEQ ID NO: 3365 - RNA, 1710 nt, Artificial Sequence
  derived and/or modified CDS sequence (opt11) from Lassa virus__ANH09731__NP
auguccgcaucaaaagaaaucaaaucguuccucuggacccaaucccuucgaagagaacucucaggauacugcuccaacaucaaacuccaagucguaaaagacgcucaagcccuccuccacggccuagacuucucagaagucuccaauguccaacgccuaaugcgcaaacaacgccgcgacgacaacgaccuuaaacgacuacgcgaccucaaccaagcaguaaacaaccucgucgaacuaaagagcacacaacaaaaauccguccuacgcgugggaacgcucacgucggacgaccuccucacacucgccgcugaccucgaaaaacucaaaagcaaagucacccgaaccgaacgaccacucagcgcaggcguauacaugggaaaccugucuucccaacaacuggaccaacgacgcgcccuacuaaacaugauaggcaugacaggaggcaaccaaggcgcacgcaccggccgugacgggguaguccgcgucugggacgucaaaaacgccgaccuccucaacaaccaguucggaacgaugcccucacucacccucgcaugccuaaccaaacagggccaagucgaccucaacgacgugguacaagcccuaacggaccuagggcucaucuacaccgccaaauaccccaacaccucggaccucgacagacuaacccaaucgcacccgauccuuaacaugaucgacaccaacaaauccucacuaaacaucuccggcuacaacuucagccucggcgccgcagucaaagcgggugccuguaugcuagacggcggcaacaugcucgaaacaauaaaaguaucaccccaaaccauggacggcauccucaaaucaauacucaaggucaagaaaucccuagguauguucaucagcgauaccccgggcgagcgaaauccguacgaaaacauccucuauaaaaucugccucucaggagacggauggcccuacaucgccagccgcacauccauaacaggcagagccugggaaaacacaguggucgaccucgaauccggaggaaaaccacaacgagccggcuccaacaacuccaacaaaucacuacagagcgcaggucucgccgccggccucaccuacagccaacucaugacccucaaagacgccaugcuccaacucgacccaaaugccaaaaccuggauggacaucgaaggccgacccgaagaccccgucgaaaucgcacucuaccagcccaccuccggcugcuacauacacuucuuccgcgagcccaccgaccucaaacaauucaaacaagacgcaaaguacucccacggcauagacguaaccgaccucuucgccgcccaaccaggccucaccuccgccgucauagaagcacucccccgcaauauggucaucacaugccaaggaagcgacgacauccgcaaauuacuugagagccaaggccgcaaggacaucaaacuaaucgacaucgcccucagcaaaacugacagucgcaaguacgaaaacgcaguaugggaccaauauaaggaucucugccacaugcacaccggcgucguagucgaaaagaaaaagaaaggcggcaaagaggaaaucacaccccacugcgcccucauggacugcauuauguuugacgccgccgugagcggagggcucaacacccucguccugcgcgccguucuuccccgcgauauggucuucagaaccucaacccccaaaguaguacucuaa

SEQ ID NO: 3366 - RNA, 1710 nt, Artificial Sequence
  derived and/or modified CDS sequence (opt11) from Lassa virus__ANH09733__NP
augucagccuccaaagaaauuaaaucuuuucuguggacccagucccuccgccgagaacuaucaggguacugcuccaacauaaaacugcaagucgucaaagacgcacaagcacuccuccacggacuagacuucagcgaagucucaaacgugcaaagacucaugcgcaaacagcgccgcgacgacaacgaccucaaaagacuccgcgaccucaaccaagccgucaacaaccuaguagaacugaaaucaacccaacaaaaauccguccuuagagucggcacccuuaccuccgacgaccuacucacccucgccgcagaccucgaaaagcucaaguccaaaguaaccagaaccgaaagaccucuauccgcaggaguauacaugggaaaccuauccucacaacagcucgaccaacgcagagcauuacuaaacaugaucggcaugagcggcgggaaccaaggcgcccgcaccggaagagacggcgucguccgcgucugggacgugaaaaacgcagaccuccuaaacaaccaauuuggaaccaugcccucccucacacuagccugucucaccaaacagggacaagucgaccuaaacgacgugguccaagcccuaaccgaccucggacucauauacacagccaaauaccccaacaccucggaccucgacagacuaacccaaucccaccccauccucaacaugaucgacaccaacaaaucaucccugaacaucucaggcuacaacuucucccuaggcgcagccgucaaagccggcgccugcaugcucgacggcggcaacaugcucgaaacuauaaaagucucaccacagaccauggacgggaucuuaaaauccauccuaaaagucaagaaaucccucggcauguucauaucagacaccccaggggaacggaaccccuacgagaacauccucuacaaaauaugccucucaggagacggcuggcccuacaucgccagccgcaccuccauaaccggccgcgccugggaaaacacagucgucgaccucgaaagcggcggaaaaccacaacgcgccggcucaaacaauucaaacaaaagccuccaaagcgccggauucgcagcaggccuaaccuacucacaacucaugacacuaaaagacgcaaugcuccaacuagacccaaacgccaaaaccuggauggauauagaaggcagaccggaagacccagucgaaauagccuucuaucaaccaaucuccggcugcuacauccacuucuuccgcgaaccaaccgaccuaaaacaauucaaacaggaugccaaauacucucauggcauagacgucaccgaccuauucgcagcccaaccaggacugacaagcgccgucaucgaagcccuaccacgcaacauggucauuaccugccaaggaucggacgacauccgaaaauuacucgagucacaaggccgaaaagacaucaaacucauagauaucgcccuaagcaaaacugacagccgcaaauacgagaacgccgucugggaccaguacaaagaccucugccacaugcacaccggcgucguaguagaaaagaaaaagaaaggcggaaaagaagaaauaacaccccacugcgcccucauggacugcaucauguuugacgcagcgguaagcggcggccugaacacccuuguccuccgcgccguccuaccccgcgacauggucuuccguaccagcacccccaaagucgugcuauag

SEQ ID NO: 3367 - RNA, 1710 nt, Artificial Sequence
  derived and/or modified CDS sequence (opt11) from Lassa virus__ANH09735__NP
augagcgcaagcaaagaagucaaaucauuccuuuggacccaaucacuucgccgcgaacucagcggauauuguuccaacaucaagcugcaaguagucaaagacgcccaggcgcuacuccacggacuagacuucuccgaaguauccaacauacaacggcuaaugcggaaagaacgccgagacgacuccgaccuaaaacgacuacgcgaccucaaccaagccguaaacaaccucgucgaacucaaaagcacccaacaaaaauccguacuacgagucggaacacucucaagcgacgaccuccucacccuagcagcagaccuugagaaacucaaaucgaaagucauuagaacugaaagaccacucucaagcggaguauacaugggaaaccuaucaacacaacaacuagaccaacggcgcgcacuccuuaacaugaucggcaugacgaacggcggccaaggcgcgaacgcaggcagagacggaaucguccgcgucugggacgucaaaaacgcugaacuacuaaacaaucaauucgguaccaugccaucacucacccuagccugcuuaaccaaacaaggucaagucgaccucaacgacgcaguccaagcccugaccgaccugggccuaaucuacacagcaaaauacccgaacuccuccgaccuagaccgccuaucgcaaaaccaccccauccucaacaugauagacaccaagaaaucaucacucaacauaagcggguacaacuucagccucggcgcagccgucaaagccggggcaugcaugcuagacggcgguaacaugcuggaaaccaucaaagucagcccacaaaccauggacgguauccuaaaaucaauccucaaaguuaaacgcucccugggcauguucgucuccgacacccccggagaacgcaaccccuacgaaaacauccucuacaaaaucugccuaucaggcgacggauggcccuacgucgccucucgcaccuccauaauaggacgcgccugggaaaacacugucgucgaccuagaauccgacuccaaaccccaaagacccggcucaaaagaaagcaaccgcucccuucaaacagccggcuucccagccggccuaaccuacagccaacuaaugacccucaaggacuccaugcuccaacucgaccccaacgcaaaaaccuggauggacauagaaggacgaccagaugaccccgucgaaauagcccucuaccaaccgagcucgggcugcuacauccacuucuuccgcgaacccaccgaccuaaaacaauucaaacaggacgcgaaauacagccacggcaucgauaucggcgaccuauucgcagcacaacccggucuaacuucagccgucaucgaggcccucccccgaaacauggucauuaccugccaaggcuccgaagacaucaaaagacugcuagaaucacaaggccgcaaagauaucagacucguagacauaucgcucucaaaagcagacucccgcaaguucgaaaacgccgucugggaccaauucaaagaucugugcaacaugcacaccggcgugguagucgagaagaaaaagaaaggaggcaaagaagaaauaacaccgcacugcgcacucauggauugcauaauguucgacgccgcagucaugggcggacucgacgccaaaguccucagagccguacuccccaaagacauggucuuccgaaccuccaccccacgcgucguccucuaa

SEQ ID NO: 3368 - RNA, 1710 nt, Artificial Sequence
  derived and/or modified CDS sequence (opt11) from Lassa virus__ANH09737__NP
augagcgccuccaaagaaguaaaauccuuccuauggacccaaucacuuagacgcgaacuaucgggauacugcucaaauauaaaacuccaaguagucaaagacgcacaagcacuacuccacggacuagauuucucagaaguaagcaacauccaacgccuaaugcggaaagaacgccgcgacgacagcgaccucaaacgccuacgcgaucucaaccaagcaguaaacaaccucgucgaacucaagagcacacaacagaaauccguccuacgcguaggcacccuauccagcgacgaccugcuaacccuagccgccgaccucgaaaagcucaaaucaaaaguaauccgaacagaacgaccccuaagcagcggcgucuauaugggcaaccuuucuacucagcagcuagaccagcgccgugcucuccucaacaugauaggcaugaccaacggaggccaaggcgcgaacgcuggccgagacggcauaguccgagucugggacgucaaaaacgccgaacuccuuaacaaccaauucggaaccaugcccucacucacucucgcaugccucaccaagcaaggccagguagaccucaacgacgccguccaagcacuaaccgaccucggacuuaucuacaccgccaaauacccaaacagcuccgaucucgaccgccucucccaaaaccaccccauccuaaacaugauagacacaaagaaauccagccuuaacauaaguggguacaacuucagccucggcgccgccguaaaagcgggagccugcauguuagacggaggcaacaugcucgaaacaauaaaagucuccccacaaaccauggacgggauccucaaaucaauacucaaagucaaaagaucacuaggaauguuugucagcgacacccccggcgaacgcaaccccuacgaaaacauucucuacaaaaucugccuaucaggggauggauggcccuacguagccagcagaaccagcauaaucggccgugccugggagaacaccguaguagaccucgaaagcgacagcaaaccccaacgcccgggcucaaaagaaagcaaccgaucucuccaaacagcaggcuucccagcaggccugaccuauucccaacuaaugacccugaaagauagcaugcuccaacucgaccccaaugccaagacauggauggacaucgaaggccggcccgacgaccccguagaaaucgcccucuaccaaccguccagcggcugcuacauccacuucuuccgagaaccaacagacuuaaaacaauucaagcaagacgccaaauacagccacggcaucgacaugggagaucucuucgccgcacaacccggacucaccucagccguaaucgaagcucucccccgcaacauggucauaaccugccaaggcagcgaagacaucaaacgacuccucgaaucacaagggcgccgcgacauacgccuggucgacaucucucuaucaaaagcagacucgcgaaaguucgaaaacgccgucugggaccaauucaaagaccuaugcaacaugcacaccggagucguaguagaaaagaaaaagaaaggcggcaaagaagagaucacaccccacugcgcccucauggacugcauaauguucgacgccgccguaaugggcggacuagacgcuaaaguacuccgagccguccuaccaaaagacauggucuuccgaacgucaaccccgcgcguaguccucuga

SEQ ID NO: 3369 - RNA, 1710 nt, Artificial Sequence
  derived and/or modified CDS sequence (opt11) from Lassa virus__ANH09739__NP
augagcgcaagcaaagaaguaaaauccuuccucuggacccaaucacucaggcgagaacucuccggcuauugcucuaacauaaaacuacaggucgucaaagacgcccaagcacuccuacacgggcucgacuucucagaagucagcaacauccaacgccuaaugcguaaagaacgacgagacgacagcgaccucaaacgacugcgcgaccucaaccaagcggucaacaaccuagucgagcuaaaaagcacccaacagaaaucaguacuccgcgugggaacacuaagcucagacgaccuccugacgcucgccgcagaccuagaaaagcuaaaaucaaaagucauccgaacagagcgaccccucucaagcggaguauacaugggaaaccucagcacacaacagcuagaccaacggcgcgcccuccucaacaugauaggaaugacaucaggaggacaaggcgcuaacgcaggcagagacgguauaguccgaguaugggacgucaagaacgcagaacuucucaacaaccaauucggcaccaugccaucccuuacccuagccugccuaaccaaacaaggccaaguagaccucaacgacgccguucaagcucucaccgaccuaggccucauauacacagccaaauacccaaacuccuccgaccuagaccgccucagccaaaaccacccaauccuaaacaugaucgauacaaaaaaauccagccucaauaucuccggcuacaacuucucacucggcgccgccguaaaagccggcgccugcaugcuagacggaggcaacaugcuagaaacaauaaaagucagcccccaaacaauggacggcauccucaaauccauacucaaagucaaacgaagccuaggcauguucgucagcgacacaccaggugaacgcaaccccuacgaaaacauccuguacaaaaucugccucuccggcgacggcuggcccuacguagcaucccgcaccuccauaaucggccgagccugggaaaacaccguaguagaccucgaauccgacuccaaaccccaacgacccggcucaaaagaguccaaccgaucacuccaaacagccggauuucccgccggccuaaccuacucccaacucaugacccucaaagacuccaugcuccaacucgacccaaacgcaaaaaccuggauggacaucgaaggccgcccagacgacccagucgaaauugcccucuaccaaccauccucgggcugcuacauacacuucuuccgggaaccgaccgaucucaaacaauucaaacaggacgcaaaauacagucacggaauagacaucggcgaccucuucgcagcacaaccaggacucaccuccgcagucauugaagcacucccccgcaacauggucauaacaugccaaggaagcgaagacaucaaacgccuccuagaaucccaaggcagacgcgacaucagacucguugacaucucacucuccaaagcagauucgcgcaaauucgaaaacgcagucugggaccaauucaaagaccucuguaacaugcacaccggagucguagucgaaaaaaaaaaaaaagguggcaaagaagagauaacaccacacugcgcccuaauggacugcauaauguucgacgccgcagucauggguggccuagacgcaaaaguacucagagcaguccuccccaaagacauggucuuccgcacgagcacaccaagagucguacuauaa

SEQ ID NO: 3370 - RNA, 1710 nt, Artificial Sequence
  derived and/or modified CDS sequence (opt11) from Lassa virus__ANH09741__NP
auguccaacuccaaagaaguaaaauccuuccucuggacccaaucccugcgucgcgaacucagcggauacugcaccaacauuaaacuccaagucguaaaagacgcccaagcccuccugcacggacuagacuucuccgaagucuccaacguccaaagacuaaugcgaaaacaaaaacgagaugacaacgaccucaaacgcuuacgggaccucaaccaagccgucaacaaccucgucgaacuuaaauccguacaacaaaaaucggugcuuaaaguaggaacccucaacuccgacgaccuccucacgcucgccgcagaccucgagaaacuaaaaucaaagguaguccgcacagaaagaccccucuccuccggagucuacauggguaaccucuccucucaacagcucgaccagcgacgcgcccuccuaaacaugauuggcauggcuggaggcagccaaggcaaccagcccucacgagacggcgucguacgagucugggacgucaagaaugcagaccuacuaaacaaccaauucgguacaaugccaagucuaacacuagcaugccucaccaaacaaggacaaguagaccuaaacgacgucguacuagcgcucacagaccuaggccuaaucuacaccgcuaaguacccaaacuccagcgaccuagacagacucucgcagaaucaccccguccucaacaugaucgacguaaacaagagcagccuaaacauaagcggcuacaauuucagccuuggcgccgcagucaaagccggagccugcaugcuugacggcggcaacaugcuagaaaccaucaagaucucaccacaaaccguagacggcauucucaaaucaauccuaaaagucaaacgcgcacucggaauguucguuagcgacacccccggcgagagaaacccauacgagaacauccucuacaaagucugccucucuggcaacggcuggcccuauauagcaucccgaacaaguaucguaggacgcgccugggagaacaccgucguggaccucgagagcaacaaaaaccaacccaaaguaggaaacaauggauccaacaaaaugcuacaaagcucaggcuucgccaccggacuaaccuacagccaacuaaugacccuacgcgacagcaugcuccagcuagauccaacggccaaaacauggauagacaucgaaggccgccccgaagaccccgucgaacucgcccuauuccaacccuccucaggcugcuacauucacuucuuccgcgaacccaccgaccucaagcaauucaaacaagacgcuaaauacucccacggcaucgacgucaacgaccuauuuucagcacaaccuggccucaccuccgccguacucgaggcccucccccgcaacaugguccugaccugccaaggaagcgacgacaucagaaaacuccucgacagccaagaccgcaaagacaucaaacucaucgauauaucacucucaaaagccgacgcccgaaaauucgaaaacgacguuugggaccaguucaaggaccugugccacaugcacacuggcauaguagucgaaaagaaaaagaaaggcggcaaacaagaaaugaccccacacugcgcccuacuggacuguaucauguucgacgccgccguaagcggcggacuaaacguccccacccuaagagccguccuaccgaccgacaugguauuccgcacaauaaccacaaaagucguccuguga

SEQ ID NO: 3371 - RNA, 1713 nt, Artificial Sequence
  derived and/or modified CDS sequence (opt11) from Lassa virus__CAA36646__NP
augagcgcgagcaaagaaguacgauccuuccuauggacccaaucacuccgccgugaacuauccggauauugcucgaacaucaaacuacaagucgucaaagacgcacaagcacuacuacacgggcuugauuucucagaagucagcaacguacagcgccuaaugcggaaacagaagcgggacgacggcgaccucaaacgucuacgcgaccucaaccaagcagucaacaacuuagucgaacucaaauccacccaacaaaaaucgguccuccgcguaggcacccuaucaagcgacgaccugcucauacuugccgcagaccucgaaaaacuaaaaucgaaaguaacccgcacagaacguccacucucauccggcguauacaugggcaaccuaucuucgcaacaacuugaccaaaggcgggcccuccucaacaugaucggaaugacaggcgucagcggaggcggaaaaggagccucagacggcauaguacgcguaugggacgucaaaaacgcggaacugcuaaacaaccaauucggaaccaugccgucacuuacgcuagcaugccuaaccaagcagggacaaguagaccuaaacgacgccguacaagcacucaccgaccucggacucaucuacacagcgaaauacccaaacucaucagaccucgacagacucucucaaucgcaccccauucugaacaugauagacacaaagaaaucaucucuuaacauaucaggauacaacuucucccuaggggcugccguaaaagccggggcaugcaugcuagacggcgggaacaugcucgaaacaaucaaagucagcccccaaaccauggauggaauccuaaaaagcauccugaaagucaagaaaagccucggcauguucguaagcgacacccccggcgagcgaaaccccuacgaaaacauacuguacaaaauaugccucuccggcgacggauggcccuacaucgccaguagaacgucaauagugggccgcgcaugggaaaacaccgucgucgaccucgaacaagacaacaaaccccagaaaauaggcaacggcggaagcaacaaaucacuccaaagcgccggcuucgccgcaggccugaccuacagccaacuaaugacccucaaagacuucaaaugcuucaaccuaaucccaaaugcgaaaacuuggauggacaucgagggacgccccgaagaccccguagaaaucgcccuauaccaaccaucguccggaugcuacguccacuucuuccgagaacccaccgaccugaaacaauucaaacaagacgcgaaauacucgcaugggaucgacgucacggaccuguucgcagcccagcccggccuuaccuccgcggucauagaagcccucccccgcaacaugguaaucacaugccaaggaucggaagacauccgcaaacuucucgaaagccaaggaagacgcgacauaaaacuaauagacaucacccucagcaaagcagacucacgaaaauuugaaaacgccgucugggaucaauucaaagaccuaugccacaugcacaccggcgucgucguagaaaagaagaaacgcggaggcaaagaagaaauaacaccccacugcgcgcuaauggacugcauaauguucgacgcagccguaucuggcgggcucgacgccaaaguacugcgcgucguacuaccccgagacauggucuuccgcaccagcacccccaaaguaguacuauaa

SEQ ID NO: 3372 - RNA, 1710 nt, Artificial Sequence
  derived and/or modified CDS sequence (opt11) from Lassa virus__CCA30315__NP
augagcgcuucaaaagaagucaaauccuuccucuggacccaaucccuccgacgcgaacuaagcggcuacugcucgaacaucaaacuccaaguggucaaagacgcacaagcccuccuccacggccucgacuucuccgaagucagcaacguacaacgccucaugagaaaacagcgccgagacgacuccgaccucaaacgccugcgcgaccucaaccaggcuguaaacaaccuagucgaacuaaaaucaacccagcaaaaaucugucuuacgcgucggaacccucuccuccgacgaccuccugacccuagccgccgaccucgaaaaacuuaaauccaaaguaaccagaacugaacgcccucucucauccggagucuacauggggaaccucuccagccaacaacucgaccaacgccgugcccuacuaaaccucaucggcaugacaaacgguucacaaggaucccaagccggccgagauggcgucguucgcgucugggacgucaaaaacgccgaacuucucaacaaccaauucgguaccaugcccucacuaacccucgccugccucacaaaacaaggacaagucgaccucaacgacgucguccaagcccugacagaccuaggacucaucuacacagccaaauacccuaacacuucagaccucgaccgccucacccagucccacccaauucucaacaugauugacacuaaaaaguccagcuuaaacaucuccggcuacaacuucagccuaggcgccgcagucaaagcaggcgccugcaugcuagacggaggcaacaugcuagaaacaaucaaagucagcccccaauccauggacggcauccuuaaaucaauccuaaaagucaaacgcgcccuuggcauguucguaucagacacccccggagaacguaaccccuacgagaacauccucuacaaaauaugccuaagcggcgacggcuggcccuacaucgcgucgcgaaccucuaucgucggcagagccugggaaaacacagugguugaccucgaaacagauggaaaaccccagaaaaucggaucaggcaacagcaacaaaucccuacagucugcgggcuuuuccgccggacucacuuacagucaacucaugacccucaaagacgccaugcuacaacucgauccaaacgccaaaaccuggauggacaucgagggccgcccagaagacccaguagaggucgcacuauaccaacccaucuccggaugcuacauccacuucuuccgagaacccacagaccuaaaacaauucaaacaagacgcaaaguacucccacggcauagacauugccgaccucuucgcagcacaaccaggucucaccucugccguuaucgaggcccuccccagaaacauggucauaaccugccaaggcuccgaagacaucaaaaagcuccuagaaucacaaggacgcaaagacauaaaacuuauagacauagcacugucaaaaaucgacucacgcaaauucgaaaacgccgucugggaccaauacaaagaccugugccacaugcacaccggcguagucgucgagaaaaagaaacgcggcggcaaagaagaaaucaccccucacugcgcccucauggacugcaucauguucgacgcagcaguauccggaggccucaacacccuaguacucagagcuguucucccacgcgacauggucuuccguacaucaacaccccgagucguucucuaa

SEQ ID NO: 3373 - RNA, 1710 nt, Artificial Sequence
  derived and/or modified CDS sequence (opt11) from Lassa virus__JX985061__NP
auguccgccuccaaagaaaucaaauccuuucucuggacacaaucccuccgacgagaguuauccggcuacugcucgaauaucaaacuccaagucgucaaagacgcccaagcacucuuacacggccucgacuucuccgaagugucaaacguacaacgccuaaugcgaaaagaacgccgcgacgacaacgaccuaaaacgccuccgcgaccuaaaucaggccgucaacaaccucguagaacucaaaagcacccaacaaaagucgauccugcgcgucggcacacucacaucagacgaccuccucauccucgccgcagaccucgaaaaacuacgaucaaaggucauccgaaccgaaagaccccucuccgcaggcguauacaugggaaaccuaaguucccaacaacucgaccaaagacgagcgcuccuaaacaugaucggcauguccggcggaaaccaaggcgcccgcgcaggccgagacggggucgugcgcgugugggacgucaaaaacgcagaacuccucuccaaccaauucgguaccaucccaucgcuaacccucgccugccuaaccaaacaagggcaagucgaccucaaugacgccguacaagcccucacagacuuaggacuaauauacacagccaaauaccccaauacauccgaccucgaccgucuaacacaaucgcaccccauccucaacaugauagacacaaagaaaucaagccucaacauaagcggcuacaauuucucauuaggagccgcagucaaagcgggcgccugcaugcuagacggaggaaacaugcuggaaacaauaaaagucuccccacaaaccauggacggcaucuuaaaaucaauacucaaagucaagaaagcccucggcauguucauaucagacacacccggcgaaagaaacccauacgaaaacauccuguacaaaaucugccucucaggcgacggcuggcccuacaucgccucaagaaccuccaucaccggacgcgcgugggaaaacacgguggucgaccuagaaucagacggcaaaccacagaaagcagacucaaacaacagcucaaaaucccuccaauccgcaggcuucacagcuggccuaaccuacucccaacucaugacccucaaagacgcgaugcuccaacucgacccaaacgccaaaaccuggauggacauagagggccgacccgaagacccagucgaaaucgcccucuaccaacccagcucgggcugcuacauacacuuuuuccgcgaacccacagaccuaaaacaauucaaacaagacgccaaauacagccauggaaucgacguaaccgaccucuuugccacccaaccaggccuaaccucugccguaaucgacgcccuaccccggaacaugguaauaaccugccaaggcagcgacgacauccgcaaacuacuggaaucucaaggacgcaaagacaucaagcuaaucgauaucgaccugaguaaaaccgacucuagaaaauaugaaaacgcagucugggaccaauacaaagaccucugccacaugcacaccggcgucgucguagagaagaaaaagaggggugggaaagaagaaauaacaccccauugcgcucucauggacugcauaauguucgacgccgcaguaagcgggggccuaaacaccucaguccuaagagcgguccucccacgcgacauggucuuccgcacaucaaccccgagagucguccuuuga

SEQ ID NO: 3374 - RNA, 1710 nt, Artificial Sequence
  derived and/or modified CDS sequence (opt11) from Lassa virus__NP_694869__NP
augucagccagcaaagaaauaaaaucauuccucuggacacaaucacuccgccgcgaacucucaggguauugcucaaacauaaaacuccaaguagucaaagacgcccaagcccuccuacacggacuagacuucucagaaguaagcaacguccaacgccuaaugagaaaagaacgcagagacgacaacgaccucaagaggcucagagaccuuaaccaagcggucaacaaccuugucgaacucaaaagcacacaacagaaauccauacuacgagucggcacacuaaccagcgacgaccuccugauccucgcagccgaccucgagaaacuaaaaagcaaagucauccgaacagaaaggccccucuccgccggagucuacaugggaaaccuaagcucccaacaacucgaccaacggcgagcccuccucaacaugaucgggaugucgggcggcaaucagggcgcccgcgccggccgggacggcgucguacgagucugggacgucaaaaacgcagaacuccuuaacaaccaguucggcaccaugcccagccuaacacucgccugccugaccaaacaaggccaaguggaccucaacgacgcagugcaagcccucaccgaccuaggccugaucuacaccgcgaaauacccaaacaccuccgaccuagaccgccugacacaaucgcaccccauacucaacaugaucgacaccaaaaaaucuucgcuaaacaucucaggauacaacuucucccucggagccgcggucaaagcaggagccugcaugcuggacggcggaaauaugcuggaaaccauaaaaguaagcccccagaccauggacggcauccugaaaucaauccugaaagucaaaaaagcccuuggcauguucaucagcgauaccccgggcgaacgcaauccauacgaaaacauccuguacaaaauaugcuuaucaggcgacggcuggcccuacaucgcauccagaacuucgaucacaggccgagcaugggaaaacaccgucgucgaccuagaauccgacggcaaaccucaaaaagcggacagcaacaacucauccaaaagccuacaaucggcaggcuucaccgccggccucacguacucccaacucaugacccucaaagacgccaugcuacagcuagacccaaacgcaaaaaccuggauggacaucgaaggccggcccgaagaccccgucgaaaucgcucucuaccaaccaagcagcgguugcuacauacacuucuucagggaacccaccgaccucaagcaauucaaacaagacgcuaaauacucccacggaaucgacgugaccgaccucuucgcgacacagcccggccucaccagcgcaguaauugacgcacugccaagaaacaugguaauaacaugccaaggaagcgacgacauacgaaaacuccucgaaucacaaggacgcaaagacaucaaacucaucgacaucgcgcucuccaaaacggacagccgcaaauaugagaaugccguaugggaccaauacaaagaccucugccacaugcacaccggaguaguaguagaaaaaaaaaaaagaggagggaaagaagagauaaccccccacugcgccuuaauggauugcaucauguucgaugcagcagugagcggcggccucaacaccuccguccuccgagcaguccuuccgcgcgacaugguauucagaaccuccacaccaagagucguacucuaa

SEQ ID NO: 3375 - RNA, 1710 nt, Artificial Sequence
  derived and/or modified CDS sequence (opt11) from Lassa virus__SCA79106__NP
auguccaacuccaaagagguaaaaucauuccuuuggacucaaucacuccgccgcgagcucuccggcuacuguagcaacauaaaacuccaagucgucaaagaugcccaagcacuacuccacggccucgacuucuccgaagugagcaacguacaaaggcucaugcgcaaacaaaaacgcgacgacggcgaucuaaaacgccuccgcgaccucaaccaagccgucaacaacuuagucgagcuaaaaucuguccaacagaaaagcauccuccgaguugggacacuaacaucagacgaccuacucacccucgccgccgaccuagaaaaacucaaaagcaaagucacccgcaccgagcguccacucucuaguggcgucuacaugggcaaccugagcagccaacaacuugaccaacgccgcgcccugcuuuccaugaucggaauguccggcggcaaccaaaacagccaaccuaaaggagacggcguaguccgcgucugggacguaaagaacgccgaccugcuaaacaaccaauuuggaacaaugcccucacugacccucgccugccucacaaaacagggacaaguggaccugaacgaugccguccaagcccucaccgaccucggccugauauacaccgcaaaauaccccaacuccagcgaucuagacaggcuaucccaaucccaucccauacucaacaugauagacacaaagaaaucaucccucaacaucuccggauacaacuucucccucggagcagccaucaaaaccggagcaugcaugcuagacggcggcaacaugcuagagacaaucaagguaaccccucaaacaauggacggcauacuaaaauccauucuaaaaguaaagcgcagccucggcauguucaucagcgacacaccaggcgaacgcaaccccuaugaaaacauacuauauaaaaucugccucuccggcgacggauggcccuacaucgccucccgcacagccaucauuggccgagccugggaaaacaccgucguagaccuagagagcgacuccaaaccccagaaaaucggcaguaacggcucaaacaaaagccuccaaucagcaggauucgcccccggucucaccuauucccaacugaugacccuaaaggacucuaugcuacagcucgaccccaacgccaagaccuggaucgacauagaaggccgaccagaagauccaguagaagucgcccucuuccaacccaucucaggcugcuacauacacuucuucagagaaccuaccgaccuaaaacaguucaagcaagacgcaaaauacucccacggaauagacgucacggaccuuuucgcagcacaacccggccuaaccuccgccguaaucgaggcccucccccgcaacaugguacuaaccugccaagggagcgaugacaucaagaaacuccucgacucccaaggacgccgugacauaaaacuaaucgaugucucccucaacaaaauagauagccggaaauucgaaaacgccgucugggaccaauacaaagaccucugccacaugcacacaggcgucguagucgaaaagaaaaagaaagggggaaaagaagaaauuaccccacacugcgcacuacuagacugcauaauguucgacgccgcaguaucaggcggccuaaacgccaccguucugagggcaguucucccgcgcgacauggucuuccgcaccagcucaccuaaaguaguccuauga

SEQ ID NO: 3376 - DNA, 42 bp, Artificial Sequence
  5'-UTR of human ribosomal protein Large 32 lacking the 5' terminal oligopyrimidine tract
ggcgctgcctacggaggtggcagccatctccttctcggcatc

SEQ ID NO: 3377 - RNA, 42 nt, Artificial Sequence
  5'-UTR of human ribosomal protein Large 32 lacking the 5' terminal oligopyrimidine tract mRNA
ggcgcugccuacggagguggcagccaucuccuucucggcauc

SEQ ID NO: 3378 - DNA, 75 bp, Artificial Sequence
  5'-UTR of human mitochondrial ATP synthase subunit alpha lacking the 5' terminal oligopyrimidine tract
gcggctcggccattttgtcccagtcagtccggaggctgcggctgcagaagtaccgcctgcggagtaactgcaaag

SEQ ID NO: 3379 - RNA, 75 nt, Artificial Sequence
  5'-UTR of human mitochondrial ATP synthase subunit alpha lacking the 5' terminal oligopyrimidine tract mRNA
gcggcucggccauuuugucccagucaguccggaggcugcggcugcagaaguaccgccugcggaguaacugcaaag

SEQ ID NO: 3380 - DNA, 110 bp, Artificial Sequence
  3'-UTR of Homo sapiens hemoglobin, alpha 1 (HBA1)
gctggagcctcggtggccatgcttcttgccccttgggcctccccccagcccctcctccccttcctgcacccgtacccccgtggtctttgaataaagtctgagtgggcggc

SEQ ID NO: 3381 - RNA, 110 nt, Artificial Sequence
  3'-UTR of Homo sapiens hemoglobin, alpha 1 (HBA1) mRNA
gcuggagccucgguggccaugcuucuugccccuugggccuccccccagccccuccuccccuuccugcacccguacccccguggucuuugaauaaagucugagugggcggc

SEQ ID NO: 3382 - DNA, 108 bp, Artificial Sequence
  3'-UTR of Homo sapiens hemoglobin, alpha 2 (HBA2)
gctggagcctcggtagccgttcctcctgcccgctgggcctcccaacgggccctcctcccctccttgcaccggcccttcctggtctttgaataaagtctgagtgggcag

SEQ ID NO: 3383 - RNA, 108 nt, Artificial Sequence
  3'-UTR of Homo sapiens hemoglobin, alpha 2 (HBA2) mRNA
gcuggagccucgguagccguuccuccugcccgcugggccucccaacgggcccuccuccccuccuugcaccggcccuuccuggucuuugaauaaagucugagugggcag

SEQ ID NO: 3384 - DNA, 132 bp, Artificial Sequence
  3'-UTR of Homo sapiens hemoglobin, beta (HBB)
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 3385 - RNA, 132 nt, Artificial Sequence
  3'-UTR of Homo sapiens hemoglobin, beta (HBB) mRNA
gcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 3386 - DNA, 44 bp, Artificial Sequence
  Center, alpha-complex-binding portion of the 3'-UTR of an alpha-globin gene (muag)
gcccgatgggcctcccaacgggccctcctcccctccttgcaccg

SEQ ID NO: 3387 - RNA, 44 nt, Artificial Sequence
  Center, alpha-complex-binding portion of the 3'-UTR of an alpha-globin gene (muag) mRNA
gcccgaugggccucccaacgggcccuccuccccuccuugcaccg

SEQ ID NO: 3388 - DNA, 186 bp, Artificial Sequence
  3'-UTR of human albumin
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 3389 - RNA, 186 nt, Artificial Sequence
  3'-UTR of human albumin mRNA
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucu

SEQ ID NO: 3390 - DNA, 186 bp, Artificial Sequence
  3'-UTR albumin7
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 3391 - RNA, 186 nt, Artificial Sequence
  3'-UTR albumin7 mRNA
caucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 3392 - DNA, 187 bp, Artificial Sequence
  3'-UTR ALB7
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 3393 - RNA, 187 nt, Artificial Sequence
  3'-UTR ALB7 mRNA
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 3394 - DNA, 24 bp, Artificial Sequence
  histone stem-loop sequence (histoneSL, hSL)
caaaggctcttttcagagccacca

SEQ ID NO: 3395 - RNA, 24 nt, Artificial Sequence
  histone stem-loop sequence (histoneSL, hSL) mRNA
caaaggcucuuuucagagccacca

SEQ ID NO: 3396 - DNA, 13 bp, Artificial Sequence
  Kozak
gccgccaccatgg

SEQ ID NO: 3397 - RNA, 13 nt, Artificial Sequence
  Kozak mRNA
gccgccaccaugg

SEQ ID NO: 3398 - protein, 15 aa, Artificial Sequence
  derived and/or modified protein sequence (wt) from Clostridium tetani__WP_023439719__P2 helper peptide
QYIKANSKFIGITEL

SEQ ID NO: 3399 - protein, 24 aa, Artificial Sequence
  derived and/or modified protein sequence (wt) from Homo sapiens__AAA59606__signal peptide-HLA-A2-SP
MAVMAPRTLVLLLSGALALTQTWA

SEQ ID NO: 3400 - protein, 23 aa, Artificial Sequence
  derived and/or modified protein sequence (wt) from Homo sapiens__AAA61213__signal peptide-HsPLAT
MDAMKRGLCCVLLLCGAVFVSPS

SEQ ID NO: 3401 - protein, 21 aa, Artificial Sequence
  derived and/or modified protein sequence (wt) from Homo sapiens__AAA61213__signal peptide-HsPLAT
MDAMKRGLCCVLLLCGAVFVS

SEQ ID NO: 3402 - protein, 22 aa, Artificial Sequence
  derived and/or modified protein sequence (wt) from Homo sapiens__AAA61213__signal peptide-HsPLAT
MDAMKRGLCCVLLLCGAVFVSP

SEQ ID NO: 3403 - protein, 27 aa, Artificial Sequence
  derived and/or modified protein sequence (wt) from Homo sapiens__NP_000790__signal peptide-HsEPO
MGVHECPAWLWLLLSLLSLPLGLPVLG

SEQ ID NO: 3404 - protein, 18 aa, Artificial Sequence
  derived and/or modified protein sequence (wt) from Homo sapiens__NP_000468__signal peptide-HsALB
MKWVTFISLLFLFSSAYS

SEQ ID NO: 3405 - protein, 18 aa, Artificial Sequence
  derived and/or modified protein sequence (wt) from Homo sapiens__AAB59424__signal peptide-IgE
MDWTWILFLVAAATRVHS

SEQ ID NO: 3406 - protein, 24 aa, Artificial Sequence
  derived and/or modified protein sequence (wt) from Homo sapiens__NP_055022__signal peptide-HsCD5
MPMGSLQPLATLYLLGMLVASCLG

SEQ ID NO: 3407 - protein, 20 aa, Artificial Sequence
  derived and/or modified protein sequence (wt) from Homo sapiens__NP_000577__signal peptide-HsIL2
MYRMQLLSCIALSLALVTNS

SEQ ID NO: 3408 - protein, 18 aa, Artificial Sequence
  derived and/or modified protein sequence (wt) from Homo sapiens__NP_001020371 __signal peptide-HsCTRB2
MAFLWLLSCWALLGTTFG

SEQ ID NO: 3409 - protein, 19 aa, Artificial Sequence
  derived and/or modified protein sequence (wt) from Homo sapiens__BAC87457__signal peptide-immunoglobulin (IgG heavy chain)
MEFGLSWVFLVALFRGVQC

SEQ ID NO: 3410 - protein, 19 aa, Artificial Sequence
  derived and/or modified protein sequence (wt) from Homo sapiens__AAA52897__signal peptide-human immunoglobulin heavy chain
MDWTWRVFCLLAVTPGAHP

SEQ ID NO: 3411 - protein, 19 aa, Artificial Sequence
  derived and/or modified protein sequence (wt) from Homo sapiens__AAA59018__signal peptide-human immunoglobulin light chain
MAWSPLFLTLITHCAGSWA

SEQ ID NO: 3412 - protein, 17 aa, Artificial Sequence
  derived and/or modified protein sequence (wt) from Gaussia princeps__AAG54095__signal peptide-GpLuc
MGVKVLFALICIAVAEA

SEQ ID NO: 3413 - protein, 21 aa, Artificial Sequence
  derived and/or modified protein sequence (wt) from Mus musculus__BAR42292__signal peptide-MmIgkappa
METDTLLLWVLLLWVPGSTGD

SEQ ID NO: 3414 - protein, 26 aa, Artificial Sequence
  derived and/or modified protein sequence (wt) from Nepenthes rafflesiana__ABF74624__signal peptide-NrChit1
MKTHYSSAILPILTLFVFLSINPSHG

SEQ ID NO: 3415 - protein, 21 aa, Artificial Sequence
  derived and/or modified protein sequence (wt) from Conus leopardus__AAS93426__signal peptide-ClLp1.1
MGMRMMFIMFMLVVLATTVVS

SEQ ID NO: 3416 - protein, 24 aa, Artificial Sequence
  derived and/or modified protein sequence (wt) from Nepenthes gracilis__AB114914__signal peptide-NgNep1
MASSLYSFLLALSIVYIFVAPTHS

SEQ ID NO: 3417 - protein, 19 aa, Artificial Sequence
  derived and/or modified protein sequence (wt) from Homo sapiens__NP_001691__signal peptide-HsAzu1
MTRLTVLALLAGLLASSRA

SEQ ID NO: 3418 - protein, 16 aa, Artificial Sequence
  derived and/or modified protein sequence (wt) from Homo sapiens__AAA51948__signal peptide-HsCD33
MPLLLLLPLLWAGALA

SEQ ID NO: 3419 - protein, 19 aa, Artificial Sequence
  derived and/or modified protein sequence (wt) from Vibrio cholerae__BAA06291__signal peptide-VcCtxB
MIKLKFGVFFTVLLSSAYA

SEQ ID NO: 3420 - protein, 20 aa, Artificial Sequence
  derived and/or modified protein sequence (wt) from Homo sapiens__NP_001890__signal peptide-HsCST4
MARPLCTLLLLMATLAGALA

SEQ ID NO: 3421 - protein, 24 aa, Artificial Sequence
  derived and/or modified protein sequence (wt) from Homo sapiens__AAA59172__signal peptide-HsIns-iso1
MALWMRLLPLLALLALWGPDPAAA

SEQ ID NO: 3422 - protein, 17 aa, Artificial Sequence
  derived and/or modified protein sequence (wt) from Homo sapiens__CAA68724__signal peptide-HsSPARC
MRAWIFFLLCLAGRALA

SEQ ID NO: 3423 - protein, 17 aa, Artificial Sequence
  derived and/or modified protein sequence (wt) from Inluenza A__ACQ45338__signal peptide-H1N1(Netherlands2009)-HA
MKAILVVLLYTFATANA

SEQ ID NO: 3424 - protein, 46 aa, Artificial Sequence
  derived and/or modified protein sequence (wt) from Influenza virus____Transmembrane domain of HA
KLESTRIYQILAIYSTVASSLVLVVSLGAISFWMCSNGSLQCRICI

SEQ ID NO: 3425 - protein, 17 aa, Artificial Sequence
  derived and/or modified protein sequence (wt) from Human immunodeficiency virus 1__BAF32550__Transmembrane domain of Env
LILGLVIICNASNNLWV

SEQ ID NO: 3426 - protein, 22 aa, Artificial Sequence
  derived and/or modified protein sequence (wt) from Human immunodeficiency virus 1__BAF32550__Transmembrane domain of Env
GIGAMIFGFLGAAGSTMGAASI

SEQ ID NO: 3427 - protein, 23 aa, Artificial Sequence
  derived and/or modified protein sequence (wt) from Human immunodeficiency virus 1__BAF32550__Transmembrane domain of Env
LWYIRLFIMIVGGLIGLRIIFAV

SEQ ID NO: 3428 - protein, 23 aa, Artificial Sequence
  derived and/or modified protein sequence (wt) from Equine infectious anemia virus__AAC03762__Transmembrane domain of Env
AIVAAIVAATAIAASATMSYVAL

SEQ ID NO: 3429 - protein, 23 aa, Artificial Sequence
  derived and/or modified protein sequence (wt) from Equine infectious anemia virus__AAC03762__Transmembrane domain of Env
WIPGLGASIIKYIVMFLLIYLLL

SEQ ID NO: 3430 - protein, 22 aa, Artificial Sequence
  derived and/or modified protein sequence (wt) from Equine infectious anemia virus__AAC03762__Transmembrane domain of Env
LFWGLVIIVGRIAGYGLRGLAV

SEQ ID NO: 3431 - protein, 23 aa, Artificial Sequence
  derived and/or modified protein sequence (wt) from Murine leukemia virus__AAA46526__Transmembrane domain of Env
WFTTLISTIMGPLIVLLLILLLG

SEQ ID NO: 3432 - protein, 23 aa, Artificial Sequence
  derived and/or modified protein sequence (wt) from Mouse mammary tumor virus__BAA03768__Transmembrane domain of Env
FVAAIILGISALIAIITSFAVAT

SEQ ID NO: 3433 - protein, 23 aa, Artificial Sequence
  derived and/or modified protein sequence (wt) from Mouse mammary tumor virus____Transmembrane domain of Env
YFIFIGVGALLLVIVLMIFPIVF

SEQ ID NO: 3434 - protein, 23 aa, Artificial Sequence
  derived and/or modified protein sequence (wt) from Vesicular stomatitis virus__CAA24525__Transmembrane domain of G protein
AVIIGFVILMFLIKLIGVLSSLF

SEQ ID NO: 3435 - protein, 20 aa, Artificial Sequence
  derived and/or modified protein sequence (wt) from Rabies virus__AEV43288__Transmembrane domain of G protein
VLMGAGVLTALMLMIFLMTC

SEQ ID NO: 3436 - protein, 149 aa, Artificial Sequence
  derived and/or modified protein sequence (wt) from Woodchuck hepatitis virus__NP_671816__VLP forming subunit of WHcAg
DIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 3437 - protein, 221 aa, Artificial Sequence
  derived and/or modified protein sequence (wt) from Alfalfa mosaic virus__NP_041195__VLP forming subunit of CP
MSSSQKKAGGKAGKPTKRSQNYAALRKAQLPKPPALKVPVVKPTNTILPQTGCVWQSLGTPLSLSSFNGLGVRFLYSFLKDFAGPRILEEDLIYRMVFSITPSYAGTFCLTDDVTTEDGRAVAHGNPMQEFPHGAFHANEKFGFELVFTAPTHAGMQNQNFKHSYAVALCLDFDAQPEGSKNPSYRFNEVWVERKAFPRAGPLRSLITVGLLDEADDLDRH

SEQ ID NO: 3438 - protein, 9 aa, Artificial Sequence
  derived and/or modified protein sequence (artificial) from Artificial____peptide linker 1
GGGGSGGGG

SEQ ID NO: 3439 - protein, 14 aa, Artificial Sequence
  derived and/or modified protein sequence (artificial) from Artificial____peptide linker 2
GGGGSGGGGSGGGG

SEQ ID NO: 3440 - protein, 5 aa, Artificial Sequence
  derived and/or modified protein sequence (artificial) from Artificial____peptide linker 3
GSGSG

SEQ ID NO: 3441 - protein, 22 aa, Artificial Sequence
  derived and/or modified protein sequence (wt) from Foot-and-mouth disease virus____F2Amod1
VKQTLNFDLLKLAGDVESNPGP

SEQ ID NO: 3442 - protein, 22 aa, Artificial Sequence
  derived and/or modified protein sequence (wt) from Foot-and-mouth disease virus____F2Amod2
VKQTLNFDLLKLAGDVESNPGP

SEQ ID NO: 3443 - RNA, 66 nt, Artificial Sequence
  derived and/or modified CDS sequence (wt) from Foot-and-mouth disease virus____F2Amod1
gugaagcagacacucaauuucgaccuucugaaguuggcuggagauguugagucuaacccaggcccc

SEQ ID NO: 3444 - RNA, 66 nt, Artificial Sequence
  derived and/or modified CDS sequence (wt) from Foot-and-mouth disease virus____F2Amod2
gucaaacagaccuugaacuucgacuugcucaaacuggccggggauguggaguccaauccuggaccu

SEQ ID NO: 3445 - RNA, 671 nt, Artificial Sequence
  derived and/or modified CDS sequence (wt) from Encephalomyocarditis virus____EMCV-IRES-4
uugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuacc

SEQ ID NO: 3446 - RNA, 461 nt, Artificial Sequence
  derived and/or modified CDS sequence (wt) from Foot-and-mouth disease virus____FMDV-IRES
agcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccu

SEQ ID NO: 3447 - protein, 14 aa, Artificial Sequence
  carrier peptide 1
CRRRRRRRRRRRRC

SEQ ID NO: 3448 - protein, 13 aa, Artificial Sequence
  carrier peptide 2
CRRRRRRRRRRRR

SEQ ID NO: 3449 - protein, 14 aa, Artificial Sequence
  carrier peptide 3
WRRRRRRRRRRRRC

SEQ ID NO: 3450 - protein, 18 aa, Artificial Sequence
  carrier peptide 4
CHHHHHHRRRRHHHHHHC

SEQ ID NO: 3451 - protein, 99 aa, Artificial Sequence
  derived and/or modified protein sequence (wt) from Lassa virus__ADY11072__Z
MGNKQAKAPESKDSPRASLIPDATHLGPQFCKSCWFENKGLVECNNHYLCLNCLTLLLSVSNRCPICKMPLPTKLRPSAAPTAPPTGAADSIRPPPYSP

SEQ ID NO: 3452 - protein, 99 aa, Artificial Sequence
  derived and/or modified protein sequence (wt) from Lassa virus__AAO59514__Z
MGNKQVRSMKKVDSPRASLIPDASHLGPQFCKSCWFENRGLVECNNHYLCLNCLSLLLSVSSRCPICKMPLPTKLKTSTTPTAPSIREANTTSPPPYSP

SEQ ID NO: 3453 - protein, 99 aa, Artificial Sequence
  derived and/or modified protein sequence (wt) from Lassa virus__AAO59508__Z
MGNRQAKNPEVENSPRASLIPDATHLGPQFCKSCWFENKGLVECNNHYLCLNCLSLLLSVSNRCPICKMPLPTRLRPTTTPTAPQIIKENTTNPPPYTP

SEQ ID NO: 3454 - protein, 99 aa, Artificial Sequence
  derived and/or modified protein sequence (wt) from Lassa virus__AAO59510__Z
MGNKQTKAPEAKDSPRASLIPDATYLGPQFCKSCWFENKGLVECNNHYLCLNCLTLLLSVSNRCPICKMPLPTKLRPSAAPTAPPAGAAHSARPPPYSP

SEQ ID NO: 3455 - protein, 99 aa, Artificial Sequence
  derived and/or modified protein sequence (wt) from Lassa virus__AAT48997__Z
MGNKQAKAPETKNSPRASLIPDATHLGPQFCKSCWFENKGLVECNNHYLCLNCLTLLLSVSNRCPICKMPLPTKLRPSAVPTAPPAQVGDRTRPPPYSP

SEQ ID NO: 3456 - protein, 99 aa, Artificial Sequence
  derived and/or modified protein sequence (wt) from Lassa virus__AAT49005__Z
MGNKQAKAPETKDSPRASLIPDATHLGPQFCKSCWFENKGLVECNNHYLCLNCLTLLLSVSNRCPICKMPLPTRLRPSAVPTAPPAPAGDRTKPPPYSP

SEQ ID NO: 3457 - protein, 99 aa, Artificial Sequence
  derived and/or modified protein sequence (wt) from Lassa virus__ADU56612__Z
MGNRQTRPTEATEQSRAHLVPDASHLGPQFCKSCWFENRGLVECNNHYLCLNCLSLLLSVSSRCPICKMPLPTRLKASAQPSAPPTEAPQNTTPPPYTP

SEQ ID NO: 3458 - protein, 99 aa, Artificial Sequence
  derived and/or modified protein sequence (wt) from Lassa virus__ADU56616__Z
MGGKHTKQPRESNSPRASLIPDATHLGPQFCKSCWFENKGLVECNNHYLCLNCLSLLLSVSNRCPICKMPLPTRLRTSTNPTAPQVEQTGPASPPPYSP

SEQ ID NO: 3459 - protein, 99 aa, Artificial Sequence
  derived and/or modified protein sequence (wt) from Lassa virus__ADU56620__Z
MGGKHTKPQRESNSPRASLIPDATHLGPQFCKSCWFENKGLVECNNHYLCLNCLTLLLSVSNRCPICKMPLPTRLRASTNPTAPQVEQVGPTNPPPYSP

SEQ ID NO: 3460 - protein, 99 aa, Artificial Sequence
  derived and/or modified protein sequence (wt) from Lassa virus__ADU56624__Z
MGNRHAKSTKVDEHQRAHLVPDASHLGPQFCKSCWFENRGLVECNNHYLCLNCLSLLLSVSSRCPICKMPLPTKLKAAAQPSAPSTEAIQNTTPPPYTP

SEQ ID NO: 3461 - protein, 99 aa, Artificial Sequence
  derived and/or modified protein sequence (wt) from Lassa virus__ADU56628__Z
MGNRQAKSTKVDEHQRAHLVPDASHLGPQFCKSCWFENRGLVECNNHYLCLNCLSLLLSVSSRCPICKMPLPTKLKAAAQPSAPSTEAIQNTTPPPYAP

SEQ ID NO: 3462 - protein, 99 aa, Artificial Sequence
  derived and/or modified protein sequence (wt) from Lassa virus__ADU56632__Z
MGNRQAKSTKVDEHQRAHLVPDASHLGPQFCKSCWFENRGLVECNNHYLCLNCLSLLLSVSSRCPICKMPLPTKLKAAAQPSAPSTEATQDTTPPPYTP

SEQ ID NO: 3463 - protein, 99 aa, Artificial Sequence
  derived and/or modified protein sequence (wt) from Lassa virus__ADU56644__Z
MGNRQTKAPEAKGSPRASLIPDATHLGPQFCKSCWFENKGLVECNDHYLCLNCLTLLLSVSSRCPICKMPLPTRLRPSTNPTAPPARAEGGINPPPYSP

SEQ ID NO: 3464 - protein, 99 aa, Artificial Sequence
  derived and/or modified protein sequence (wt) from Lassa virus__AHC95545__Z
MGNKQAKDPKTESSPRASLIPDATHLGPQFCKSCWFENKGLVECNNHYLCLNCLSLLLSVSNRCPICKMPLPTKLKPITTPTAPQITRESITNPPPYTP

SEQ ID NO: 3465 - protein, 99 aa, Artificial Sequence
  derived and/or modified protein sequence (wt) from Lassa virus__AHC95547__Z
MGNRQAKDPKVESSPRASLIPDATHLGPQFCKSCWFENKGLVECNNHYLCLNCLSLLLSVSNRCPICKMPLPTRLRPTTMPTAPQIIKEGTTNPPPYTP

SEQ ID NO: 3466 - protein, 99 aa, Artificial Sequence
  derived and/or modified protein sequence (wt) from Lassa virus__AIT17124__Z
MGNKQVKTPEAKDSPRASLIPDATHLGPQFCKSCWFENKGLVECNNHYLCLNCLTLLLSVGNRCPICKMPLPTKLRPSVTPTAPPTRAADSIGPPPYSP

SEQ ID NO: 3467 - protein, 99 aa, Artificial Sequence
  derived and/or modified protein sequence (wt) from Lassa virus__AIT17128__Z
MGNKQAKTPEAKDSPRANLIPDATHLGPQFCKSCWFENKGLVECNNHYLCLNCLTLLLSVSNRCPICKMPLPTKLRPSAAPTAPPTGAADSIRPPPYSP

SEQ ID NO: 3468 - protein, 99 aa, Artificial Sequence
  derived and/or modified protein sequence (wt) from Lassa virus__AIT17132__Z
MGNKQAKAPEARDSPRASLIPDATHLGPQFCKSCWFENKGLVECNNHYLCLNCLTLLLSVSNRCPICKMPLPTKLRPSATPTAPPTEAADSIRPPPYRP

SEQ ID NO: 3469 - protein, 99 aa, Artificial Sequence
  derived and/or modified protein sequence (wt) from Lassa virus__AIT17136__Z
MGNKQTKAPESKNSPRASLIPDATYLGPQFCKSCWFENKGLVECNNHYLCLNCLTLLLSVSNRCPICKMPLPTKLRSSAAPTAPPTGAADSTKPPPYSP

SEQ ID NO: 3470 - protein, 99 aa, Artificial Sequence
  derived and/or modified protein sequence (wt) from Lassa virus__AIT17140__Z
MGNKQAKAPEPKDSPRASLIPDATHLGPQFCKSCWFENKGLVECNNHYLCLNCLTLLLSVSNRCPICKMPLPTKLRPSAAPTAPPAGAVDSTRPPPYSP

SEQ ID NO: 3471 - protein, 99 aa, Artificial Sequence
  derived and/or modified protein sequence (wt) from Lassa virus__AIT17144__Z
MGNKQAKTPESKDSPRASLIPDATHLGPQFCKSCWFENKGLVECNNHYLCLNCLTLLLGVSNRCPICKMPLPTKLRSSVAPTAPPTGAVDSIRPPPYSP

SEQ ID NO: 3472 - protein, 99 aa, Artificial Sequence
  derived and/or modified protein sequence (wt) from Lassa virus__AIT17152__Z
MGNKQAKTPETKDSPRASLIPDATHLGPQFCKSCWFENKGLVECNNHYLCLNCLTLLLSVSNRCPICKMPLPTKLRPSTAPTAPPAGAADNTRPPPYSP

SEQ ID NO: 3473 - protein, 99 aa, Artificial Sequence
  derived and/or modified protein sequence (wt) from Lassa virus__AIT17162__Z
MGNKQAKASESKDSPRASLIPDATHLGPQFCKSCWFENKGLVECNNHYLCLNCLTLLLSVSNRCPICKMPLPTKLRPSVTPTAPPTRTADNTRPPPYSP

SEQ ID NO: 3474 - protein, 99 aa, Artificial Sequence
  derived and/or modified protein sequence (wt) from Lassa virus__AIT17166__Z
MGNKQAKAPEAKDSPRASLIPDATHLGPQFCKSCWFETKGLVECNNHYLCLNCLTLLLSVSNRCPICKMPLPTKLRPSATPTAPPTEAADSIGPPPYSP

SEQ ID NO: 3475 - protein, 99 aa, Artificial Sequence
  derived and/or modified protein sequence (wt) from Lassa virus__AIT17170__Z
MGNKQAKVPESKDSPRASLIPDATHLGPQFCKSCWFENKGLVECNNHYLCLNCLTLLLSVSNRCPICKMPLPTKLRPSAAPTAPPAGAADSIRPPPYSP

SEQ ID NO: 3476 - protein, 99 aa, Artificial Sequence
  derived and/or modified protein sequence (wt) from Lassa virus__AIT17174__Z
MGNKQTKAPEAKGSPRASLIPDATHLGPQFCKSCWFENKGLVECNNHYLCLNCLTLLLSVSSRCPICKMPLPTKLRPSAVPTAPPTKAEDNTRPPPYSP

SEQ ID NO: 3477 - protein, 99 aa, Artificial Sequence
  derived and/or modified protein sequence (wt) from Lassa virus__AIT17178__Z
MGNKQAKASEAKDSPRASLIPDATHLGPQFCKSCWFENKGLVECNNHYLCLNCLSLLLSVSSRCPICKMPLPTRLRPSTAPTAPPARAGDNIKPPPYSP

SEQ ID NO: 3478 - protein, 99 aa, Artificial Sequence
  derived and/or modified protein sequence (wt) from Lassa virus__AIT17182__Z
MGNKQAKVPEVRDSPRASLIPDATHLGPQFCKSCWFENKGLVECNNHYLCLNCLTLLLSVSSRCPICKMPLPTKLRPSATPTAPPAGAGDGTRPPPYSP

SEQ ID NO: 3479 - protein, 99 aa, Artificial Sequence
  derived and/or modified protein sequence (wt) from Lassa virus__AIT17186__Z
MGNKQAKTPETKDSPRASLIPDATHLGPQFCKSCWFENKGLVECNNHYLCLNCLTLLLSVSNRCPICKMPLPTKLRPSVAPTAPPAGAADNTRPPPYSP

SEQ ID NO: 3480 - protein, 99 aa, Artificial Sequence
  derived and/or modified protein sequence (wt) from Lassa virus__AIT17194__Z
MGNKQAKAPEPKDSPRASLIPDATHLGPQFCKSCWFENKGLVECNNHYLCLNCLTLLLSVSNRCPICKMPLPTKLRPSVAPTAPPAGVVDSTRPPPYSP

SEQ ID NO: 3481 - protein, 99 aa, Artificial Sequence
  derived and/or modified protein sequence (wt) from Lassa virus__AIT17198__Z
MGNKQAKVPESKDSPRASLIPDATHLGPQFCKSCWFENRGLVECNNHYLCLNCLTLLLSVSNRCPICKMPLPTKLRPSTAPTAPPTGAADSTRPPPYSP

SEQ ID NO: 3482 - protein, 99 aa, Artificial Sequence
  derived and/or modified protein sequence (wt) from Lassa virus__AIT17202__Z
MGNKQAKTPESKDSPRASLIPDATHLGPQFCKSCWFENKGLVECNNHYLCLNCLTLLLSVSNRCPICKMPLPTRLRPSAAPTAPPSGAADSTRPPPYSP

SEQ ID NO: 3483 - protein, 99 aa, Artificial Sequence
  derived and/or modified protein sequence (wt) from Lassa virus__AIT17206__Z
MGNKQAKAPEAKDSPRASLIPDATHLGPQFCKSCWFENKGLVECNNHYLCLNCLTLLLSVSYRCPICKMPLPTKLRPSATPTAPPTEAADSIRPPPYRP

SEQ ID NO: 3484 - protein, 99 aa, Artificial Sequence
  derived and/or modified protein sequence (wt) from Lassa virus__AIT17214__Z
MGNKQAKAPEVKDSPRASLIPDATHLGPQFCKSCWFENKGLVECNNHYLCLNCLTLLLSVSNRCPICKMPLPTKLRPSAAPTAPPTGTADSIRPPPYSP

SEQ ID NO: 3485 - protein, 99 aa, Artificial Sequence
  derived and/or modified protein sequence (wt) from Lassa virus__AIT17222__Z
MGNKQAKTPETKDSPRASLIPDATHLGPQFCKSCWFENKGLVECNSHYLCLNCLTLLLSVSSRCPICKMPLPTRLRPSTAPTAPPAGVGDSTSPPPYSP

SEQ ID NO: 3486 - protein, 99 aa, Artificial Sequence
  derived and/or modified protein sequence (wt) from Lassa virus__AIT17226__Z
MGNKQAKTPEAKDSPRASLIPDATHLGPQFCKSCWFENKGLVECNNHYLCLNCLTLLLSVSNRCPICKMPLPTKLRPSATPTAPPAGAADSIGPPPYSP

SEQ ID NO: 3487 - protein, 98 aa, Artificial Sequence
  derived and/or modified protein sequence (wt) from Lassa virus__AIT17230__Z
MGNKQAKASDKNSPRASLIPDATHLGPQFCKSCWFENKGLVECNNHYLCLNCLTLLLSVSNRCPICKMPLPTKLRPSATPTAPPTGAADSIRPPPYSP

SEQ ID NO: 3488 - protein, 99 aa, Artificial Sequence
  derived and/or modified protein sequence (wt) from Lassa virus__AIT17234__Z
MGNKQAKASEEKNSPRASLIPDATHLGPQFCKSCWFENKGLVECNNHYLCLNCLTLLLSVSNRCPICKMPLPTKLRPSATPTAPPTGAADSIRPPPYSP

SEQ ID NO: 3489 - protein, 99 aa, Artificial Sequence
  derived and/or modified protein sequence (wt) from Lassa virus__AIT17238__Z
MGNKQTKAPEAKGSPRASLIPDATHLGPQFCKSCWFENKGLVECNNHYLCLNCLTLLLSVSNRCPICKMPLPTKLRPSATPTAPPTEAADSIRPPPYRP

SEQ ID NO: 3490 - protein, 99 aa, Artificial Sequence
  derived and/or modified protein sequence (wt) from Lassa virus__AIT17242__Z
MGNKQAKAPESKDSPRASLIPDATHLGPQFCKSCWFENKGLVECNNHYLCLNCLTLLLSVSNRCPICKMPLPTRLRPSAAPTAPPTGATDSTRPPPYSP

SEQ ID NO: 3491 - protein, 99 aa, Artificial Sequence
  derived and/or modified protein sequence (wt) from Lassa virus__AIT17248__Z
MGNKQVKAPEARNSPRASLIPDATHLGPQFCKSCWFENKGLVECNNHYLCLNCLTLLLGVSSRCPICKTPLPTRLRPSATPTAPPAGAGDNTRPPPYSP

SEQ ID NO: 3492 - protein, 99 aa, Artificial Sequence
  derived and/or modified protein sequence (wt) from Lassa virus__AIT17252__Z
MGNKQAKAPEAKDSPRASLIPDATHLGPQFCKSCWFENKGLVECNNHYLCLNCLTLLLSVSNRCPICKMPLPTKLRPSTAPTAPPAGAADSTRPPPYSP

SEQ ID NO: 3493 - protein, 99 aa, Artificial Sequence
  derived and/or modified protein sequence (wt) from Lassa virus__AIT17256__Z
MGNKQAKAPETKDSPRASLIPDATHLGPQFCKSCWFENKGLVECNNHYLCLNCLTLLLSVSNRCPICKMPLPTKLRPSAAPTAPPVGAADNTRPPPYSP

SEQ ID NO: 3494 - protein, 99 aa, Artificial Sequence
  derived and/or modified protein sequence (wt) from Lassa virus__AIT17260__Z
MGNKQAKAPELKDSPRASLIPDATHLGPQFCKSCWFENKGLVECNNHYLCLNCLTLLLSVSNRCPICKMPLPTKLRPSAAPTAPPAGAVDSTRPPPYSP

SEQ ID NO: 3495 - protein, 99 aa, Artificial Sequence
  derived and/or modified protein sequence (wt) from Lassa virus__AIT17268__Z
MGNKQTKAPEVKGSPRASLIPDATHLGPQFCKSCWFENKGLVECNNHYLCLNCLTLLLSVSNRCPICKMPLPTKLKPSTTPTAPPTGAADSIRPPPYSP

SEQ ID NO: 3496 - protein, 99 aa, Artificial Sequence
  derived and/or modified protein sequence (wt) from Lassa virus__AIT17272__Z
MGNKQVKTSEARDSPRASLIPDATDLGPQFCKSCWFENKGLVECNNHYLCLNCLTLLLSVSNRCPICKMPLPTRLRPSANPTAPPAETGDSTRPPPYSP

SEQ ID NO: 3497 - protein, 99 aa, Artificial Sequence
  derived and/or modified protein sequence (wt) from Lassa virus__AIT17278__Z
MGSKQTKTPEVKDSPRASLIPDATHLGPQFCKSCWFENKGLVECNNHYLCLNCLTLLLSVSNRCPICKMPLPTKLRPSAAPTAPPARAADDTRPPPYSP

SEQ ID NO: 3498 - protein, 99 aa, Artificial Sequence
  derived and/or modified protein sequence (wt) from Lassa virus__AIT17282__Z
MGNKQAKAPEPKDSPRASLIPDATHLGPQFCKSCWFENKGLVECNNHYLCLNCLTLLLSVSNRCPICKMPLPTKLRPSAAPTAPPAGAVDSIRPPPYSP

SEQ ID NO: 3499 - protein, 99 aa, Artificial Sequence
  derived and/or modified protein sequence (wt) from Lassa virus__AIT17286__Z
MGNKQTKAPEVKDSPRASLIPDATHLGPQFCKSCWFENKGLVECNNHYLCLNCLTLLLSVSNRCPICKMPLPTKLRPSTAPTAPPAGTMDSTRPPPYSP

SEQ ID NO: 3500 - protein, 99 aa, Artificial Sequence
  derived and/or modified protein sequence (wt) from Lassa virus__AIT17290__Z
MGNKQARAPEAKDSPRASLIPDATHLGPQFCKSCWFENKGLVECNNHYLCLNCLTLLLSVSSRCPICKMPLPTRLRPSAIPTAPPAGTGDSSRPPPYSP

SEQ ID NO: 3501 - protein, 99 aa, Artificial Sequence
  derived and/or modified protein sequence (wt) from Lassa virus__AIT17296__Z
MGNKQAKTPEIKDSPRASLIPDATHLGPQFCKSCWFENKGLVECNNHYLCLNCLTLLLSVSNRCPICKMPLPTKLRPSAAPTAPPAGAADITRPPPYSP

SEQ ID NO: 3502 - protein, 99 aa, Artificial Sequence
  derived and/or modified protein sequence (wt) from Lassa virus__AIT17300__Z
MGNKQVKAPEARNSPRASLIPDATHLGPQFCKSCWFENKGLVECNNHYLCLNCLTLLLGVSSRCPICKMPLPTRLRPSTAPTAPPAGAGDNTRPPPYSP

SEQ ID NO: 3503 - protein, 99 aa, Artificial Sequence
  derived and/or modified protein sequence (wt) from Lassa virus__AIT17312__Z
MGNKQAKTPETKDSPRASLIPDATHLGPQFCKSCWFENKGLVECNNHYLCLNCLTLLLSVSNRCPICKMPLPTKLRPSAAPTAPPVGAADSTRPPPYSP

SEQ ID NO: 3504 - protein, 99 aa, Artificial Sequence
  derived and/or modified protein sequence (wt) from Lassa virus__AIT17316__Z
MGNKQAKAPEARNSPRASLIPDATHLGPQFCKSCWFENRGLVECNNHYLCLNCLTLLLSVSSRCPICKMPLPTRLRPSAAPTAPPAGAGDNTRPPPYSP

SEQ ID NO: 3505 - protein, 99 aa, Artificial Sequence
  derived and/or modified protein sequence (wt) from Lassa virus__AIT17320__Z
MGNKQAKAPEARNSPRASLIPDATHLGPQFCKSCWFENKGLVECNNHYLCLNCLTLLLGVSSRCPICKMPLPTRLRPSAAPTAPLAEAGDNTRPPPYSP

SEQ ID NO: 3506 - protein, 99 aa, Artificial Sequence
  derived and/or modified protein sequence (wt) from Lassa virus__AIT17326__Z
MGNKQSKAPESRDSPRASLIPDATHLGPQFCKSCWFENKGLVECNNHYLCLNCLTLLLSVSNRCPICKMPLPTKLRPSATPTAPPTRAADSIRPPPYSP

SEQ ID NO: 3507 - protein, 99 aa, Artificial Sequence
  derived and/or modified protein sequence (wt) from Lassa virus__AIT17330__Z
MGNKQAKALESKNSPRASLIPDATYLGPQFCKSCWFENKGLVECNNHYLCLNCLTLLLSVSNRCPICKMPLPTKLRSSAAPTAPPTGAADGTKPPPYSP

SEQ ID NO: 3508 - protein, 99 aa, Artificial Sequence
  derived and/or modified protein sequence (wt) from Lassa virus__AIT17342__Z
MGNKQAKASEAKDSPRASLIPDATHLGPQFCKSCWFENKGLVECNNHYLCLNCLTLLLSVSNRCPICKMPLPTKLRPSTAPTAPQTGAADSIRPPPYSP

SEQ ID NO: 3509 - protein, 99 aa, Artificial Sequence
  derived and/or modified protein sequence (wt) from Lassa virus__AIT17346__Z
MGNKQAKAPETKDSPRASLIPDATHLGPQFCKSCWFENKGLVECNNHYLCLNCLTLLLSVSNRCPICKMPLPTKLRPSAAPTAPPVGAADSTRPPPYSP

SEQ ID NO: 3510 - protein, 99 aa, Artificial Sequence
  derived and/or modified protein sequence (wt) from Lassa virus__AIT17362__Z
MGNKQAKAPESKDSPRASLIPDATHLGPQFCKSCWFENKGLVECNNHYLCLNCLTLLLSVSNRCPICKMPLPTKLRPSAAPTAPPAGAADSIRPPPYSP

SEQ ID NO: 3511 - protein, 99 aa, Artificial Sequence
  derived and/or modified protein sequence (wt) from Lassa virus__AIT17366__Z
MGNKQTKTPEVKDSPRASLIPDATHLGPQFCKSCWFENKGLVECNNHYLCLNCLTLLLSVSNRCPICKMPLPTKLRPSAAPTAPPARAADDTRPPPYSP

SEQ ID NO: 3512 - protein, 99 aa, Artificial Sequence
  derived and/or modified protein sequence (wt) from Lassa virus__AIT17376__Z
MGNKQAKAPESKDSPRASLIPDATYLGPQFCKSCWFENKGLVECNNHYLCLNCLTLLLSVSNRCPICKMPLPTKLRSSVAPTAPPTRAADSTRPPPYSP

SEQ ID NO: 3513 - protein, 99 aa, Artificial Sequence
  derived and/or modified protein sequence (wt) from Lassa virus__AIT17382__Z
MGNKQTKTSEVKDSPRASLIPDATHLGPQFCKSCWFENKGLVECNNHYLCLNCLTLLLSVSNRCPICKMPLPTKLRPSAAPTAPPARAADDTRPPPYSP

SEQ ID NO: 3514 - protein, 99 aa, Artificial Sequence
  derived and/or modified protein sequence (wt) from Lassa virus__AIT17386__Z
MGNKQAKTPEARDSPRASLIPDATHLGPQFCKSCWFENKGLVECNNHYLCLNCLTLLLSVSSRCPICKMPLPTKLRPSATPTAPPAGAGDGTRPPPYSP

SEQ ID NO: 3515 - protein, 99 aa, Artificial Sequence
  derived and/or modified protein sequence (wt) from Lassa virus__AIT17396__Z
MGNKQVKAPEARNSPRASLIPDATHLGPQFCKSCWFENKGLVECNNHYLCLNCLTLLLGVSSRCPICKMPLPTRLRPSAAPTAPPAEAGDNTRPPPYSP

SEQ ID NO: 3516 - protein, 99 aa, Artificial Sequence
  derived and/or modified protein sequence (wt) from Lassa virus__AIT17402__Z
MGNRQAKSTKVDEHQRAHLVPDASHLGPQFCKSCWFENRGLVECNNHYLCLNCLSLLLSVSSRCPICKMPLPTKLKAAAQPSAPSTETIQNTTPPPYTP

SEQ ID NO: 3517 - protein, 99 aa, Artificial Sequence
  derived and/or modified protein sequence (wt) from Lassa virus__AIT17406__Z
MGNRQAKSSKVDEHQRAHLVPDASHLGPQFCKSCWFENKGLVECNNHYLCLNCLSLLLSVSSRCPICKMPLPTKLKAAAQPSAPSTEAVQNTAPPPYAP

SEQ ID NO: 3518 - protein, 99 aa, Artificial Sequence
  derived and/or modified protein sequence (wt) from Lassa virus__AIT17410__Z
MGNKQAKSTKVDEHQRAHLVPDASHLGPQFCKSCWFENRGLVECNNHYLCLNCLSLLLSVSSRCPICKMPLPTRLKAATQPSAPSTEATQNTTPPPYTP

SEQ ID NO: 3519 - protein, 99 aa, Artificial Sequence
  derived and/or modified protein sequence (wt) from Lassa virus__AIT17418__Z
MGNRQAKSTKVDEHQRAHLVPDASHLGPQFCKSCWFENRGLVECNNHYLCLNCLSLLLSVSSRCPICKMPLPTKLKAATQPSAPSTETIQNTTPPPYTP

SEQ ID NO: 3520 - protein, 99 aa, Artificial Sequence
  derived and/or modified protein sequence (wt) from Lassa virus__AIT17422__Z
MGNRQAKSAKVDEHQRAHLVPDASHLGPQFCKSCWFENRGLVECNNHYLCLNCLSLLLSVSSRCPICKMPLPTKLKAATQPSAPSTEATQNTTPPPYTP

SEQ ID NO: 3521 - protein, 99 aa, Artificial Sequence
  derived and/or modified protein sequence (wt) from Lassa virus__AIT17426__Z
MGNKQAKSTKVDEHQRAHLVPDASHLGPQFCKSCWFENRGLVECNNHYLCLNCLSLLLSVSSRCPICKMPLPTKLKAATQPSAPSTEATQNTTPPPYTP

SEQ ID NO: 3522 - protein, 99 aa, Artificial Sequence
  derived and/or modified protein sequence (wt) from Lassa virus__AIT17432__Z
MGNKQAKSTKVDEHQRAHLVPDASHLGPQFCKSCWFENRGLVECNNHYLCLNCLSLLLSVSSRCPICKMPLPTRLKAATQPSAPSTEATQNTIPPPYTP

SEQ ID NO: 3523 - protein, 99 aa, Artificial Sequence
  derived and/or modified protein sequence (wt) from Lassa virus__AIT17436__Z
MGNKQAKSTKADEHQRAHLVPDASHLGPQFCKSCWFENRGLVECNNHYLCLNCLSLLLSVSSRCPICKMPLPTKLKAATQPSAPSTEATRNTTPPPYTP

SEQ ID NO: 3524 - protein, 99 aa, Artificial Sequence
  derived and/or modified protein sequence (wt) from Lassa virus__AIT17444__Z
MGNRQAKSTKVDEHQRAHLVPDASHLGPQFCKSCWFENKGLVECNNHYLCLNCLSLLLSVSSRCPICKMPLPTKLKAAAQPSAPSTEAAQNTAPPPYAP

SEQ ID NO: 3525 - protein, 99 aa, Artificial Sequence
  derived and/or modified protein sequence (wt) from Lassa virus__AIT17448__Z
MGNRQAKSTKVGEHQRAHLVPDASHLGPQFCKSCWFENRGLVECNNHYLCLNCLSLLLSVSSRCPICKMPLPTKLKATAQPSAPSAEAIQNTTPPPYTP

SEQ ID NO: 3526 - protein, 99 aa, Artificial Sequence
  derived and/or modified protein sequence (wt) from Lassa virus__AIT17452__Z
MGNRQAKSTRVDEHQRAHLVPDASHLGPQFCKSCWFENRGLVECNNHYLCLNCLSLLLSVSSRCPICKMPLPTRLRAAVQPSAPSTETTQDTTPPPYSP

SEQ ID NO: 3527 - protein, 99 aa, Artificial Sequence
  derived and/or modified protein sequence (wt) from Lassa virus__AIT17456__Z
MGNRQAKSTEVNEHQRAHLVPDASHLGPQFCKSCWFENRGLVECNNHYLCLNCLSLLLSVSSRCPICKMPLPTKLKAATQPSAPSTEVTQNTVPPPYSP

SEQ ID NO: 3528 - protein, 99 aa, Artificial Sequence
  derived and/or modified protein sequence (wt) from Lassa virus__AIT17460__Z
MGNRQAKSTKVDEHQRAHLVPDASHLGPQFCKSCWFENRGLVECNNHYLCLNCLSLLLSVSSRCPICKMPLPTKLKAAAQPSAPPTEATQNTTPPPYTP

SEQ ID NO: 3529 - protein, 99 aa, Artificial Sequence
  derived and/or modified protein sequence (wt) from Lassa virus__AIT17468__Z
MGNRQAKQTKVDEHQRAHLVPDASHLGPQFCKSCWFENRGLVECNNHYLCLNCLSLLLSISSRCPICKMPLPTKLKAAAQPSAPSTEATQDTTPPPYTP

SEQ ID NO: 3530 - protein, 99 aa, Artificial Sequence
  derived and/or modified protein sequence (wt) from Lassa virus__AIT17472__Z
MGNKQTKSTKADEHQRAHLVPDASHLGPQFCKSCWFENRGLVECNNHYLCLNCLSLLLSVSSRCPICKMPLPTRLKAAAQPSAPSTEATQDTTPPPYTP

SEQ ID NO: 3531 - protein, 99 aa, Artificial Sequence
  derived and/or modified protein sequence (wt) from Lassa virus__AIT17476__Z
MGNRQAKSTKVDEHQRAHLVPDASHLGPQFCKSCWFENRGLVECNNHYLCLNCLSLLLSVSSRCPICKMPLPTKLKAAAQPSAPSAEAIQNTTPPPYTP

SEQ ID NO: 3532 - protein, 99 aa, Artificial Sequence
  derived and/or modified protein sequence (wt) from Lassa virus__AIT17480__Z
MGNRHAKSTKVDEHQRAHLVPDASHLGPQFCKSCWFENRGLVECNNHYLCLNCLSLLLSVSSRCPICKMPLPTKLKAAAQPSAPSTEVIQSTTPPPYTP

SEQ ID NO: 3533 - protein, 99 aa, Artificial Sequence
  derived and/or modified protein sequence (wt) from Lassa virus__AIT17484__Z
MGNRHAKSTKVDEHQRAHLVPDASHLGPQFCKSCWFENRGLVECNNHYLCLNCLSLLLSVSSRCPICKMPLPTKLKAAAQPSAPSTEEIQNTTPPPYTP

SEQ ID NO: 3534 - protein, 99 aa, Artificial Sequence
  derived and/or modified protein sequence (wt) from Lassa virus__AIT17488__Z
MGNRQAKPTKVDEHQRAHLVPDASHLGPQFCKSCWFENKGLVECNNHYLCLNCLSLLLSVSSRCPICKMPLPTKLKAAAQPSAPSTEAAQNTAPPPYAP

SEQ ID NO: 3535 - protein, 99 aa, Artificial Sequence
  derived and/or modified protein sequence (wt) from Lassa virus__AIT17496__Z
MGNRQAKSTKVDEHQRAHLVPDASHLGPQFCKSCWFENRGLVECNNHYLCLNCLSLLLSVSSRCPICKMPLPTRLKAATQPSAPSTEATQTTTPPPYTP

SEQ ID NO: 3536 - protein, 99 aa, Artificial Sequence
  derived and/or modified protein sequence (wt) from Lassa virus__AIT17500__Z
MGNRQTKSTKVDEHQRAHLVPDASHLGPQFCKSCWFENKGLVECNNHYLCLNCLSLLLSVSSRCPICKMPLPTKLKTAAQPSAPPTEAARTTAPPPYAP

SEQ ID NO: 3537 - protein, 99 aa, Artificial Sequence
  derived and/or modified protein sequence (wt) from Lassa virus__AIT17508__Z
MGNRQTKSTKVDEHQRAHLVPDASHLGPQFCKSCWFENKGLVECNNHYLCLNCLSLLLSVSSRCPICKMPLPTKLKAAAQPSAPSTEATQNTAPPPYAP

SEQ ID NO: 3538 - protein, 99 aa, Artificial Sequence
  derived and/or modified protein sequence (wt) from Lassa virus__AIT17512__Z
MGNRQAKSTKVYEHQRAHLVPDASHLGPQFCKSCWFENRGLVECNNHYLCLNCLSLLLSVSSRCPICKMPLPTRLKAATQPSAPSTEATQNTTPPPYTP

SEQ ID NO: 3539 - protein, 99 aa, Artificial Sequence
  derived and/or modified protein sequence (wt) from Lassa virus__AIT17516__Z
MGNRQAKSTKVDEHQRAHLVPDASHLGPQFCKSCWFENRGLVECNNHYLCLNCLSLLLSVSSRCPICKMPLPTKLKTATQPSAPLTEATQNTTPPPYTP

SEQ ID NO: 3540 - protein, 99 aa, Artificial Sequence
  derived and/or modified protein sequence (wt) from Lassa virus__AIT17520__Z
MGNKQAKSTKVDEHQRAHLVPDASHLGPQFCKSCWFENRGLVECNNHYLCLNCLSLLLSVSNRCPICKMPLPTKLKAAAQPSAPSTEATQNTTPPPYTP

SEQ ID NO: 3541 - protein, 99 aa, Artificial Sequence
  derived and/or modified protein sequence (wt) from Lassa virus__AIT17526__Z
MGNRQAKSAKVTEHQRAHLVPDASHLGPQFCKSCWFENKGLVECNNHYLCLNCLSLLLSVSSRCPICKMPLPTRLKAATQPSAPSAEAPQSTTPPPYTP

SEQ ID NO: 3542 - protein, 99 aa, Artificial Sequence
  derived and/or modified protein sequence (wt) from Lassa virus__AIT17536__Z
MGNRQTRPTEATEQSRAHLVPDASHLGPQFCKSCWFENKGLVECNNHYLCLNCLSLLLSVSSRCPICKMPLPTRLKASAQPSAPPTEAPQNKAPPPYTP

SEQ ID NO: 3543 - protein, 99 aa, Artificial Sequence
  derived and/or modified protein sequence (wt) from Lassa virus__AIT17542__Z
MGNRQVKSTKVDEHQRAHLIPDASHLGPQFCKSCWFENRGLVECNNHYLCLNCLSLLLSVSSRCPICKMPLPTKLEAAAQPSAPSTEATQDTTPPPYTP

SEQ ID NO: 3544 - protein, 99 aa, Artificial Sequence
  derived and/or modified protein sequence (wt) from Lassa virus__AIT17546__Z
MGNKQAKSTKVDEHQRAHLVPDASHLGPQFCKSCWFENRGLVECNNHYLCLNCLSLLLSVSSRCPICKMPLPTKLKAAAQPSAPSTETIQNTTPPPYTP

SEQ ID NO: 3545 - protein, 99 aa, Artificial Sequence
  derived and/or modified protein sequence (wt) from Lassa virus__AIT17550__Z
MGNRQAKQTKVDEHQRAHLVPDASHLGPQFCKSCWFENRGLVECNNHYLCLNCLSLLLSVSSRCPICKMPLPTKLKAAAQPSAPSTEITQNTTPPPYTP

SEQ ID NO: 3546 - protein, 99 aa, Artificial Sequence
  derived and/or modified protein sequence (wt) from Lassa virus__AIT17554__Z
MGNRQAKSTKADEHQRAHLVPDASHLGPQFCKSCWFENRGLVECNNHYLCLNCLSLLLSVSNRCPICKMPLPTRLKAAAQPSAPSTEATQDTTPPPYTP

SEQ ID NO: 3547 - protein, 99 aa, Artificial Sequence
  derived and/or modified protein sequence (wt) from Lassa virus__AIT17558__Z
MGNRQAKSTKVDEHQRAHLVPDASHLGPQFCKSCWFENRGLVECNNHYLCLNCLSLLLSVSSRCPICKMPLPTRLKAAAQPSAPSTEAIRSTTPPPYTP

SEQ ID NO: 3548 - protein, 99 aa, Artificial Sequence
  derived and/or modified protein sequence (wt) from Lassa virus__AIT17570__Z
MGNRQAKSAKVNEHQRAHLVPDASHLGPQFCKSCWFENRGLVECNNHYLCLNCLSLLLSVSSRCPICKMPLPTKLKAAAQPSAPSTEATQNITPPPYTP

SEQ ID NO: 3549 - protein, 99 aa, Artificial Sequence
  derived and/or modified protein sequence (wt) from Lassa virus__AIT17578__Z
MGNRQAKSTKVDEHQRAHLVPDASHLGPQFCKSCWFENKGLVECNNHYLCLNCLSLLLSVSSRCPICKMPLPTKLRAAAQPSAPSTESAQNTAPPPYAP

SEQ ID NO: 3550 - protein, 99 aa, Artificial Sequence
  derived and/or modified protein sequence (wt) from Lassa virus__AIT17586__Z
MGNKQAKSTKVDEHQRAHLVPDASHLGPQFCKSCWFENRGLVECNNHYLCLNCLSLLLSVSSRCPICKMPLPTRLKAAAQPSAPSTEVTQNTTPPPYTP

SEQ ID NO: 3551 - protein, 99 aa, Artificial Sequence
  derived and/or modified protein sequence (wt) from Lassa virus__AIT17590__Z
MGNRQAKSTKVDEHQRAHLVPDASHLGPQFCKSCWFENKGLVECNNHYLCLNCLSLLLSVSSRCPICKMPLPTKLEATTQPSAPSTEETQSTTPPPYTP

SEQ ID NO: 3552 - protein, 99 aa, Artificial Sequence
  derived and/or modified protein sequence (wt) from Lassa virus__AIT17602__Z
MGNKQAKSTKVDEYQRAHLVPDASHLGPQFCKSCWFENRGLVECNNHYLCLNCLSLLLSVSNRCPICKMPLPTRLKAAAQPSAPPTEATQNTTPPPYTP

SEQ ID NO: 3553 - protein, 99 aa, Artificial Sequence
  derived and/or modified protein sequence (wt) from Lassa virus__AIT17610__Z
MGNRQAKPTKVDEHQRAQLVPDASHLGPQFCKSCWFENRGLVECNNHYLCLNCLSLLLSVSSRCPICKMPLPTKLKAATQPSAPSTEATQNSTPPPYTP

SEQ ID NO: 3554 - protein, 99 aa, Artificial Sequence
  derived and/or modified protein sequence (wt) from Lassa virus__AIT17614__Z
MGNRQAKSTKVDEHQRAHLVPDASHLGPQFCKSCWFENRGLVECNNHYLCLNCLSLLLSVSSRCPICKMPLPTKLKAATQPSAPSTEATQNTTPPPYTP

SEQ ID NO: 3555 - protein, 99 aa, Artificial Sequence
  derived and/or modified protein sequence (wt) from Lassa virus__AIT17618__Z
MGNRQAKSTEVDEHQRAHLVPDASHLGPQFCKSCWFENRGLVECNNHYLCLNCLSLLLSVSNRCPICKMPLPTKLKAATQPSAPSTEATQNTTPPPYTP

SEQ ID NO: 3556 - protein, 99 aa, Artificial Sequence
  derived and/or modified protein sequence (wt) from Lassa virus__AIT17622__Z
MGNRQAKSTKVDEHQRAHLVPDASHLGPQFCKSCWFENRGLVECNNHYLCLNCLSLLLSVSSRCPICKMPLPTKLKAATQPSAPSTEVTQNTIPPPYSP

SEQ ID NO: 3557 - protein, 99 aa, Artificial Sequence
  derived and/or modified protein sequence (wt) from Lassa virus__AIT17628__Z
MGNKQAKSTKIDEHQRAHLVPDASHLGPQFCKSCWFENRGLVECNNHYLCLNCLSLLLSVSSRCPICKMPLPTRLKAATQPSAPSTEATQNTTPPPYTP

SEQ ID NO: 3558 - protein, 99 aa, Artificial Sequence
  derived and/or modified protein sequence (wt) from Lassa virus__AIT17632__Z
MGNRQAKSTKVDEHQRAHLVPDASHLGPQFCKSCWFENKGLVECNNHYLCLNCLSLLLSVSSRCPICKMPLPTKLRATAQPSAPSTEAIQNTTPPPYTP

SEQ ID NO: 3559 - protein, 99 aa, Artificial Sequence
  derived and/or modified protein sequence (wt) from Lassa virus__AIT17636__Z
MGNRQAKSTKVDEHQRAHLVPDASHLGPQFCKSCWFENRGLVECNNHYLCLNCLSLLLSVSSRCPICKMPLPTKLKAAAQPSAPSIETIQNTTPPPYTP

SEQ ID NO: 3560 - protein, 99 aa, Artificial Sequence
  derived and/or modified protein sequence (wt) from Lassa virus__AIT17640__Z
MGNRQAKSTKVGEHQRAHLVPDASHLGPQFCKSCWFENRGLVECNNHYLCLNCLSLLLSVSSRCPICKMPLPTKLKAAAQPSAPSTEATQDTTPPPYTP

SEQ ID NO: 3561 - protein, 99 aa, Artificial Sequence
  derived and/or modified protein sequence (wt) from Lassa virus__AIT17648__Z
MGNRQAKSTKVDEHQRAHLVPDASHLGPQFCKSCWFENKGLVECNNHYLCLNCLSLLLSVSSRCPICKMPLPTKLKATVQPSAPSTEAAQSTAPPPYAP

SEQ ID NO: 3562 - protein, 99 aa, Artificial Sequence
  derived and/or modified protein sequence (wt) from Lassa virus__AIT17652__Z
MGNRQAKSTKVGEHQRAHLVPDASHLGPQFCKSCWFENRGLVECNNHYLCLNCLSLLLSVSSRCPICKMPLPTKLKAAAQPSAPSAEAIQKTTPPPYTP

SEQ ID NO: 3563 - protein, 99 aa, Artificial Sequence
  derived and/or modified protein sequence (wt) from Lassa virus__AIT17656__Z
MGNRQAKSTKVDDHQRAHLVPDASHLGPQFCKSCWFENRGLVECNNHYLCLNCLSLLLSVSSRCPICKMPLPTKLKAAAQPSAPSTEAAQDTTPPPYTP

SEQ ID NO: 3564 - protein, 99 aa, Artificial Sequence
  derived and/or modified protein sequence (wt) from Lassa virus__AIT17660__Z
MGNRQAKSTKVDEHQRAHLVPDASHLGPQFCKSCWFENRGLVECNNHYLCLNCLSLLLSVSNRCPICKMPLPTKLKAAAQPSAPSTEAIQNTTPPPYAP

SEQ ID NO: 3565 - protein, 99 aa, Artificial Sequence
  derived and/or modified protein sequence (wt) from Lassa virus__AIT17664__Z
MGNKQAKSTKVDEHQRAHLVPDASHLGPQFCKSCWFENKGLVECNNHYLCLNCLSLLLSVSSRCPICKMPLPTKLKAAAQPSAPSTEAAQNTAPPPYAP

SEQ ID NO: 3566 - protein, 99 aa, Artificial Sequence
  derived and/or modified protein sequence (wt) from Lassa virus__AIT17668__Z
MGNRQAKSTKVDEHQRAHLVPDASHLGPQFCKSCWFENKGLVECNNHYLCLNCLSLLLSVSSRCPICKMPLPTKLKTTAQPSAPPTEAAKNTAPPPYAP

SEQ ID NO: 3567 - protein, 99 aa, Artificial Sequence
  derived and/or modified protein sequence (wt) from Lassa virus__AIT17676__Z
MGNRQAKSTKVDEHQRAHLVPDASHLGPQFCKSCWFENRGLVECNNHYLCLNCLSLLLSVSSRCPICKMPLPTKLKAATQPSAPSTEVTQNTTPPPYTP

SEQ ID NO: 3568 - protein, 99 aa, Artificial Sequence
  derived and/or modified protein sequence (wt) from Lassa virus__AIT17680__Z
MGNRQAKSTKIDEHQRAHLVPDASHLGPQFCKSCWFENRGLVECNNHYLCLNCLSLLLSVSSRCPICKMPLPTKLKAAAQPSAPSTEAIQNTTPPPYTP

SEQ ID NO: 3569 - protein, 99 aa, Artificial Sequence
  derived and/or modified protein sequence (wt) from Lassa virus__AIT17684__Z
MGNRQAKSAKVDEHQRAHLVPDASHLGPQFCKSCWFENKGLVECNNHYLCLNCLSLLLSVSCRCPICKMPLPTKLKAATQPSAPSTEATQNTTPPPYTP

SEQ ID NO: 3570 - protein, 99 aa, Artificial Sequence
  derived and/or modified protein sequence (wt) from Lassa virus__AIT17692__Z
MGNRHAKPTKVDEHQRAHLVPDASHLGPQFCKSCWFENRGLVECNNHYLCLNCLSLLLSVSSRCPICKMPLPTKLKAAAQPSAPSTEAIQNTTPPPYTP

SEQ ID NO: 3571 - protein, 99 aa, Artificial Sequence
  derived and/or modified protein sequence (wt) from Lassa virus__AIT17702__Z
MGNRHAKSTKVDEHQRAHLVPDASHLGPQFCKSCWFENRGLVECNNHYLCLNCLSLLLSVSSRCPICKMPLPTKLKAAAQPSAPSTEAFQNTTPPPYTP

SEQ ID NO: 3572 - protein, 99 aa, Artificial Sequence
  derived and/or modified protein sequence (wt) from Lassa virus__AIT17708__Z
MGNRHAKSTKVDEHQRAHLVPDASHLGPQFCKSCWFENRGLVECNNHYLCLNCLSLLLSVSSRCPICKMPLPTKLKAATQPSAPSTEAIQNTTPPPYTP

SEQ ID NO: 3573 - protein, 99 aa, Artificial Sequence
  derived and/or modified protein sequence (wt) from Lassa virus__AIT17716__Z
MGNRPAKSTKVDEHQRAHLVPDASHLGPQFCKSCWFENRGLVECNNHYLCLNCLSLLLSVSSRCPICKMPLPTKLKAAAQPSAPSTEATQNTTPPPYTP

SEQ ID NO: 3574 - protein, 99 aa, Artificial Sequence
  derived and/or modified protein sequence (wt) from Lassa virus__AIT17720__Z
MGNRQAKPTKVDEHQRAHLVPDASHLGPQFCKSCWFENRGLVECNNHYLCLNCLSLLLSVSSRCPICKMPLPTRLKAAAQPSAPSTEETQNTTPPPYTP

SEQ ID NO: 3575 - protein, 99 aa, Artificial Sequence
  derived and/or modified protein sequence (wt) from Lassa virus__AIT17730__Z
MGNRQAKSTKVDEHQRAHLVPDASHLGPQFCKSCWFENRGLVECNNHYLCLNCLSLLLSVSSRCPICKMPLPTKLKAAAQPSAPLTEAIQNTTPPPYTP

SEQ ID NO: 3576 - protein, 99 aa, Artificial Sequence
  derived and/or modified protein sequence (wt) from Lassa virus__AIT17734__Z
MGNRQAKSTKVDEHQRAHLVPDASHLGPQFCKSCWFENRGLVECNNHYLCLNCLSLLLSVSSRCPICKMPLPTKLKAAAQPSAPSTEAIQNTTPPPYTP

SEQ ID NO: 3577 - protein, 99 aa, Artificial Sequence
  derived and/or modified protein sequence (wt) from Lassa virus__AIT17738__Z
MGNRQAKSTKVDEHQRAHLVPDASHLGPQFCKSCWFENRGLVECNNHYLCLNCLSLLLSVSSRCPICKMPLPTKLKAATLPSAPSTEVTQNTTPPPHSP

SEQ ID NO: 3578 - protein, 99 aa, Artificial Sequence
  derived and/or modified protein sequence (wt) from Lassa virus__AIT17750__Z
MGNRQAKSAKVNEHQRAHLVPDASHLGPQFCKSCWFENRGLVECNNHYLCLNCLSLLLSVSSRCPICKMPLPTKLKAATQPSAPSTEATQNTTPPPYTP

SEQ ID NO: 3579 - protein, 99 aa, Artificial Sequence
  derived and/or modified protein sequence (wt) from Lassa virus__AIT17754__Z
MGNRQAKSTKVDEHQRAHLVPDASHLGPQFCKSCWFENKGLVECNNHYLCLNCLSLLLSVSSRCPICKMPLPTKLKASAQPSAPSTEAAQNTAPPPYAP

SEQ ID NO: 3580 - protein, 99 aa, Artificial Sequence
  derived and/or modified protein sequence (wt) from Lassa virus__AIT17760__Z
MGNRQAKSTRTDEHQRAHLVPDASHLGPQFCKSCWFENKGLVECNNHYLCLNCLSLLLSVSSRCPICKMPLPTKLKAAAQPSAPSTEAGQNTAPPPYAP

SEQ ID NO: 3581 - protein, 99 aa, Artificial Sequence
  derived and/or modified protein sequence (wt) from Lassa virus__AIT17768__Z
MGNRQAKSATVDECQRAHLVPDASYLGPQFCKSCWFENKGLVECNNHYLCLNCLSLLLSVSSRCPICKMPLPTKLKAAAQPSAPSTRATQNTTPPPYTP

SEQ ID NO: 3582 - protein, 99 aa, Artificial Sequence
  derived and/or modified protein sequence (wt) from Lassa virus__AIT17776__Z
MGNKQAKSTKVDEHQRAHLVPDASHLGPQFCKSCWFENKGLVECNNHYLCLNCLSLLLSVSSRCPICKMPLPTRLKAAAQPSAPSTEATQNAAPPPYAP

SEQ ID NO: 3583 - protein, 99 aa, Artificial Sequence
  derived and/or modified protein sequence (wt) from Lassa virus__AIT17780__Z
MGNRQTKSTKVDEHQRAYLVPDASLLGPQFCKSCWFENKGLVECNNHYLCLNCLSLLLSVSSRCPICKMPLPTRLKAAAQPSAPPTEAIQNTTPPPYTP

SEQ ID NO: 3584 - protein, 99 aa, Artificial Sequence
  derived and/or modified protein sequence (wt) from Lassa virus__AIT17784__Z
MGNRQTKPTKVDEHQRAHLVPDASHLGPQFCKSCWFENKGLVECNNHYLCLNCLSLLLSVSSRCPICKMPLPTKLKATAQPSAPSTEAAQNTAPPPYAP

SEQ ID NO: 3585 - protein, 99 aa, Artificial Sequence
  derived and/or modified protein sequence (wt) from Lassa virus__AIT17788__Z
MGNRQVKSTKVDEHQRAHLVPDASHLGPQFCKSCWFENRGLVECNNHYLCLNCLSLLLSVSSRCPICKMPLPTKLKAATQPSAPPTEATQKTTPPPYTP

SEQ ID NO: 3586 - protein, 99 aa, Artificial Sequence
  derived and/or modified protein sequence (wt) from Lassa virus__AIT17792__Z
MGNKQAKSTKVDEHQRAHLVPDASHLGPQFCKSCWFENRGLVECNNHYLCLNCLSLLLSVSGRCPICKMPLPTKLKATAQPSAPSTEATQNTTPPPYTP

SEQ ID NO: 3587 - protein, 99 aa, Artificial Sequence
  derived and/or modified protein sequence (wt) from Lassa virus__AIT17796__Z
MGNKQAKSTKVDEHQRAHLVPDASHLGPQFCKSCWFENRGLVECNNHYLCLNCLSLLLSVSSRCPICKMPLPTKLKAAAQPSAPSTEAIQNTTPPPYTP

SEQ ID NO: 3588 - protein, 99 aa, Artificial Sequence
  derived and/or modified protein sequence (wt) from Lassa virus__AIT17800__Z
MGNKQAKAPEAKDSPRASLIPDATHLGPQFCKSCWFENKGLVECNNHYLCLNCLTLLLSVSNRCPICKMPLPTKLRPSATPTAPPTEAADSIRPPPYHP

SEQ ID NO: 3589 - protein, 99 aa, Artificial Sequence
  derived and/or modified protein sequence (wt) from Lassa virus__AIT17804__Z
MGNKQAKASEEKNSPRASLIPDATHLGPQFCKSCWFENKGLVECNNHYLCLNCLTLLLSVSNRCPICKMPLPTKLRPSTTPTAPPTGAADSIRPPPYSP

SEQ ID NO: 3590 - protein, 99 aa, Artificial Sequence
  derived and/or modified protein sequence (wt) from Lassa virus__AIT17808__Z
MGNKQAKAPESKDSPRASLIPDATHLGPQFCKSCWFENKGLVECNNHYLCLNCLTLLLSVSNRCPICKMPLPTRLRPSAAPTAPPTGAADSTRPPPYSP

SEQ ID NO: 3591 - protein, 100 aa, Artificial Sequence
  derived and/or modified protein sequence (wt) from Lassa virus__AIT17834__Z
MGNKQTRSPPKPEHPRPTLLPDASHLGPQFCKSCWFENKGLVECNNHYLCLNCLTLLLSVSDRCPICKMPLPTKLAVRTQPSAPPLNQGNTQSSPPPYSP

SEQ ID NO: 3592 - protein, 99 aa, Artificial Sequence
  derived and/or modified protein sequence (wt) from Lassa virus__AIT17838__Z
MGNKQAKVPESKDSPRASLIPDATHLGPQFCKSCWFENKGLVECNNHYLCLNCLTLLLSVSNRCPICKMPLPTKLKPSAAPTAPPTGAADSIRPPPYSP

SEQ ID NO: 3593 - protein, 99 aa, Artificial Sequence
  derived and/or modified protein sequence (wt) from Lassa virus__AIT17842__Z
MGNKQAKVPESKDSPRASLIPDATHLGPQFCKSCWFENKGLVECNNHYLCLNCLTLLLSVSNRCPICKMPLPTKLRPSAAPTAPPTGVADSIRPPPYSP

SEQ ID NO: 3594 - protein, 99 aa, Artificial Sequence
  derived and/or modified protein sequence (wt) from Lassa virus__ANH09743__Z
MGNKQAKASEVEDGPRASLIPDATHLGPQFCKSCWFENKSLVECNNHYLCLNCLTLLLSVSNRCPICKMPLPTRLKPSVVPTAPPTRAGDGTRPPPYSP

SEQ ID NO: 3595 - protein, 99 aa, Artificial Sequence
  derived and/or modified protein sequence (wt) from Lassa virus__ANH09745__Z
MGNKQTKAPEVEDGPRASLIPDATHLGPQFCKSCWFENKGLVECNNHYLCLNCLTLLLSVSSRCPICKMPLPTRLKPSIVPTAPPARTGENTRPPPYSP

SEQ ID NO: 3596 - protein, 99 aa, Artificial Sequence
  derived and/or modified protein sequence (wt) from Lassa virus__ANH09749__Z
MGNKQAKAPEVEDGPRASLIPDATHLGPQFCKSCWFENRGLVECNNHYLCLNCLTLLLSVSNRCPICKMPLPTRLKPSVVPTAPPTGAGGDTRPPPYSP

SEQ ID NO: 3597 - protein, 99 aa, Artificial Sequence
  derived and/or modified protein sequence (wt) from Lassa virus__ANH09751__Z
MGNKQAKAPKAEDGPRASLIPDATHLGPQFCKSCWFENKGLVECNNHYLCLNCLTLLLSVSNRCPICKMPLPTRLKPSVVPTAPPTGAGGDTRPPPHSP

SEQ ID NO: 3598 - protein, 99 aa, Artificial Sequence
  derived and/or modified protein sequence (wt) from Lassa virus__ANH09753__Z
MGNKQAKASEAEDGPRASLIPDATHLGPQFCKSCWFENKGLVECNNHYLCLNCLTLLLSVSSRCPICKMPLPTRLRPSVVPTAPSAGAGDGTRPPPYSP

SEQ ID NO: 3599 - protein, 99 aa, Artificial Sequence
  derived and/or modified protein sequence (wt) from Lassa virus__ANH09755__Z
MGNKQTKTIKKTDSPRASLIPDASHMGPQFCKSCWFENRGLVECNNHYLCLNCLSLLLSVSNRCPICKMPLPTKLRASPSPTAPSIREANITNPPPYSP

SEQ ID NO: 3600 - protein, 99 aa, Artificial Sequence
  derived and/or modified protein sequence (wt) from Lassa virus__ANH09759__Z
MGNKQTKTTKKTDSPRASLIPDASHMGPQFCKSCWFENRGLVECNNHYLCLNCLSLLLSVSNRCPICKMPLPTKLRASPSPTAPSIREANITNPPPYSP

SEQ ID NO: 3601 - protein, 99 aa, Artificial Sequence
  derived and/or modified protein sequence (wt) from Lassa virus__ANH09761__Z
MGNKGTKPTQNSEPSRANLVPDASYLGPQFCKSCWFENKGLVECNNHYLCLNCLTMLLSVSNRCPICKMPLPTKIKASGSPSAPPTEANSAVSPPPYTP

SEQ ID NO: 3602 - protein, 99 aa, Artificial Sequence
  derived and/or modified protein sequence (wt) from Lassa virus__AMR44579__Z
MGARQTKQPQIEGSPRASLVPDASHLGPQFCKSCWFENKGLVECNNHYLCLNCLSLLLSVSNRCPICKMPLPTKLRVSSAPSAPPAATAQPGTPPPYSP

SEQ ID NO: 3603 - protein, 99 aa, Artificial Sequence
  derived and/or modified protein sequence (wt) from Lassa virus__AMZ00378__Z
MGNRQTKATEAKDSPRASLIPDATHLGPQFCKSCWFENKGLVECNNHYLCLNCLTLLLSVSSRCPICKMPLPTRLKSSTNPTAPSAKTESSINPPPYSP

SEQ ID NO: 3604 - RNA, 300 nt, Artificial Sequence
  derived and/or modified CDS sequence (wt) from Lassa virus__ADY11072__Z
augggaaacaagcaagccaaagccccagaaucaaaagacaguccgagagccagccugaucccagaugccacacaucuagggccacaguucuguaagagcugcugguucgaaaacaagggccugguugagugcaacaaccacuaucugugucucaacugccucaccuuacuucuaagugucagcaacaggugucccauuugcaagaugccucuccccacaaaacugagaccaucagccgcuccaacagcaccuccaaccggagcagcggacagcaucagacccccacccuacagucccuga

SEQ ID NO: 3605 - RNA, 300 nt, Artificial Sequence
  derived and/or modified CDS sequence (wt) from Lassa virus__AAO59514__Z
augggcaacaaacaagucagauccaugaagaaaguagacagcccaagggccaguuugauuccugaugcuucccacuuggguccucaauuuugcaaaagcugcugguuugaaaacagaggccugguugaaugcaacaaccauuaccucugccucaauugccucucauugcuccugagugucagcagcaggugucccauuugcaagaugccccuacccacaaagcucaagacauccaccacuccaacugcucccuccaucagagaggccaacaccacaagucccccaccauauagucccuaa

SEQ ID NO: 3606 - RNA, 300 nt, Artificial Sequence
  derived and/or modified CDS sequence (wt) from Lassa virus__AAO59508__Z
auggggaacagacaagccaaaaauccagagguggagaacagcccaagggcuagucuaauuccggaugccacgcaccuugggccacaguucugcaagagcugcugguucgaaaacaaagguuuaguugaguguaauaaccacuaucuuugccucaacugccucuccuugcuuuuaagcgucagcaacaggugcccuaucugcaagaugccccuucccacgaggcugagaccgacaaccacaccaacagcgccacagaucaucaaggaaaacaccaccaaccccccgccauacacacccuaa

SEQ ID NO: 3607 - RNA, 300 nt, Artificial Sequence
  derived and/or modified CDS sequence (wt) from Lassa virus__AAO59510__Z
augggaaacaagcaaaccaaagccccagaagcaaaagacagcccgagggccagccugaucccagaugccacauaucuagggccacaguucugcaagagcugcugguucgaaaacaagggccuggucgagugcaacaaccacuaucugugucucaacugucuuaccuuacuucugagugucagcaacaggugccccaucugcaagaugccucuccccacaaaacugagaccaucagcugccccaacagcacccccagccggagcagcgcacagcgccagaccuccacccuacagucccuga

SEQ ID NO: 3608 - RNA, 300 nt, Artificial Sequence
  derived and/or modified CDS sequence (wt) from Lassa virus__AAT48997__Z
auggggaacaagcaagccaaagcuccagaaacaaagaacagcccgagggccagucuaaucccugaugccacacaccuaggaccacaguuuugcaagagcugcugguuugaaaacaagggucugguugagugcaacaaccauuauuugugucucaauugccuuacccuucucuugagugucagcaacaggugccccaucugcaaaaugccacuccccacaaaacugagaccgucggccgucccaacagcgcccccagcccaagugggagaccgcaccagacccccacccuacagucccuga

SEQ ID NO: 3609 - RNA, 300 nt, Artificial Sequence
  derived and/or modified CDS sequence (wt) from Lassa virus__AAT49005__Z
auggggaacaagcaagccaaagccccagaaacaaaggacagcccgagggcuagucugaucccugaugccacacaccuaggaccacaguucugcaagagcugcugguuugaaaacaagggucuaguugagugcaacaaccauuauuugugucucaacugccuuacccuucuccugagugucagcaacaggugccccaucugcaaaaugccacuccccacaagacugagaccgucagccgucccaacagcgcccccagccccagcgggagaccgcaccaaacccccacccuacagucccuga

SEQ ID NO: 3610 - RNA, 300 nt, Artificial Sequence
  derived and/or modified CDS sequence (wt) from Lassa virus__ADU56612__Z
augggcaacaggcaaaccaggccaacugaagccacugaacagagcagggcucacuugguaccagacgcaucccaccugggaccccaauucugcaagagcuguugguuugaaaacagaggucuaguggagugcaacaaccacuaccugugucucaacugucucaguuugcuccucagugucagcagcagauguccaaucugcaagaugccccuucccaccaggcugaaggcaucagcacagcccagcgcacccccaaccgaagcaccccagaacacaacacccccaccauacaccccauaa

SEQ ID NO: 3611 - RNA, 300 nt, Artificial Sequence
  derived and/or modified CDS sequence (wt) from Lassa virus__ADU56616__Z
auggguggcaaacacaccaaacaaccaagagaauccaacagucccagagcuuccuuaauuccugaugcaacacacuugggcccucaauucugcaagaguuguugguuugagaacaaaggucugguagagugcaacaaccauuaccugugccucaacugccuuucucuacuccugucugucagcaacagaugccccaucugcaagaugccccucccuacgaggcucagaacaucaaccaauccaacagcaccccaggucgaacagaccggucccgcaaguccuccaccauauagucccuag

SEQ ID NO: 3612 - RNA, 300 nt, Artificial Sequence
  derived and/or modified CDS sequence (wt) from Lassa virus__ADU56620__Z
auggguggcaaacacaccaaaccacagagagaauccaacagucccagagccucucuaauucccgaugcaacacaccugggcccucaauuuugcaagaguuguugguuugagaacaaaggucugguggagugcaacaaccauuacuuaugccucaacugccuuacuuuacuccugucugucagcaacagaugccccaucuguaagaugccccuccccacgaggcugagagcaucaaccaacccaacagcaccccaggucgaacaagucggcccuacaaauccuccaccauacagucccuaa

SEQ ID NO: 3613 - RNA, 300 nt, Artificial Sequence
  derived and/or modified CDS sequence (wt) from Lassa virus__ADU56624__Z
augggcaacagacaugccaaaucgacaaaagucgaugaacaucaaagagcucaucuagugccagaugcaucccaucugggcccccaguucugcaagaguugcugguuugagaacagaggguugguagagugcaacaaucacuaccugugucucaacugucucagccugcuccucagugucagcagcagaugcccgaucugcaagaugccccuucccaccaagcuaaaggcagcagcacagccgagugcaccaucaaccgaggcgauccagaacacaacaccuccaccauacaccccauaa

SEQ ID NO: 3614 - RNA, 300 nt, Artificial Sequence
  derived and/or modified CDS sequence (wt) from Lassa virus__ADU56628__Z
augggcaacagacaggcuaaaucgacaaaagucgaugaacaucaaagagcucaucuagugccagaugcaucccaucugggcccccaauucugcaagaguugcugguuugagaacagaggauugguagagugcaacaaucacuaccugugucucaacugucucagccugcuccucagcgucagcagcagaugcccgaucugcaagaugccccuucccaccaagcuaaaggcagcagcacagccaagcgcaccaucaaccgaggcgauccagaacacaacaccuccaccguaugccccauaa

SEQ ID NO: 3615 - RNA, 300 nt, Artificial Sequence
  derived and/or modified CDS sequence (wt) from Lassa virus__ADU56632__Z
augggcaacagacaggccaagucgacaaaagucgaugagcaucaaagagcucaucuagugccagaugcaucccaucuaggcccccaguucugcaagaguugcugguuugagaacagagggcugguagagugcaacaaccacuaccugugucucaacugucuuagccugcuccucagcgucagcagcagaugcccgaucugcaagaugccccuucccaccaagcuaaaggcagcagcacagccgagcgcacccucaaccgaggcgacccaggacacaacaccuccaccguacaccccauga

SEQ ID NO: 3616 - RNA, 300 nt, Artificial Sequence
  derived and/or modified CDS sequence (wt) from Lassa virus__ADU56644__Z
augggcaacaggcagaccaaagcuccagaagcaaagggcagcccaagagccagucugaucccagacgccacacaccuagggccacaauucugcaaaagcuguugguuugaaaacaagggccuaguugaaugcaaugaccauuacuugugucucaacugucucacccuacuuuuaagcgucagcagcagauguccuaucugcaaaaugccccuccccacaagacugaggccaucaaccaacccaacggcgcccccagccagagcagagggcggcaucaauccuccaccauacagccccuga

SEQ ID NO: 3617 - RNA, 300 nt, Artificial Sequence
  derived and/or modified CDS sequence (wt) from Lassa virus__AHC95545__Z
auggggaauaagcaagccaaagauccaaagacagagagcagcccaagggccagucucauuccggaugccacacaccuuggaccacaauuuugcaagaguuguugguuugaaaacaaagguuuaguugaguguaacaaccacuaccugugccucaacugccucucccuacuuuugagugucagcaacaggugccccaucuguaagaugccucuucccacgaagcucaagccgauaaccacgccaacagcaccacaaaucaccagagagagcaucaccaaucccccaccauacacacccuaa

SEQ ID NO: 3618 - RNA, 300 nt, Artificial Sequence
  derived and/or modified CDS sequence (wt) from Lassa virus__AHC95547__Z
auggggaacagacaagccaaagacccaaagguggaaagcagcccaagggccagucugauuccagaugccacgcaccuuggaccgcaauucugcaagagcuguugguuugaaaauaagggccuaguugaguguaacaaccacuaccugugucucaacugccucucccuacuccugagcgucagcaacagaugcccuaucuguaagaugccccugcccacgaggcuaagaccaacaaccaugccgacagcaccacaaaucaucaaagaaggcaccaccaauccuccaccauacacacccuaa

SEQ ID NO: 3619 - RNA, 300 nt, Artificial Sequence
  derived and/or modified CDS sequence (wt) from Lassa virus__AIT17124__Z
augggaaacaagcaagucaaaaccccggaagcaaaagacaguccgagagccagccugaucccagaugccacacaccuagggccacaguucugcaagagcugcugguucgaaaacaagggccugguugagugcaacaaccacuaucugugucucaacugccucacuuuacuucuaaguguuggcaacaggugccccauuugcaagaugccccuucccacaaaacugagaccaucagucacuccaacagcacccccaaccagagcagcggacagcaucggacccccacccuacagucccuga

SEQ ID NO: 3620 - RNA, 300 nt, Artificial Sequence
  derived and/or modified CDS sequence (wt) from Lassa virus__AIT17128__Z
augggaaacaagcaagccaaaaccccggaggcaaaagacaguccaagagccaacuugaucccagaugccacacaccuggggccacaguucugcaagagcugcugguucgaaaauaaaggccugguugagugcaacaaccacuaucugugucucaacugccucaccuuacuucuaagugucagcaacaggugccccaucuguaagaugccucuucccacaaaacugagaccgucagccgcuccaacagcacccccaacuggagcagcggacagcaucagacccccacccuacagucccuga

SEQ ID NO: 3621 - RNA, 300 nt, Artificial Sequence
  derived and/or modified CDS sequence (wt) from Lassa virus__AIT17132__Z
augggaaacaagcaagccaaagccccagaagcaagagacagcccgagagccagccugaucccagacgccacacaucuagggccacaguucugcaaaagcugcugguucgaaaacaagggccugguugagugcaacaaccacuaucugugccucaacugccucaccuuacuucuaagugucagcaacaggugccccauuugcaagaugccucuucccacaaaacugagaccaucagccacaccaacagcacccccaaccgaagcagcagacagcaucagacccccacccuaccgucccuga

SEQ ID NO: 3622 - RNA, 300 nt, Artificial Sequence
  derived and/or modified CDS sequence (wt) from Lassa virus__AIT17136__Z
augggaaacaagcaaaccaaagccccagaaucaaaaaacaguccgagagccagucugaucccagaugccacauaucuaggaccacaguucugcaagagcugcugguucgaaaacaagggccugguugagugcaacaaccacuaucugugucucaacugccucaccuuacuucuaagugucagcaacaggugccccauuugcaagaugccucuccccacaaaacugagaucaucagccgcuccaacagcacccccaaccggagcagcggacagcaccaaacccccacccuacagccccuga

SEQ ID NO: 3623 - RNA, 300 nt, Artificial Sequence
  derived and/or modified CDS sequence (wt) from Lassa virus__AIT17140__Z
augggaaacaagcaagccaaggccccagaaccaaaggauaguccgagagccagccugaucccagaugcuacacaucuagggccacaguucuguaagagcugcugguucgaaaacaagggccugguugagugcaacaaccacuaucugugccucaacugccucaccuuacucuuaagugucagcaacaggugccccauuugcaagaugccucuccccacaaaacugagaccaucagccgcuccgacagcacccccagccggagcaguggacagcaccagaccuccacccuacagucccuga

SEQ ID NO: 3624 - RNA, 300 nt, Artificial Sequence
  derived and/or modified CDS sequence (wt) from Lassa virus__AIT17144__Z
augggaaacaagcaagcuaaaaccccagaaucaaaggacaguccgagagcuagccugaucccagaugccacacaucuagggccgcaguucuguaagagcugcugguucgaaaacaagggccugguugaguguaacaaccacuaucugugucucaacugccucaccuugcuucugggugucagcaacaggugccccauuugcaagaugccucuccccacaaaacugagaucaucagucgcuccaacagcacccccaaccggagcaguggacagcaucagacccccacccuacagucccuga

SEQ ID NO: 3625 - RNA, 300 nt, Artificial Sequence
  derived and/or modified CDS sequence (wt) from Lassa virus__AIT17152__Z
augggaaacaagcaagccaagaccccagaaacaaaagacaguccgagagccagccugaucccagaugccacacaccuagggccacaguuuugcaagagcugcugguucgaaaacaagggccugguugagugcaauaaccacuaucugugccucaauugucuuacccuacuucuaagugucagcaacaggugucccauuugcaagaugccucuccccacaaaacugagaccaucaaccgccccaacagcacccccagccggagcagcggacaacaccagacccccacccuauagccccuga

SEQ ID NO: 3626 - RNA, 300 nt, Artificial Sequence
  derived and/or modified CDS sequence (wt) from Lassa virus__AIT17162__Z
augggaaacaagcaagccaaggccucagaaucaaaggacagcccaagagccagccugaucccagaugccacacaucuagggccacaguucuguaagagcugcugguucgagaacaagggccugguugagugcaacaaccacuauuugugucucaacugccucacacuacuucugagugucagcaacaggugccccaucugcaagaugccucuccccacgaagcugagaccgucggucaccccaacagcgcccccaaccagaacagcagacaacaccagacccccacccuacagucccuga

SEQ ID NO: 3627 - RNA, 300 nt, Artificial Sequence
  derived and/or modified CDS sequence (wt) from Lassa virus__AIT17166__Z
augggaaacaagcaagccaaagccccggaagcaaaagacaguccgagagccagccugaucccagaugccacacaccuagggccacaguuuugcaagagcugcugguucgaaaccaagggccugguugagugcaacaaccacuaucuaugucucaauugccucacuuuacuucuaagugucagcaauaggugccccauuugcaagaugccccuucccacaaaacugagaccgucagccacuccaacggcacccccaaccgaagcugcggacagcaucggacccccacccuacagucccuga

SEQ ID NO: 3628 - RNA, 300 nt, Artificial Sequence
  derived and/or modified CDS sequence (wt) from Lassa virus__AIT17170__Z
augggaaacaaacaagccaaggucccagaaucaaaagacagcccgagagccagccuaaucccagaugccacacaucuagggccgcaauucuguaagaguugcugguucgaaaacaaaggccugguugagugcaacaaccacuaucugugucucaacugccucaccuuacuuuuaagugucagcaacaggugccccauuugcaagaugccucuccccacaaaacugagaccaucagccgcuccaacagcacccccagcuggagcagcggacagcaucagacccccaccuuacagucccuga

SEQ ID NO: 3629 - RNA, 300 nt, Artificial Sequence
  derived and/or modified CDS sequence (wt) from Lassa virus__AIT17174__Z
auggggaacaagcaaaccaaagcucccgaagccaaaggcagcccgagggccagucugaucccagacgccacacaccuggggccacaguucugcaagagcugcugguucgaaaacaagggcuugguugagugcaacaaccauuauuugugucucaacugccucacucugcuucugagugucagcagcaggugucccauuugcaagaugccccucccaacaaaacuaagaccaucagccgucccaacagcgcccccaaccaaagcagaagacaacaccagacccccacccuauagucccuga

SEQ ID NO: 3630 - RNA, 300 nt, Artificial Sequence
  derived and/or modified CDS sequence (wt) from Lassa virus__AIT17178__Z
auggggaacaagcaagccaaagcuucagaagcaaaagacagcccgagggcuagucugauuccagaugccacacaccuaggaccacaguucuguaagagcuguugguuugagaacaagggccugguugaaugcaacaaucacuaucugugucucaacugccucagucugcuucugagugucagcagcaggugccccaucugcaaaaugccccucccgacaagacugaggccaucaacagccccaacagcacccccagccagagcaggggauaacaucaaacccccacccuacagucccuga

SEQ ID NO: 3631 - RNA, 300 nt, Artificial Sequence
  derived and/or modified CDS sequence (wt) from Lassa virus__AIT17182__Z
auggggaacaagcaagccaaagucccagaaguaagggacagcccgagagccagucugaucccagaugccacacaccuagggccacaguucuguaagagcuguugguucgaaaacaaaggccuggucgagugcaacaaucacuaucuaugccucaacugccuuacucuacuucuaaguguuagcaguaggugucccaucugcaagaugccccuccccacaaaacugagaccaucagccaccccaacugcacccccagccggagcaggagauggcaccagacccccacccuacagucccuaa

SEQ ID NO: 3632 - RNA, 300 nt, Artificial Sequence
  derived and/or modified CDS sequence (wt) from Lassa virus__AIT17186__Z
augggaaauaagcaagccaaaaccccagaaacaaaagacaguccgagagccagccugaucccagaugcuacacaccuagggccacaguuuuguaagagcugcugguucgaaaacaagggucugguugagugcaauaaccacuaucugugccucaauugucucacccuacuucuaagugucaguaacaggugucccauuugcaagaugccucuccccacaaaacugagaccaucaguagccccaacagcacccccagccggagcagcggacaacaccagacccccacccuacagucccuga

SEQ ID NO: 3633 - RNA, 300 nt, Artificial Sequence
  derived and/or modified CDS sequence (wt) from Lassa virus__AIT17194__Z
augggaaacaagcaagccaaagccccagaaccaaaggacagcccgagagccagccugauuccagaugccacacaucuagggccgcaguucuguaagagcuguugguucgaaaacaagggccuaguugagugcaacaaccacuauuugugucucaacugccucacccuacucuugagugucagcaacaggugccccauuugcaagaugccccuccccacgaaacugagaccaucaguugcuccaacggcacccccagccggaguaguggacagcaccagacccccacccuacagucccuaa

SEQ ID NO: 3634 - RNA, 300 nt, Artificial Sequence
  derived and/or modified CDS sequence (wt) from Lassa virus__AIT17198__Z
augggaaacaaacaagccaaggucccagaaucaaaagacagcccgagagccagccuaaucccagaugccacacaucuagggccgcaauucuguaagaguugcugguucgaaaacaggggccugguugagugcaacaaccacuaucugugucucaacugccucaccuuacuuuuaagugucaguaacaggugccccauuugcaagaugccucuccccacaaaacugagaccaucaaccgcuccaacagcacccccaacuggagcagcagacagcaccagacccccaccuuacagucccuga

SEQ ID NO: 3635 - RNA, 300 nt, Artificial Sequence
  derived and/or modified CDS sequence (wt) from Lassa virus__AIT17202__Z
augggaaacaagcaagccaaaaccccagaaucaaaggacaguccgagagccagccugaucccagaugccacacaucuagggccgcaguucuguaagagcugcugguucgaaaacaagggccugguugagugcaacaaccacuaucugugucucaacugccucaccuuacuucuaagugucagcaauaggugccccauuugcaagaugccucuccccacaagacugagaccaucagccgcuccaacagcacccccauccggagcggcggacagcaccagaccuccacccuacagucccuga

SEQ ID NO: 3636 - RNA, 300 nt, Artificial Sequence
  derived and/or modified CDS sequence (wt) from Lassa virus__AIT17206__Z
augggaaacaagcaagccaaagccccagaagcaaaagacagcccgagagccagccugaucccagaugccacacaucuagggccacaguucugcaaaagcugcugguucgaaaacaagggccugguugagugcaacaaccacuaucugugccucaacugccucaccuuacuucuaagugucagcuacaggugccccauuugcaagaugccucuucccacaaaacugagaccaucagccacuccaacagcacccccaaccgaagcagcagacagcaucagacccccacccuaccgccccuaa

SEQ ID NO: 3637 - RNA, 300 nt, Artificial Sequence
  derived and/or modified CDS sequence (wt) from Lassa virus__AIT17214__Z
augggaaacaagcaggccaaagccccagaaguaaaagacaguccgagagccagccugaucccagaugccacacaucuagggccacaguucuguaagagcugcugguuugaaaacaagggucugguugagugcaauaaccacuaucugugucucaacugccuuacccuacuucuaagugucagcaauaggugccccauuuguaagaugccucuucccacaaaacugagaccaucagcugcuccaacagcaccuccaaccggaacagcggacagcaucagacccccacccuacagucccuaa

SEQ ID NO: 3638 - RNA, 300 nt, Artificial Sequence
  derived and/or modified CDS sequence (wt) from Lassa virus__AIT17222__Z
auggggaacaagcaagccaaaacuccagaaacaaaagacagcccgagggccagucugaucccagaugccacacaucuagggccacaauucugcaagagcugcugguucgaaaacaagggucugguugagugcaacagucacuaucugugccucaacugccucacccuacuucuaagugucaguaguaggugucccaucugcaagaugccccuccccacaaggcugaggccaucaaccgcuccaacagcaccuccagccggagugggggacagcaccagccccccacccuacagccccuga

SEQ ID NO: 3639 - RNA, 300 nt, Artificial Sequence
  derived and/or modified CDS sequence (wt) from Lassa virus__AIT17226__Z
augggaaacaagcaagccaaaaccccggaagcaaaagacaguccaagagccagccugaucccagaugccacacaccuagggccacaguucugcaagagcugcugguucgaaaacaagggccugguugagugcaacaaccacuaucugugucucaacugccucaccuuacuccuaagugucagcaacaggugccccauuugcaagaugccccuucccacaaaacugagaccgucagccacuccaacagcacccccagccggagcagcggacagcaucggaccaccacccuacagucccuga

SEQ ID NO: 3640 - RNA, 297 nt, Artificial Sequence
  derived and/or modified CDS sequence (wt) from Lassa virus__AIT17230__Z
augggaaacaagcaagccaaggccucagauaaaaacagcccgagagccagccugauuccagaugccacacaccuagggccacaauucugcaagagcugcugguucgaaaacaaaggccugguugagugcaacaaccacuaucugugucucaacugccucaccuuacuuuuaagugucagcaacaggugccccaucugcaagaugccucuucccacaaaacugagaccaucagccacuccaacagcacccccaaccggagcagcggacagcaucagacccccacccuacagucccuga

SEQ ID NO: 3641 - RNA, 300 nt, Artificial Sequence
  derived and/or modified CDS sequence (wt) from Lassa virus__AIT17234__Z
augggaaacaagcaagcuaaagccucagaagaaaaaaacaguccgagagccagccugauuccagaugccacacaccuagggccacaauucugcaagagcugcugguucgaaaacaagggccugguugagugcaacaaccacuaucugugucucaacugccucaccuuacuuuuaagugucagcaacaggugccccaucugcaagaugccucuucccacaaaacugagaccaucagccacuccgacagcaccuccaaccggagcagcagacagcaucagacccccacccuacagucccuga

SEQ ID NO: 3642 - RNA, 300 nt, Artificial Sequence
  derived and/or modified CDS sequence (wt) from Lassa virus__AIT17238__Z
augggaaacaagcaaaccaaagcuccagaagcaaaaggcagcccuagagccagccugaucccagaugccacacaucuagggccacaguucugcaaaagcugcugguucgaaaacaagggccugguugagugcaacaaccacuaucugugucucaacugccucacuuuacuucuaagugucagcaacaggugccccauuugcaaaaugccucuuccuacaaaacugagaccaucagccacuccaacagcaccuccaaccgaagcagcggacagcaucagacccccacccuaccgucccuga

SEQ ID NO: 3643 - RNA, 300 nt, Artificial Sequence
  derived and/or modified CDS sequence (wt) from Lassa virus__AIT17242__Z
augggaaacaagcaagccaaagccccagaaucaaaggacaguccgagagccagccugaucccagaugccacacaucuagggccgcaguuuuguaagagcugcugguucgaaaacaagggccugguugagugcaacaaccacuauuugugucucaacugccucaccuuacuucuaagugucagcaauaggugccccauuugcaagaugccucuccccacaagacugagaccaucagccgccccaacagcacccccaaccggagcaacggacagcaccagaccuccacccuacagucccuga

SEQ ID NO: 3644 - RNA, 300 nt, Artificial Sequence
  derived and/or modified CDS sequence (wt) from Lassa virus__AIT17248__Z
auggggaacaagcaagucaaagcuccugaagcaaggaauaguccgagggccagucugaucccagacgccacacaccuagggccacaguucugcaagagcugcugguucgagaacaagggccuggucgagugcaacaaucacuaccugugccucaacugucuaacccuacuccuaggugucagcagcaggugucccaucugcaagacgccccuccccacaagacugagaccaucagccaccccaacggcgcccccagccggagcaggagacaacaccagacccccacccuacagucccuga

SEQ ID NO: 3645 - RNA, 300 nt, Artificial Sequence
  derived and/or modified CDS sequence (wt) from Lassa virus__AIT17252__Z
auggggaacaagcaagccaaagccccagaggcaaaagacaguccgagagccagccugaucccagaugccacacaucuagggccacaauucugcaagagcugcugguucgaaaacaaaggccuggucgaaugcaauaaccacuaucugugucucaacugucuuacccuacuucuaagugucagcaacaggugccccaucugcaaaaugccccuucccacaaaacugagaccaucaaccgcaccaacggcacccccagcuggagcagcagacagcaccaggcccccacccuacagucccuga

SEQ ID NO: 3646 - RNA, 300 nt, Artificial Sequence
  derived and/or modified CDS sequence (wt) from Lassa virus__AIT17256__Z
augggaaacaagcaagccaaagccccagaaacaaaggacaguccgagagccagccugaucccagaugccacacaucuagggccgcaguucuguaagagcugcugguucgaaaacaagggccugguugagugcaauaaccacuaucugugccucaacugccucaccuuacuuuuaagugucagcaacaggugucccauuugcaagaugccucuccccacaaaacugagaccaucagcugcuccaacagcacccccagucggagcagcagacaacaccagacccccacccuacagucccuga

SEQ ID NO: 3647 - RNA, 300 nt, Artificial Sequence
  derived and/or modified CDS sequence (wt) from Lassa virus__AIT17260__Z
augggaaacaagcaagccaaagccccagaauuaaaggacagcccgagagccagccugaucccagaugccacacaucuagggccgcaguucuguaagagcugcugguucgaaaacaagggccuaguugagugcaacaaccacuaucugugucucaacugccucaccuuacuccuaagcgucagcaacaggugccccauuugcaagaugccccuccccacaaaacugagaccaucagcugcuccaacagcacccccagccggagcgguggacagcaccagacccccacccuacagucccuga

SEQ ID NO: 3648 - RNA, 300 nt, Artificial Sequence
  derived and/or modified CDS sequence (wt) from Lassa virus__AIT17268__Z
augggaaacaagcaaaccaaagccccagaagugaaaggcaguccgagagccagccugauuccagaugcuacacaccuaggaccacaauucugcaagagcuguugguucgaaaacaagggacugguugaguguaacaaccacuaccugugucucaacugccucaccuuacuucuaagugucagcaacaggugccccauuugcaagaugccccuucccacaaaacugaaaccaucaaccacaccaacagcacccccaaccggagcagcggacagcaucagaccuccacccuacagucccuga

SEQ ID NO: 3649 - RNA, 300 nt, Artificial Sequence
  derived and/or modified CDS sequence (wt) from Lassa virus__AIT17272__Z
augggaaacaagcaagucaagaccucagaggcaagggacagcccaagggccagucugauuccggacgcuacagaccuaggaccacaguucuguaagagcugcugguucgaaaacaagggucugguugaguguaacaaucacuacuuaugccuuaauugccucacucuacuucugaguguuagcaacaggugucccaucugcaagaugccccuucccacaagacuaaggccaucagccaacccaacagcacccccagccgaaacaggggacagcaccagaccuccacccuacagccccuga

SEQ ID NO: 3650 - RNA, 300 nt, Artificial Sequence
  derived and/or modified CDS sequence (wt) from Lassa virus__AIT17278__Z
auggggagcaagcaaaccaaaaccccagaaguaaaagacaguccgagagcuagccugauuccagaugccacacaucuagggccacaguucuguaagagcugcugguucgagaacaagggccugguugagugcaacaaccauuaucugugccucaacugccucaccuuacuucuaagugucagcaacaggugccccaucugcaagaugccccuucccacaaaacugaggccaucagccgcuccaacggcacccccagccagagcagcggacgacaccaggcccccgcccuacagucccuga

SEQ ID NO: 3651 - RNA, 300 nt, Artificial Sequence
  derived and/or modified CDS sequence (wt) from Lassa virus__AIT17282__Z
augggaaacaagcaagccaaggccccagaaccaaaggauaguccgagagccagccugaucccagaugcuacacaucuagggccacaguucuguaagagcugcugguucgaaaacaagggccugguugagugcaacaaccacuauuugugccucaacugccucaccuuacucuuaagugucagcaacaggugccccaucugcaagaugccucuccccacaaaacugagaccaucagccgcuccgacagcacccccagccggagcaguggacagcaucagaccuccacccuacagucccuga

SEQ ID NO: 3652 - RNA, 300 nt, Artificial Sequence
  derived and/or modified CDS sequence (wt) from Lassa virus__AIT17286__Z
auggggaacaagcaaaccaaagccccagagguaaaggacaguccgagagcuagccuaaucccagaugccacacaucuagggccacaguucugcaagagcugcugguucgagaacaagggccugguugagugcaacaaccacuaucugugccucaauugucuuaccuuacuucuaagugucagcaacaggugccccaucugcaagaugccccuucccacaaaacugagaccaucaaccgcuccaacagcacccccagccggaacaauggacagcaccaggcccccgcccuacagucccuga

SEQ ID NO: 3653 - RNA, 300 nt, Artificial Sequence
  derived and/or modified CDS sequence (wt) from Lassa virus__AIT17290__Z
auggggaacaagcaagccagggcuccagaagcgaaggacagcccgagggccagucugaucccagaugcuacacaccuagggccacaguucugcaagagcugcugguucgaaaauaaaggccuaguagagugcaacaaucacuauuugugccucaacugccucacccugcuucuaagcgucagcagcaggugccccaucugcaagaugccccuccccacaagacugagaccaucagccaucccaacggcacccccagccgggacgggagacagcagcagacccccacccuacagccccuga

SEQ ID NO: 3654 - RNA, 300 nt, Artificial Sequence
  derived and/or modified CDS sequence (wt) from Lassa virus__AIT17296__Z
augggaaacaagcaagccaaaaccccagaaauaaaagacagcccgagagccagccuaaucccagaugcuacacaccuagggccacaguucuguaagagcugcugguucgaaaacaagggccuaguugagugcaacaaccacuaucugugccucaauugucuuacccuacuucuaagugucagcaacaggugucccauuugcaaaaugccucuccccacaaaacugagaccaucagccgccccgacggcacccccagccggagcagcagacaucaccagacccccacccuacagucccuga

SEQ ID NO: 3655 - RNA, 300 nt, Artificial Sequence
  derived and/or modified CDS sequence (wt) from Lassa virus__AIT17300__Z
auggggaacaagcaagucaaagcuccagaagcaaggaacaguccgagggccagucugaucccagacgccacacaccuagggccacaguucugcaagagcugcugguucgagaacaagggccuggucgagugcaacaaucacuaccugugccucaacugucuaacccuacuccuaggugucagcagcaggugucccaucugcaagaugccccuccccacaagacugagaccaucaacugccccaacggcgcccccagccggagcaggagacaacaccagacccccacccuacagucccuga

SEQ ID NO: 3656 - RNA, 300 nt, Artificial Sequence
  derived and/or modified CDS sequence (wt) from Lassa virus__AIT17312__Z
augggaaacaagcaagccaaaaccccagaaacaaaggacaguccaagagccagccugaucccagaugccacacaucuagggccgcaguucuguaagagcugcugguucgaaaacaagggccugguugagugcaacaaccacuaucugugucucaacugccucaccuuacuuuuaagugucagcaacaggugccccauuugcaagaugccucucccaacaaaacugagaccaucagcugcuccaacagcacccccagucggagcagcagacagcaccagacccccacccuacagucccuga

SEQ ID NO: 3657 - RNA, 300 nt, Artificial Sequence
  derived and/or modified CDS sequence (wt) from Lassa virus__AIT17316__Z
auggggaacaaacaagccaaagcuccagaagcaaggaacaguccgagggccagucugaucccagacgccacacaccuggggccacaguucugcaagagcugcugguucgagaacaggggccuggucgagugcaacaaucacuaccugugucucaacugucuaacccuacuccuaagugucagcagcaggugucccaucugcaagaugccccuccccacaagacugaggccaucagccgccccaacggcgcccccagcuggagcaggagacaacaccagacccccacccuacagucccuga

SEQ ID NO: 3658 - RNA, 300 nt, Artificial Sequence
  derived and/or modified CDS sequence (wt) from Lassa virus__AIT17320__Z
auggggaacaagcaagccaaagcuccugaagcaaggaacaguccgagggccagucugaucccagacgccacacaccuagggccacaguucugcaagagcugcugguucgagaacaagggccuggucgagugcaacaaucacuaccugugccuuaacugucuaacucuacuccuaggugucagcagcaggugucccaucugcaagaugccccucccaacaagacugagaccaucagccgccccgacggcgccccuggcugaagcaggagacaacaccagacccccacccuacagucccuga

SEQ ID NO: 3659 - RNA, 300 nt, Artificial Sequence
  derived and/or modified CDS sequence (wt) from Lassa virus__AIT17326__Z
augggaaacaagcaauccaaagccccagaaucaagagacaguccaagagccagccugaucccggaugccacacaucuagggccacaguucugcaagagcugcugguucgaaaacaagggccugguugagugcaacaaccacuaucugugucucaacugccucaccuuacuucugagugucagcaacaggugccccauuugcaagaugccucuccccacaaagcugagaccaucagccacuccaacagcaccuccaacuagagcagcagacagcaucagacccccacccuacagucccuga

SEQ ID NO: 3660 - RNA, 300 nt, Artificial Sequence
  derived and/or modified CDS sequence (wt) from Lassa virus__AIT17330__Z
augggaaacaagcaagccaaagcccuagaaucaaaaaacaguccgagagccagucugaucccagaugccacauaucuaggaccacaguucugcaagagcugcugguucgaaaacaagggccugguugagugcaacaaccacuaucugugucucaacugccucaccuugcuucuaagugucagcaacaggugccccauuugcaagaugccucucccuacaaaacugagaucaucagccgcuccaacagcacccccaaccggagcagcggacggcaccaaacccccacccuacagccccuga

SEQ ID NO: 3661 - RNA, 300 nt, Artificial Sequence
  derived and/or modified CDS sequence (wt) from Lassa virus__AIT17342__Z
augggaaacaagcaggccaaagccucagaagcaaaagacaguccgagagccagccugaucccagaugccacacaucuggggccacaguucuguaagagcugcugguuugaaaacaagggucugguugagugcaacaaccacuaucugugucucaacugccuuacccuacuucuaagugucagcaauagaugccccauuugcaagaugccucuucccacaaaacugagaccaucaacugcuccaacagcaccucaaaccggagcagcggacagcaucagacccccacccuauagucccuga

SEQ ID NO: 3662 - RNA, 300 nt, Artificial Sequence
  derived and/or modified CDS sequence (wt) from Lassa virus__AIT17346__Z
auggggaacaagcaagccaaagccccagaaacaaaggauaguccgagagccagccugaucccagaugccacacaucuagggccacaguucuguaagagcugcugguucgaaaacaagggccugguugagugcaacaaccacuaucugugucucaacugccucaccuugcuuuugaguguuagcaacaggugccccauuugcaagaugccucuccccacaaaacugagaccaucagcugcuccaacagcacccccagucggagcagcagacagcaccagacccccacccuacagucccuga

SEQ ID NO: 3663 - RNA, 300 nt, Artificial Sequence
  derived and/or modified CDS sequence (wt) from Lassa virus__AIT17362__Z
augggaaacaaacaagccaaggccccagaaucaaaagacagcccaagggccagccuaaucccagaugcuacacaucuagggccgcaauucuguaagaguugcugguucgaaaacaagggccugguugagugcaacaaccacuaucugugucucaacugccucaccuuacuuuuaagugucagcaacaggugccccauuugcaagaugccucuccccacaaaacugagaccaucagccgcuccaacagcacccccagccggggcagcagacagcauccgacccccacccuacagucccuga

SEQ ID NO: 3664 - RNA, 300 nt, Artificial Sequence
  derived and/or modified CDS sequence (wt) from Lassa virus__AIT17366__Z
auggggaauaagcaaaccaaaaccccagaaguaaaagacaguccgagagcuagccugauuccagaugccacacaucuagggccacaguucuguaagagcugcugguucgagaacaagggccugguugagugcaacaaccauuaucugugccucaacugccucaccuuacuucuaagugucagcaacaggugccccaucuguaagaugccucuucccacaaaacugagaccaucagccgcuccaacagcacccccagccagagcagcggacgacaccaggcccccgcccuacagccccuga

SEQ ID NO: 3665 - RNA, 300 nt, Artificial Sequence
  derived and/or modified CDS sequence (wt) from Lassa virus__AIT17376__Z
augggaaacaagcaagccaaagccccagaaucaaaagacaguccgagagccagccugaucccagaugccacauaucuaggaccacaguucuguaaaagcugcugguucgaaaacaagggccugguugaguguaacaaccacuaucugugucucaacugccucaccuuacuucuaagugucagcaacaggugcccuauuugcaagaugccucuccccacaaaacugagaucaucggucgcuccaacagcaccuccaaccagagcagcagacagcaccagacccccacccuacagucccuga

SEQ ID NO: 3666 - RNA, 300 nt, Artificial Sequence
  derived and/or modified CDS sequence (wt) from Lassa virus__AIT17382__Z
auggggaacaagcaaaccaaaaccucagaaguaaaagacaguccgagagcuagccuaauuccagaugccacacaucuagggccacaguucuguaagagcugcugguucgagaacaagggccuggucgagugcaacaaccauuaucugugccucaacugccucaccuuacuucuaagugucagcaacaggugccccaucugcaagaugccucuucccacaaaacugagaccaucagccgcuccaacagcacccccagccagagcagcggacgacaccaggcccccgcccuacagucccuga

SEQ ID NO: 3667 - RNA, 300 nt, Artificial Sequence
  derived and/or modified CDS sequence (wt) from Lassa virus__AIT17386__Z
auggggaacaagcaagccaaaaccccagaagcaagggacagcccgagagccagucugaucccagaugcuacacaccuagggccacaguucuguaagagcuguugguucgaaaacaaaggccuggucgagugcaacaaucacuaucugugccucaacugccuuacuuuacuucuaaguguuaguaguaggugucccaucugcaagaugccccuccccacaaaacugagaccaucagccaccccaacugcacccccagccggagcaggagacggcaccagacccccacccuacagucccuga

SEQ ID NO: 3668 - RNA, 300 nt, Artificial Sequence
  derived and/or modified CDS sequence (wt) from Lassa virus__AIT17396__Z
auggggaacaagcaagucaaagcuccugaagcaaggaacaguccgagggccagccugaucccagaugccacacaccuagggccacaguucugcaagagcugcugguucgagaacaagggccuggucgagugcaacaaucacuaccugugccucaacugucuaacccuacuccuaggugucagcagcaggugucccaucugcaagaugccccucccaacaagacugagaccaucagccgccccaacggcgcccccagccgaagcaggagacaacaccagacccccacccuauagucccuga

SEQ ID NO: 3669 - RNA, 300 nt, Artificial Sequence
  derived and/or modified CDS sequence (wt) from Lassa virus__AIT17402__Z
augggcaacagacaggcuaaaucgacaaaagucgaugaacaucaaagagcucaucuagugccagaugcaucccaucuaggcccccaguucugcaagaguugcugguuugagaacagaggguugguagaguguaacaaucacuaccugugucucaacugucucagccugcuucucagcgucagcaguagaugcccgaucugcaagaugccccuucccaccaagcuaaaggcagcagcacagccgagcgcaccaucaaccgagacgauccagaacacaacaccuccaccguacaccccauaa

SEQ ID NO: 3670 - RNA, 300 nt, Artificial Sequence
  derived and/or modified CDS sequence (wt) from Lassa virus__AIT17406__Z
augggcaacagacaggccaaaucaucaaaaguugaugagcaucaaagagcucaucuaguaccagaugcaucccaucuaggcccccaguuuugcaaaaguugcugguuugagaacaagggguugguagagugcaacaaccacuaccugugccucaacugucucagccugcuccucagcgucagcagcagaugcccgauuugcaagaugccccuucccaccaagcugaaagcagcagcacaaccgagcgcacccucaacugaggcgguccagaacacagcaccuccaccguaugccccauga

SEQ ID NO: 3671 - RNA, 300 nt, Artificial Sequence
  derived and/or modified CDS sequence (wt) from Lassa virus__AIT17410__Z
augggcaacaagcaggccaaaucgacaaaggucgaugaacaucaaagagcucaucuggugccagaugcaucucaucuaggcccccaguucuguaagaguugcugguuugagaacagagggcugguggagugcaacaaccacuaucugugucucaacugucucagccugcuucucagcgucagcagcagguguccgaucugcaaaaugccucuucccaccaggcuaaaggcagcaacacagccgagcgcaccuucaaccgaggcgacccagaacacaacaccuccaccauacaccccguga

SEQ ID NO: 3672 - RNA, 300 nt, Artificial Sequence
  derived and/or modified CDS sequence (wt) from Lassa virus__AIT17418__Z
augggcaacagacaggcuaaaucgacaaaagucgaugaacaucaaagagcucaucuagugccggaugcaucccaucuaggcccccaguucugcaagaguugcugguuugagaacagaggguugguagaguguaacaaucacuaccugugucucaacugucucagccugcuucucagcgucagcaguagaugcccgaucugcaagaugccccuucccaccaagcuaaaggcagcaacacagccgagcgcaccaucaaccgagacgauccagaacacaacacccccaccauacaccccauag

SEQ ID NO: 3673 - RNA, 300 nt, Artificial Sequence
  derived and/or modified CDS sequence (wt) from Lassa virus__AIT17422__Z
augggcaauagacaagccaaaucggcaaaagucgaugaacaucaaagagcucaucuggugccagaugcgucccauuugggcccccaguucugcaagaguugcugguuugagaacagaggguugguagagugcaacaaccacuaccugugucucaacugucucagucugcuccucagcgucagcagcagaugcccgaucugcaagaugccccuucccaccaagcugaaggcagcaacacagccgagcgcacccucaaccgaggcgacccagaacacaacaccuccaccguacaccccauga

SEQ ID NO: 3674 - RNA, 300 nt, Artificial Sequence
  derived and/or modified CDS sequence (wt) from Lassa virus__AIT17426__Z
augggcaacaaacaggccaaaucgacaaaagucgaugaacaccaaagagcucaucuagugccagaugcaucccaucuaggcccccaguucugcaagaguugcugguuugagaacagaggguugguagagugcaacaaucacuaccugugccucaacugucucagccugcuccucagcgucagcagcagaugcccaaucugcaagaugccccuucccaccaagcuaaaggcagcaacacagccgagcgcaccaucaaccgaggcgacccagaacacaacaccuccaccguacaccccauga

SEQ ID NO: 3675 - RNA, 300 nt, Artificial Sequence
  derived and/or modified CDS sequence (wt) from Lassa virus__AIT17432__Z
augggcaacaagcaggccaaaucgacaaaaguugaugaacaucaaagagcucaucuagugccagaugcaucucaucuaggcccccaguucuguaagaguugcugguuugagaacagagggcugguggagugcaacaaccacuaccugugucucaacugucucagccugcuucucagcgucagcagcagguguccgaucugcaaaaugccucuucccaccaggcuaaaggcagcaacacagccgagcgcacccucaaccgaggcgacccagaacacaauaccuccaccauacaccccguga

SEQ ID NO: 3676 - RNA, 300 nt, Artificial Sequence
  derived and/or modified CDS sequence (wt) from Lassa virus__AIT17436__Z
augggcaacaaacaggccaaaucgacaaaagccgaugaacaucaaagagcucaucuagugccagaugcaucccaucugggcccccaguucuguaagaguugcugguuugagaacagagggcugguggagugcaacaaucacuaucugugucucaacugucucagccugcuccucagcgucagcagcagaugcccgaucugcaagaugccucuucccaccaagcuaaaggcagcaacacagccgagcgcaccaucaacugaggcgacccggaacacaacacccccaccguacaccccauga

SEQ ID NO: 3677 - RNA, 300 nt, Artificial Sequence
  derived and/or modified CDS sequence (wt) from Lassa virus__AIT17444__Z
augggcaacagacaggcuaaaucaacaaaagucgacgaacaucaaagagcucaccuagugccagaugcaucucaucuaggcccccaguuuugcaaaaguugcugguuugagaacaagggguugguagagugcaacaaccacuaccugugucucaacugucucagccugcuccucagcguuagcagcagaugcccgaucugcaagaugccccuucccaccaagcugaaggcagcagcacaaccgagcgcacccucaaccgaggcggcccagaacacagcaccuccaccguaugccccauga

SEQ ID NO: 3678 - RNA, 300 nt, Artificial Sequence
  derived and/or modified CDS sequence (wt) from Lassa virus__AIT17448__Z
auggguaacagacaggccaaaucgacaaaagucggugaacaucaaagagcucaucuagugccagaugcaucccaucuaggcccccaguucugcaagaguugcugguuugagaacagaggguugguagagugcaacaaucacuaccugugucucaacugucucagccugcuccucagugucagcagcaggugcccgaucugcaagaugccccuccccaccaagcuaaaggcaacagcacagccaagcgcaccaucagccgaggcaauccagaacacaacaccuccaccguacaccccauaa

SEQ ID NO: 3679 - RNA, 300 nt, Artificial Sequence
  derived and/or modified CDS sequence (wt) from Lassa virus__AIT17452__Z
augggcaacagacaggccaaaucgacaagagucgaugaacaucaaagagcccaucuagugccagaugcaucccaucuagguccucaguucugcaagagcuguugguuugaaaacagaggguugguagaguguaacaaccacuaucugugucucaacugucucagucuucuccuuagcgucagcagcagaugcccgaucugcaagaugccccuuccuaccaggcuaagggcagcaguacagccgagcgcacccucaaccgagacaacccaggacacaacaccuccaccguacuccccauga

SEQ ID NO: 3680 - RNA, 300 nt, Artificial Sequence
  derived and/or modified CDS sequence (wt) from Lassa virus__AIT17456__Z
augggcaacagacaggccaaaucgacagaagucaaugaacaucaaagagcucaucuagugccagaugcaucccaucuaggcccucaguucugcaagaguugcugguucgagaacagaggguugguggagugcaacaaucacuaccugugucucaacugucucagcuugcuccucagcgucaguagcagaugcccgaucugcaagaugccccuucccaccaagcuaaaggcagcaacacagccgagcgcaccaucaaccgaagugacccagaacacagugccuccaccguauuccccauaa

SEQ ID NO: 3681 - RNA, 300 nt, Artificial Sequence
  derived and/or modified CDS sequence (wt) from Lassa virus__AIT17460__Z
augggcaacagacaggccaaaucgacaaaagucgaugaacaucaaagagcucaucuaguaccagaugcaucccaucuaggcccucaguucugcaagaguugcugguuugagaacagagggcugguagagugcaacaaccacuaccugugucucaauugucucagccugcuccucagcgucagcagcagaugcccgaucuguaagaugccucuucccaccaaacuaaaggcagcagcacaaccgagcgcacccccaaccgaggcaacccaaaacacaacaccuccaccguacaccccguag

SEQ ID NO: 3682 - RNA, 300 nt, Artificial Sequence
  derived and/or modified CDS sequence (wt) from Lassa virus__AIT17468__Z
augggcaacaggcaggccaaacagaccaaagucgacgaacaucaaagagcucaccuaguaccggaugcaucccaucuaggcccccaauucugcaagaguugcugguuugagaacagaggguugguagagugcaacaaccauuaccuaugucucaacugucucagcuuacuucucagcaucagcagcaggugccccaucugcaaaaugccucuucccaccaaacuaaaggcagcagcgcagccgagcgcacccucaacugaggcaacccaggacacaacaccuccaccauacaccccauga

SEQ ID NO: 3683 - RNA, 300 nt, Artificial Sequence
  derived and/or modified CDS sequence (wt) from Lassa virus__AIT17472__Z
augggcaacaagcagaccaaaucgacaaaagcugaugaacaucaaagggcucaucuagugccagaugcaucccaucuaggcccccaguucugcaagaguugcugguuugagaacaggggguugguagagugcaacaaccacuacuugugucucaauugccucagucugcuccucagcgucagcagcagaugcccgaucugcaagaugccccuucccaccaggcuaaaggcagcagcacagccgagcgcacccucaaccgaggcgacccaggacacaacaccuccaccguauaccccauga

SEQ ID NO: 3684 - RNA, 300 nt, Artificial Sequence
  derived and/or modified CDS sequence (wt) from Lassa virus__AIT17476__Z
augggcaauagacaggcuaagucgacaaaagucgaugaacaucaaagagcucaucuagugccagaugcaucccaucugggcccccaguucugcaagaguugcugguuugagaacagaggguuaguggagugcaacaaucacuaucugugucucaacugucucagccugcuccucagcgucagcagcagaugcccgauuugcaagaugccccuucccaccaagcuaaaggcagcagcacagccgagugcaccuucagccgaggcgauccagaacacaacgccuccaccauacaccccauaa

SEQ ID NO: 3685 - RNA, 300 nt, Artificial Sequence
  derived and/or modified CDS sequence (wt) from Lassa virus__AIT17480__Z
auggguaacagacaugccaaaucgacaaaagucgaugaacaucaaagagcucaucuagugccagaugcaucccaucuaggcccccaguucugcaagaguugcugguuugagaauagaggguugguagagugcaacaaucacuaccugugucucaacugucucagccugcuccucagugucagcagcagaugcccgaucugcaagaugccccuucccaccaagcuaaaggcagcagcacagccgagcgcaccauccaccgaggugauccagagcacaacaccuccaccauacaccccauaa

SEQ ID NO: 3686 - RNA, 300 nt, Artificial Sequence
  derived and/or modified CDS sequence (wt) from Lassa virus__AIT17484__Z
augggcaacagacaugccaaaucgacaaaagucgaugaacaucaaagagcucaucuagugccagaugcaucccaucuaggcccccaguucugcaagagcugcugguuugagaacagaggguugguagagugcaacaaucacuaccugugucucaacugucucagccugcuccucagugucagcagcagaugcccgaucugcaagaugccccuucccaccaagcuaaaggcagcagcacagccgagugcaccgucaaccgaggagauccagaacacaacaccuccaccauacaccccauaa

SEQ ID NO: 3687 - RNA, 300 nt, Artificial Sequence
  derived and/or modified CDS sequence (wt) from Lassa virus__AIT17488__Z
augggcaacagacaggccaaaccaacgaaggucgaugagcaucaaagagcucaucuagugccagaugcaucccaucuaggcccccaguuuugcaaaaguugcugguuugagaacaagggguugguagagugcaacaaccacuaccugugccucaacugucucagucugcuccucagcgucagcagcagaugcccgaucugcaagaugccccuucccaccaagcugaaggcagcagcacagccgagcgcacccucaacugaggcggcccagaacacagcgccuccaccguaugccccauga

SEQ ID NO: 3688 - RNA, 300 nt, Artificial Sequence
  derived and/or modified CDS sequence (wt) from Lassa virus__AIT17496__Z
augggcaacagacaggccaaaucgacaaaagucgaugaacaucaaagagcucaucuagugccagaugcaucccaucuaggcccccaguucugcaagaguugcugguuugagaacagaggguugguagagugcaacaaucacuaccugugucucaacugucucagccugcuccucagugucagcagcagaugcccaaucugcaagaugccccuuccuaccaggcuaaaggcagcgacacagccgagcgcaccaucaacugaggcgacccagaccacaacaccuccaccauacaccccauga

SEQ ID NO: 3689 - RNA, 300 nt, Artificial Sequence
  derived and/or modified CDS sequence (wt) from Lassa virus__AIT17500__Z
augggcaacagacagaccaaaucaacaaaaguugaugaacaucaaagagcucaucuagugccagaugcgucccaucuaggcccccaguuuugcaaaaguugcugguuugagaacaagggguuaguagagugcaacaaccauuaccugugucucaacugucucagccugcuccucaguguuagcagcagaugcccgaucuguaagaugccccuuccuaccaagcugaagacagcagcacagccgagugcacccccaacugaggcggcccggaccacagcaccuccaccguacgccccauga

SEQ ID NO: 3690 - RNA, 300 nt, Artificial Sequence
  derived and/or modified CDS sequence (wt) from Lassa virus__AIT17508__Z
augggcaacagacagaccaaaucaacaaaagucgaugagcaucaaagagcucaucuagugccagaugcaucccaucuaggcccccaguuuugcaaaagcugcugguuugagaacaaaggguugguagagugcaacaaccacuaccugugccucaauugucucagccugcuccucagcgucaguagcagaugcccgaucugcaagaugccccuucccaccaagcugaaggcagcagcacagccgagcgcacccucaacugaggcaacccagaauacagcaccuccaccauaugccccauga

SEQ ID NO: 3691 - RNA, 300 nt, Artificial Sequence
  derived and/or modified CDS sequence (wt) from Lassa virus__AIT17512__Z
augggcaacagacaggccaaaucgacaaaagucuaugaacaucaaagagcucaucuagugccagaugcaucccaucuaggcccccaguucugcaagaguugcugguuugagaacagaggguugguagaaugcaauaaucacuaccugugucucaacugucucagccugcuccucagugucagcagcagaugcccaaucugcaagaugccccuucccaccaggcuaaaggcagcgacacagcccagcgcaccaucaaccgaggcaacccaaaacacaacacccccaccguacaccccauaa

SEQ ID NO: 3692 - RNA, 300 nt, Artificial Sequence
  derived and/or modified CDS sequence (wt) from Lassa virus__AIT17516__Z
augggcaacagacaagccaagucgacaaaaguugaugaacaucaaagagcucaucuagugccagaugcaucccaucuaggcccccaguucugcaagaguugcugguuugagaacagaggguugguggagugcaauaaucacuaucugugccucaacugucucagccugcuccucagcgucagcagcagaugcccgaucugcaagaugccccuucccaccaagcugaagacagcaacacagccgagcgcaccauuaacugaggcgacccagaacacaacacccccaccguacaccccauga

SEQ ID NO: 3693 - RNA, 300 nt, Artificial Sequence
  derived and/or modified CDS sequence (wt) from Lassa virus__AIT17520__Z
augggcaacaaacaggcuaaaucgacaaaagucgaugaacaccaaagagcucaucuagugccagaugcaucccaucuaggcccccaguucugcaagaguugcugguuugagaacagaggguugguggagugcaacaaucacuacuugugucucaacugccucagccugcuccucagcgucagcaacagaugcccgaucugcaagaugccccuucccaccaagcuaaaggcagcagcacagccgagcgcaccaucaaccgaggcgacccagaacacaacaccuccaccauacaccccguaa

SEQ ID NO: 3694 - RNA, 300 nt, Artificial Sequence
  derived and/or modified CDS sequence (wt) from Lassa virus__AIT17526__Z
auggguaacagacaggcuaaaucagccaaaguuacugagcaucagagagcacaucuagugccggaugcaucccauuuggguccucaauucuguaagagcugcugguuugagaacaaagggcugguggaaugcaacaaucauuaucugugucucaauugccuuaguuugcuccuuagcgucagcagcagaugcccaaucugcaagaugccccuucccaccagacuaaaggcagcgacacaacccagcgcacccucagccgaggcaccccagagcacaacgcccccaccauacaccccguaa

SEQ ID NO: 3695 - RNA, 300 nt, Artificial Sequence
  derived and/or modified CDS sequence (wt) from Lassa virus__AIT17536__Z
augggcaacaggcaaaccaggccaacugaagccacugagcagagcagggcccacuugguaccagaugcaucccaccugggaccccaauucugcaagagcuguugguuugaaaacaaagguuuaguggagugcaacaaccacuaccugugucucaacugucucagcuugcuccucagugucagcagcagauguccaaucugcaagaugccccuucccaccaggcugaaggcaucagcacagcccagcgcacccccaaccgaagcaccccagaacaaagcaccuccaccauacaccccauaa

SEQ ID NO: 3696 - RNA, 300 nt, Artificial Sequence
  derived and/or modified CDS sequence (wt) from Lassa virus__AIT17542__Z
augggcaauagacaggucaaaucgacaaaagucgaugaacaucaaagagcucaucuaauuccagaugcaucccauuuaggcccccaguucuguaagaguugcugguuugagaacagagggcugguagagugcaacaaucauuaccugugucucaacugucucagccuacuccucagcgucagcagcagaugcccgaucugcaagaugccccuucccaccaagcuagaggcagcagcacagccgagugcaccaucaacugaggcgacccaggacacaacaccuccaccguacaccccauaa

SEQ ID NO: 3697 - RNA, 300 nt, Artificial Sequence
  derived and/or modified CDS sequence (wt) from Lassa virus__AIT17546__Z
augggcaacaaacaggcuaaaucgacaaaagucgaugaacaucaaagagcucaucuagugccagaugcaucccaucuaggcccucaguucugcaagaguugcugguuugagaacagaggguugguggagugcaacaaccacuaccugugucucaacugucucagccugcuccucagcgucagcagcagaugcccgaucugcaagaugccccuucccaccaagcuaaaggcagcagcacagccgagcgcaccaucaaccgagacaauccagaacacaacacccccaccguacaccccguaa

SEQ ID NO: 3698 - RNA, 300 nt, Artificial Sequence
  derived and/or modified CDS sequence (wt) from Lassa virus__AIT17550__Z
augggcaacagacaggccaaacagaccaaagucgacgaacaucaaagggcucaccuaguaccggacgcaucccaucugggcccccaauucugcaagaguugcugguuugagaacagaggguugguggagugcaacaaccacuacuuaugucucaacugucucagcuuacuccucagcgucaguagcaggugccccauuugcaaaaugccucuucccacuaaacuaaaggcagcagcacagccaagcgcacccucaacugagauaacccagaacacaacaccuccaccauacaccccauga

SEQ ID NO: 3699 - RNA, 300 nt, Artificial Sequence
  derived and/or modified CDS sequence (wt) from Lassa virus__AIT17554__Z
augggcaacaggcaggccaaaucgacaaaagcugacgaacaucaaagagcucaucuagugccagaugcaucccaucuaggcccccaguucugcaagaguugcugguuugagaacaggggguugguagaguguaacaaccacuacuugugucucaauugccucagucugcuccucagcgucagcaacagauguccgaucugcaagaugccccuucccaccaggcuaaaggcagcagcacagccgagcgcaccuucaaccgaggcgacccaggacacaacaccuccaccguauaccccauga

SEQ ID NO: 3700 - RNA, 300 nt, Artificial Sequence
  derived and/or modified CDS sequence (wt) from Lassa virus__AIT17558__Z
augggcaacagacaagccaagucgacaaaagucgaugaacaucaaagagcucaucuagugccagaugcaucccaucuaggcccccaguucugcaagagcugcugguuugaaaacagaggguugguagaaugcaacaaucacuaccugugucucaacugucucagccugcuccucagugucagcagcagaugcccaaucugcaagaugccccuucccaccaggcugaaggcagcagcacaaccgagcgcaccaucaaccgaggcaauccggagcacaacaccuccaccguauaccccauaa

SEQ ID NO: 3701 - RNA, 300 nt, Artificial Sequence
  derived and/or modified CDS sequence (wt) from Lassa virus__AIT17570__Z
augggcaacagacaggccaagucggcaaaagucaaugaacaucaaagagcucaucuggugccagaugcgucccauuuaggcccccaguucugcaagaguugcugguuugagaacagaggguugguggagugcaacaaccacuacuugugucucaacugucucagucugcuccucagcguuagcaguagaugcccgauuugcaagaugccccuccccaccaagcuaaaggcagcagcacagcccagcgcacccucaaccgaggcgacccagaacauaacaccuccaccguacaccccauga

SEQ ID NO: 3702 - RNA, 300 nt, Artificial Sequence
  derived and/or modified CDS sequence (wt) from Lassa virus__AIT17578__Z
augggcaacagacaggcuaaaucaacaaaagucgaugaacaucaaagagcucaucuagugccagaugcaucccaucuaggcccccaguuuugcaaaaguugcugguuugagaacaagggguugguggagugcaacaaccacuaccugugucucaacugucucagccugcuccucagcgucagcaguagaugcccgaucugcaagaugccccuucccaccaagcugagggcagcagcacagccgagcgcacccucaacugagucggcucagaacacagcaccuccaccguaugccccauga

SEQ ID NO: 3703 - RNA, 300 nt, Artificial Sequence
  derived and/or modified CDS sequence (wt) from Lassa virus__AIT17586__Z
augggcaacaaacaggccaaaucgacaaaagucgaugaacaucaaagagcucaucuagugccagaugcaucucaucuaggcccccaguucuguaagagcugcugguuugagaacagagggcugguagagugcaacaaccacuaccugugucucaacugucucagccugcuucucagcgucagcagcagguguccgaucugcaaaaugccccuucccaccaggcugaaggcagcagcacagccgagcgcacccucaaccgaggugacccagaacacaacaccuccaccguacaccccguga

SEQ ID NO: 3704 - RNA, 300 nt, Artificial Sequence
  derived and/or modified CDS sequence (wt) from Lassa virus__AIT17590__Z
augggcaacagacaggccaaaucgacaaagguugaugaacaucaaagagcucaucuagugccagaugcaucccaucuaggcccccaguucugcaagaguugcugguuugagaacaaaggguugguagagugcaauaaucauuaccugugucucaacugucucagcuugcuucucagcgucagcagcagaugcccgaucugcaagaugccucuucccaccaagcuagaggcaacgacacagccgagcgcaccaucaaccgaggagacccagagcacaacaccuccaccguacaccccguga

SEQ ID NO: 3705 - RNA, 300 nt, Artificial Sequence
  derived and/or modified CDS sequence (wt) from Lassa virus__AIT17602__Z
augggcaacaaacaggccaaaucaacaaaggucgaugaauaucaaagagcucaucuagugccagaugcaucccaucuaggcccccaguucuguaagagcugcugguuugaaaacagaggguugguagagugcaacaaccacuaccugugucucaacugucucagccugcuccucagugucagcaacagaugcccgaucugcaagaugccccuucccaccaggcuaaaagcagcagcacagccgagcgcacccccaaccgaggcgacccagaacacaacacccccaccguacaccccauga

SEQ ID NO: 3706 - RNA, 300 nt, Artificial Sequence
  derived and/or modified CDS sequence (wt) from Lassa virus__AIT17610__Z
augggcaacagacaggccaaaccaacaaaaguugaugaacaucaaagagcucaacuagugccagaugcaucccaucuaggcccccaguucugcaagaguugcugguuugagaacagaggguugguagagugcaacaaucacuaccugugucucaacugucucagccugcuccucagcgucagcagcagaugcccgaucugcaagaugccccuucccaccaagcuaaaggcggcaacacagccgagcgcaccaucaaccgaggcgacccagaacucaacaccuccaccguacaccccauga

SEQ ID NO: 3707 - RNA, 300 nt, Artificial Sequence
  derived and/or modified CDS sequence (wt) from Lassa virus__AIT17614__Z
augggcaacagacaagccaaaucgacaaaaguugaugaacaucaaagagcucaucuagugccagaugcaucccaucuaggcccccaguucugcaagagcugcugguuugagaacagaggguugguggagugcaauaaucacuaucugugucucaacugucucagccugcuccucagcgucagcagcagaugcccgaucugcaagaugccccuucccaccaagcuaaaggcagcaacacagccgagcgcaccaucaacugaggcgacccagaacacaacacccccaccguacaccccauga

SEQ ID NO: 3708 - RNA, 300 nt, Artificial Sequence
  derived and/or modified CDS sequence (wt) from Lassa virus__AIT17618__Z
augggcaacagacaggccaaaucgacagaagucgaugaacaucaaagagcucaucuagugccagaugcaucucaucuaggcccccaguucugcaagaguugcugguuugagaacagaggguugguagagugcaacaaucacuaccugugucucaacugucucagccugcuccucagcgucagcaacagaugcccgaucugcaagaugccucuccccaccaagcuaaaggcagcaacacagccgagcgcaccaucaaccgaggcgacccagaacacaacacccccaccauacaccccauga

SEQ ID NO: 3709 - RNA, 300 nt, Artificial Sequence
  derived and/or modified CDS sequence (wt) from Lassa virus__AIT17622__Z
augggcaacagacaggccaaaucgacaaaagucgaugaacaucaaagagcucaucuagugccagaugcaucccaucucggcccucaauucugcaagaguugcugguuugagaacagagggcugguagagugcaacaaucacuaccugugucucaacugucucagccugcuccucagcgucagcagcagaugcccgaucugcaagaugccccuucccaccaagcuaaaagcagcaacacagccgagcgcaccaucaaccgaagugacccagaacacaauaccuccaccauacuccccauga

SEQ ID NO: 3710 - RNA, 300 nt, Artificial Sequence
  derived and/or modified CDS sequence (wt) from Lassa virus__AIT17628__Z
augggcaacaagcaggccaaaucgacaaaaaucgaugaacaucaaagagcucaucuagugccagaugcaucucaucuaggcccccaguucuguaagaguugcugguuugagaacagagggcugguagagugcaacaaccacuaccugugucucaacugucucagccugcuucucagcgucagcagcagguguccgaucugcaaaaugccucuucccaccaggcugaaggcagcaacacagccgagcgcacccucaaccgaggcgacccagaacacaacaccuccaccauacaccccguga

SEQ ID NO: 3711 - RNA, 300 nt, Artificial Sequence
  derived and/or modified CDS sequence (wt) from Lassa virus__AIT17632__Z
augggcaauagacaggccaaaucgacaaaagucgaugaacaucaaagagcucauuuagugccagaugcaucccaucuaggcccucaguucugcaagaguugcugguuugagaacaaaggguugguagagugcaacaaucacuaccugugucucaauugucucagccugcuccucagcgucagcaguaggugcccgaucugcaagaugccccuucccaccaagcugagggcaacagcacagccgagcgcaccaucaaccgaggcgauccagaacacaacaccuccaccguacaccccguga

SEQ ID NO: 3712 - RNA, 300 nt, Artificial Sequence
  derived and/or modified CDS sequence (wt) from Lassa virus__AIT17636__Z
augggcaacagacaggcuaaaucgacaaaagucgaugaacaucaaagagcucaucuagugccagaugcaucccaucuaggcccccaguucugcaagaguuguugguuugagaacagaggguugguagaguguaacaaucacuaccugugucucaacugucucagccugcuucucagcgucagcaguagaugcccgaucugcaagaugccccuucccaccaagcuaaaggcagcagcacagccgagcgcaccaucaaucgagacgauccagaacacaacaccuccuccguacaccccauaa

SEQ ID NO: 3713 - RNA, 300 nt, Artificial Sequence
  derived and/or modified CDS sequence (wt) from Lassa virus__AIT17640__Z
augggcaacagacaggccaaaucgacaaaagucggugaacaucaaagagcucaucuagugccagaugcaucccaucuaggcccccaguucuguaagaguugcugguuugagaacagaggguugguagaguguaacaaccacuaccugugucucaacugucucagccugcuccucagugucagcagcagaugcccgaucugcaagaugccccuucccaccaagcuaaaggcagcagcacagccaagcgcacccucaacugaggcgacccaggacacaacaccuccaccguacaccccauaa

SEQ ID NO: 3714 - RNA, 300 nt, Artificial Sequence
  derived and/or modified CDS sequence (wt) from Lassa virus__AIT17648__Z
augggcaacagacaggccaaaucaacaaaagucgaugaacaucaaagagcucaucuagugccagaugcaucccaucuaggcccccaguuuugcaaaaguugcugguuugagaacaagggguugguagagugcaacaaccacuaccugugucucaacugccucagccugcuccuuagcguuagcagcagaugcccgauuuguaagaugccccuucccaccaagcuaaaggcaacaguacagccaagugcacccucgacugaggcggcccagagcacagcaccuccaccguaugccccauga

SEQ ID NO: 3715 - RNA, 300 nt, Artificial Sequence
  derived and/or modified CDS sequence (wt) from Lassa virus__AIT17652__Z
auggguaacagacaggccaaaucgacaaaagucggugaacaucaaagagcucaucuagugccagaugcaucccaucuaggcccccaguucugcaagaguugcugguuugagaacagaggguugguagagugcaacaaucacuaccugugucucaacugucucagccugcuccucagugucagcagcaggugcccgaucugcaagaugccccuccccaccaagcuaaaggcagcagcacagccaagcgcaccaucagccgaggcaauccagaaaacaacaccuccaccguacaccccauaa

SEQ ID NO: 3716 - RNA, 300 nt, Artificial Sequence
  derived and/or modified CDS sequence (wt) from Lassa virus__AIT17656__Z
augggcaacagacaggccaaaucgacaaaagucgaugaucaucaaagagcucaucuagugccagaugcaucccauuuaggcccccaguucugcaagaguuguugguuugagaacaggggguugguagaguguaacaaccacuaccugugucucaacugucucagucugcuccucagcgucagcagcagaugcccgaucugcaagaugccccuucccaccaagcuaaaggcagcagcacagccgagcgcacccucaaccgaggcggcccaggacacaacaccuccaccguacaccccauga

SEQ ID NO: 3717 - RNA, 300 nt, Artificial Sequence
  derived and/or modified CDS sequence (wt) from Lassa virus__AIT17660__Z
augggcaacagacaggccaaaucgacaaaagucgaugaacaucaaagagcucaucuagugccagaugcaucccaucuaggcccccaguucugcaagaguugcugguuugagaacagaggguugguggagugcaacaaucacuaccugugucucaacugucucagccugcuccucagcgucaguaacaggugcccgaucugcaagaugccccuucccaccaagcuaaaggcagcagcacagccaagugcaccaucaaccgaggcgauccagaacacaacaccuccaccguacgcuccauaa

SEQ ID NO: 3718 - RNA, 300 nt, Artificial Sequence
  derived and/or modified CDS sequence (wt) from Lassa virus__AIT17664__Z
augggcaacaaacaggccaaaucaacaaaagucgaugagcaucaaagagcucaucuagugccagaugcaucccauuugggcccccaauuuugcaaaaguugcugguuugagaacaaaggguugguggagugcaacaaucauuaccugugucucaacugucucagucugcuccucagcgucagcagcagaugcccgaucugcaagaugccccuucccaccaagcugaaggcagcugcacagccgagcgcacccucaaccgaggcggcccaaaacacagcaccuccaccguaugccccauga

SEQ ID NO: 3719 - RNA, 300 nt, Artificial Sequence
  derived and/or modified CDS sequence (wt) from Lassa virus__AIT17668__Z
auggguaacagacaggccaaaucaacaaaagucgaugaacaucaaagagcucaucuagugccagaugcaucccaucuaggcccccaguuuugcaaaaguugcugguuugagaacaagggguugguugagugcaacaaccacuaccugugucucaacugucucagccugcuccuuagcguuagcagcagaugcccgauuugcaagaugccccuccccaccaagcuaaagacaacagcacagccaagugcacccccgacugaggcggccaagaacacagcaccuccaccguaugccccauga

SEQ ID NO: 3720 - RNA, 300 nt, Artificial Sequence
  derived and/or modified CDS sequence (wt) from Lassa virus__AIT17676__Z
augggcaacagacaggccaaaucgacaaaagucgacgaacaucaaagagcacaucuagugccagaugcaucccaucuaggcccccaguucugcaagaguugcugguuugagaacagaggguuaguagagugcaacaaucauuaccugugucucaauugucucagccugcuucucagcgucagcagcagauguccaaucuguaagaugccccuucccaccaagcuaaaggcagcaacacagccgagugcaccaucaaccgaggugacccagaacacaacaccuccaccguacaccccauga

SEQ ID NO: 3721 - RNA, 300 nt, Artificial Sequence
  derived and/or modified CDS sequence (wt) from Lassa virus__AIT17680__Z
auggguaacagacaggcuaaaucgacaaaaaucgaugaacaucaaagagcucaucuagugccagaugcaucccaucuaggcccccaguucugcaagaguugcugguuugagaacagaggguugguagagugcaacaaucacuaccugugucucaacugucucagccugcuccucagcgucagcagcagaugcccgaucugcaagaugccccuucccaccaagcuaaaggcagcagcacagccgagcgcaccaucaacagaggcgauccagaauacaacacccccaccguacaccccguaa

SEQ ID NO: 3722 - RNA, 300 nt, Artificial Sequence
  derived and/or modified CDS sequence (wt) from Lassa virus__AIT17684__Z
augggcaacagacaggccaaaucggcaaaagucgaugaacaucaaagagcucaucuagugccagaugcaucccaucuaggcccccaguucugcaagaguugcugguucgagaacaagggguuaguagagugcaacaaucacuaccugugucucaauugucucagccuacuccucagcgucagcugcagaugcccgaucugcaagaugccccuucccaccaagcuaaaggcagcaacacagccaagcgcgccaucaaccgaggcgacccagaacacaacaccuccaccguacaccccauga

SEQ ID NO: 3723 - RNA, 300 nt, Artificial Sequence
  derived and/or modified CDS sequence (wt) from Lassa virus__AIT17692__Z
augggcaacagacaugccaaaccgacaaaagucgaugaacaucaaagagcucaucuagugccagaugcaucccaucuaggcccccaguucugcaagaguugcugguuugagaacagaggguugguggagugcaacaaucacuaccugugucucaacugucucagcuugcuccucagugucagcagcagaugcccgaucugcaagaugccccuucccaccaagcugaaggcagcagcacagccgagugcaccaucaaccgaggcgauccagaauacaacacccccaccauacaccccauga

SEQ ID NO: 3724 - RNA, 300 nt, Artificial Sequence
  derived and/or modified CDS sequence (wt) from Lassa virus__AIT17702__Z
augggcaacagacaugccaaaucgacaaaagucgaugaacaucaaagagcucaucuggugccagaugcaucccaucuaggcccccaguucugcaagaguugcugguuugagaacagaggguugguagagugcaacaaucacuaccugugucucaacugucucagccugcuccucagugucagcagcagaugcccgaucugcaagaugccccuucccaccaagcuaaaggcagcagcacagccgagugcaccaucaaccgaggcguuccagaacacaacaccuccaccauacaccccauaa

SEQ ID NO: 3725 - RNA, 300 nt, Artificial Sequence
  derived and/or modified CDS sequence (wt) from Lassa virus__AIT17708__Z
augggcaacagacaugccaaaucgacaaaagucgaugaacaucaaagagcucaucuggugccagaugcaucccaucuaggcccccaguucugcaagaguugcugguuugagaacagagggcugguagagugcaacaaucacuaccugugucucaacugucucagccugcuccucagugucagcagcagaugcccgaucugcaagaugccccuucccaccaagcuaaaggcagcaacacagccgagugcaccaucaaccgaggcgauccagaacacaacaccuccaccauacaccccauaa

SEQ ID NO: 3726 - RNA, 300 nt, Artificial Sequence
  derived and/or modified CDS sequence (wt) from Lassa virus__AIT17716__Z
augggcaauagaccggcgaaaucgacaaaaguugaugaacaucaaagagcucaucuagugccagaugcaucccaucuaggcccccaguucugcaagaguugcugguuugaaaacagagggcuaguagagugcaacaaccacuaccugugucucaacugucucagccugcuccucagcgucaguagcagaugcccgaucugcaagaugccccuucccaccaagcuaaaggcagcagcacagccgagcgcacccucaaccgaggcgacccagaacacaacaccuccaccguacaccccauga

SEQ ID NO: 3727 - RNA, 300 nt, Artificial Sequence
  derived and/or modified CDS sequence (wt) from Lassa virus__AIT17720__Z
auggguaacagacaggccaaaccgacaaaagucgaugaacaucaaagagcucaucuagugccagaugcaucccaucugggcccccaauucugcaagaguugcugguuugagaacagaggguugguagagugcaacaaucacuacuugugucucaacugucucagcuugcuccucagcgucagcagcagaugcccgaucugcaagaugccucuucccaccaggcuaaaagcagcagcacagccgagcgcaccaucaaccgaagagacccagaacacaacaccuccaccguacaccccauga

SEQ ID NO: 3728 - RNA, 300 nt, Artificial Sequence
  derived and/or modified CDS sequence (wt) from Lassa virus__AIT17730__Z
augggcaacagacaggcuaaaucgacaaaaguugaugaacaucaaagagcucaucuagugccagaugcaucccaucuaggcccccaguucugcaagagcugcugguuugagaacagaggguugguagaaugcaacaaucacuaccugugucucaacugucucagccugcuccucagcgucaguagcagaugcccgaucugcaagaugccccuccccacuaagcuaaaggcagcagcacagccgagcgcaccauuaaccgaggcgauccaaaacacaacaccuccaccauacaccccguaa

SEQ ID NO: 3729 - RNA, 300 nt, Artificial Sequence
  derived and/or modified CDS sequence (wt) from Lassa virus__AIT17734__Z
augggcaacagacaggccaaaucgacaaaagucgaugaacaucaaagagcucaucuagugccagaugcaucccaucuaggcccccaauucugcaagaguugcugguuugagaacagaggguugguagaguguaacaaucacuaccugugucucaacugucuuagccugcuccucagcgucagcagcagaugcccgaucugcaagaugccccuucccaccaagcuaaaggcagcagcacagccgagcgcaccaucaaccgaggcgauccagaacacaacaccuccaccuuacaccccauaa

SEQ ID NO: 3730 - RNA, 300 nt, Artificial Sequence
  derived and/or modified CDS sequence (wt) from Lassa virus__AIT17738__Z
augggcaacagacaggccaaaucgacaaaagucgaugaacaucaaagagcucaucuagugccagaugcaucccaucucggcccucaauucugcaagaguugcugguuugagaacagaggguugguagagugcaacaaucacuaccugugucucaacugucucagccugcuccucagcgucagcagcagaugcccgaucugcaagaugccccuucccaccaagcuaaaggcagcaacacugccgagcgcaccaucaaccgaagugacccagaacacaacaccuccaccacacuccccauga

SEQ ID NO: 3731 - RNA, 300 nt, Artificial Sequence
  derived and/or modified CDS sequence (wt) from Lassa virus__AIT17750__Z
auggguaauagacaggccaaaucggcaaaagucaaugaacaucaaagagcucaccuagugccagaugcaucccauuuaggcccccaguucugcaagaguugcugguucgagaacagaggguugguagagugcaacaaccacuaccugugucucaacugucucagucugcuccucagcgucagcagcaggugcccgaucuguaagaugccccuucccaccaagcuaaaggcagcaacacagccgagugcacccucaacugaagcgacccagaacacaacaccuccgccguacaccccauaa

SEQ ID NO: 3732 - RNA, 300 nt, Artificial Sequence
  derived and/or modified CDS sequence (wt) from Lassa virus__AIT17754__Z
auggguaacagacaggccaaaucaacaaaagucgaugaacaucaaagagcucaucuagugccagaugcaucccaucuaggcccccaguuuugcaaaaguugcugguuugagaacaagggguugguagagugcaacaaccacuaccugugucucaacugucucagccugcuccuuagcgucagcagcagaugcccgauuugcaagaugccccuucccaccaagcuaaaggcaucagcacagccaagugcacccucaacugaggcggcccagaacacagcaccuccaccguaugccccauga

SEQ ID NO: 3733 - RNA, 300 nt, Artificial Sequence
  derived and/or modified CDS sequence (wt) from Lassa virus__AIT17760__Z
augggcaacagacaggccaaaucaacaagaacugaugaacaucaaagagcucaucuaguaccagaugcaucccaucuaggcccucaguucugcaaaaguugcugguuugagaacaagggguuaguagaaugcaacaaccacuaccugugucucaacugucucagccugcuccucuccgucagcagcagaugcccgaucugcaagaugccucuucccaccaaauuaaaggcagcagcacaaccgagcgcacccucaacugaggcgggccagaacacagcaccuccaccguacgccccauga

SEQ ID NO: 3734 - RNA, 300 nt, Artificial Sequence
  derived and/or modified CDS sequence (wt) from Lassa virus__AIT17768__Z
augggcaacagacaggccaaaucagcaacagucgaugaaugucaaagagcucaucuaguaccagaugcauccuaucugggcccccaauucugcaagaguugcugguuugagaacaaagggcugguagagugcaacaaucacuaucugugucucaacugucucagccugcuccucagcgucagcagcagaugccccaucugcaagaugccucuucccaccaagcugaaggcagcagcacagccgagcgcaccaucaaccagggcgacccagaacacaacaccuccaccguauaccccauaa

SEQ ID NO: 3735 - RNA, 300 nt, Artificial Sequence
  derived and/or modified CDS sequence (wt) from Lassa virus__AIT17776__Z
augggcaacaaacaagccaaaucaacaaaagucgaugagcaucaaagagcucaucuagugccagaugcaucccaucuaggcccccaguuuugcaaaagcugcugguuugagaacaagggguugguagaguguaacaaccacuaccugugccucaacugucucagccugcuccucagcgucagcagcagaugcccgaucugcaagaugccccuucccaccaggcuaaaggcagcagcacagccgagcgcacccucaacugaggcgacccagaacgcagcaccuccaccguaugccccauga

SEQ ID NO: 3736 - RNA, 300 nt, Artificial Sequence
  derived and/or modified CDS sequence (wt) from Lassa virus__AIT17780__Z
augggcaacagacagaccaaaucgacaaaagucgaugaacaucaaagagcuuaucuagugccagaugcaucccuucuaggcccccaguucugcaagaguugcugguuugagaacaaaggguugguagaaugcaacaaucacuaccugugucuuaacugucucagccugcuccucagcgucagcagcagaugcccgaucugcaagaugccucuucccaccaggcuaaaggcagcagcacagccgagugcaccaccaacugaggcgauccagaacacaacaccuccaccguacaccccauaa

SEQ ID NO: 3737 - RNA, 300 nt, Artificial Sequence
  derived and/or modified CDS sequence (wt) from Lassa virus__AIT17784__Z
augggcaacagacagaccaaaccaacaaaagucgaugagcaucaaagagcucaucuagugccagaugcaucccaucuaggcccccaguuuugcaaaaguugcugguuugagaacaagggguugguggagugcaacaaccacuaccugugccucaacugucucagccuacuccucagcguuagcagcagaugcccgaucugcaagaugccccuucccaccaagcugaaggcaacagcacagccgagcgcacccucaacugaggcggcccagaacacagcaccuccaccguaugccccauga

SEQ ID NO: 3738 - RNA, 300 nt, Artificial Sequence
  derived and/or modified CDS sequence (wt) from Lassa virus__AIT17788__Z
augggcaacagacaggucaaaucgacaaaagucgaugaacaucaaagagcucaucuagugccagaugcaucccauuuaggcccccaguucugcaagaguugcugguuugagaacagaggguugguagagugcaauaaucacuaccugugucucaacugucucagccugcuccucagugucagcagcaggugcccgaucugcaagaugccccuccccaccaagcuaaaagcagcaacacagccaagcgcaccaccaaccgaggcgacccagaaaaccacaccuccaccguauaccccauaa

SEQ ID NO: 3739 - RNA, 300 nt, Artificial Sequence
  derived and/or modified CDS sequence (wt) from Lassa virus__AIT17792__Z
augggcaacaaacaggcaaaaucgacaaaggucgaugaacaucaaagagcucaucuagugccagaugcaucucaucuaggcccccaguucugcaagaguugcugguuugagaacagagggcugguugagugcaacaaccacuacuugugccucaacugucucagccugcuucucagugucagcggcagguguccgaucugcaaaaugccccuucccaccaagcuaaaagcaacagcacaaccgagugcacccucaaccgaggcgacccagaacacgacaccuccaccguacaccccguga

SEQ ID NO: 3740 - RNA, 300 nt, Artificial Sequence
  derived and/or modified CDS sequence (wt) from Lassa virus__AIT17796__Z
augggcaacaaacaggccaaaucgacaaaagucgaugaacaucaaagagcucaucuagugccagaugcaucccaucuaggcccccaguucugcaagaguugcugguuugagaacagaggguugguagaguguaacaaucacuaccugugucucaacugucuuagccugcuccucagcgucagcagcagaugcccgaucugcaagaugccccuucccaccaagcuaaaggcagcagcacagccgagcgcaccaucaacugaggcgauccagaacacaacaccuccaccuuacaccccauaa

SEQ ID NO: 3741 - RNA, 300 nt, Artificial Sequence
  derived and/or modified CDS sequence (wt) from Lassa virus__AIT17800__Z
augggaaacaagcaagccaaagccccagaagcaaaagacagcccgagagccagccuaaucccagaugccacacaucuagggccacaguucugcaagagcugcugguucgaaaacaagggccugguugagugcaacaaccacuaucugugucucaacugccucaccuuacuucuaagugucaguaacaggugccccauuugcaagaugccucuuccuacaaaacugagaccaucagccacuccaacagcaccuccaacugaagcagcggacagcaucagaccuccacccuaccaucccuga

SEQ ID NO: 3742 - RNA, 300 nt, Artificial Sequence
  derived and/or modified CDS sequence (wt) from Lassa virus__AIT17804__Z
augggaaacaagcaagccaaagccucagaagaaaaaaacaguccgagagccagccugauuccagaugccacacaccuagggccacaauucugcaagagcugcugguucgaaaacaagggccugguugagugcaacaaccacuaucugugucucaacugccucaccuuacuuuuaagugucagcaacaggugccccaucugcaagaugccucuucccacaaaacugagaccaucaaccacuccaacagcaccuccaacuggagcagcggacagcaucagacccccacccuacagucccuga

SEQ ID NO: 3743 - RNA, 300 nt, Artificial Sequence
  derived and/or modified CDS sequence (wt) from Lassa virus__AIT17808__Z
augggaaacaagcaagccaaagccccagaaucaaaggacaguccgagagccagucugaucccagaugcuacacaucuagggccgcaauucuguaagagcugcugguucgaaaacaagggccugguugagugcaacaaccacuaucugugucucaacugccucacccuacuucuaagugucagcaacaggugccccauuugcaagaugccucuccccacaagacugagaccaucagccgcuccaacagcacccccaaccggagcagcggacagcaccagaccuccacccuacagucccuga

SEQ ID NO: 3744 - RNA, 303 nt, Artificial Sequence
  derived and/or modified CDS sequence (wt) from Lassa virus__AIT17834__Z
augggcaacaagcagaccagguccccacccaaaccagagcaccccagaccaacccugcuacccgacgcaucccaccugggcccccaauucugcaagagcugcugguuugagaacaagggacugguggaguguaauaaccauuaccucugucuaaacugucucacacugcuucucagcgugagcgacagauguccuauuuguaagaugccccuccccaccaagcuggcaguccgaacccaaccaagugcacccccacucaaccagggcaacacucaauccuccccgccccccuacagccccuaa

SEQ ID NO: 3745 - RNA, 300 nt, Artificial Sequence
  derived and/or modified CDS sequence (wt) from Lassa virus__AIT17838__Z
augggaaacaaacaagccaaggucccagaaucaaaagacagcccgagagccagccuaaucccagaugccacacaucuagggccgcaauucuguaagaguugcugguucgaaaacaagggccugguugaguguaacaaccacuaucugugucucaacugccucaccuuacuuuugagugucagcaacaggugccccauuugcaagaugccucuccccacaaaacugaaaccaucagccgcuccaacagcacccccaacuggagcagcggacagcaucagacccccaccuuacagucccuga

SEQ ID NO: 3746 - RNA, 300 nt, Artificial Sequence
  derived and/or modified CDS sequence (wt) from Lassa virus__AIT17842__Z
augggaaacaaacaagccaaggucccagaaucaaaagacagcccgagagccagccuaaucccagaugccacacaucuagggccgcaauucuguaagaguugcugguucgaaaacaagggccugguugagugcaacaaccacuaucugugucucaacugccucaccuuacuuuugagugucagcaacaggugccccauuugcaagaugccucuccccacaaaacugagaccaucagccgcuccaacagcacccccaacuggaguagcggacagcaucagacccccaccuuacagucccuga

SEQ ID NO: 3747 - RNA, 300 nt, Artificial Sequence
  derived and/or modified CDS sequence (wt) from Lassa virus__ANH09743__Z
augggaaacaagcaggccaaagccucagaaguggaggaugguccaagggccagucugaucccagaugccacacaccuggggccacaguucugcaagagcugcugguucgaaaauaagagcuugguugagugcaacaaccauuaucugugccucaacugccucacucugcuucugagcgucagcaacaggugccccaucugcaaaaugccucucccaacaagacugaaaccaucagucgucccaacagcaccccccaccagagcaggagacggcaccaggcccccacccuacagucccuaa

SEQ ID NO: 3748 - RNA, 300 nt, Artificial Sequence
  derived and/or modified CDS sequence (wt) from Lassa virus__ANH09745__Z
augggaaacaagcagaccaaagccccagaaguggaggauggcccgagggccagcuugaucccagaugccacacaccuagggccucaguucugcaagagcuguugguucgaaaauaagggcuugguugagugcaacaaccauuaucugugccucaacugccucacucugcuccugagcgucagcagcaggugccccaucugcaagaugccucucccgacaagacuaaaaccaucaaucgucccaacagcaccccccgccagaacaggagaaaacaccagaccuccacccuauagucccuga

SEQ ID NO: 3749 - RNA, 300 nt, Artificial Sequence
  derived and/or modified CDS sequence (wt) from Lassa virus__ANH09749__Z
augggaaacaaacaggccaaagcuccagaaguagaggauggcccaagggccagucugaucccagaugccacacaccuagggccacaguucugcaagagcuguugguuugagaauaggggcuugguugagugcaacaaccauuaucugugccucaacugccucacucugcuucugagcgucagcaacaggugccccaucugcaaaaugccucucccaacaagacuaaaaccaucagucguuccaacagcaccccccacuggagcaggaggcgacaccagacccccacccuacagucccuga

SEQ ID NO: 3750 - RNA, 300 nt, Artificial Sequence
  derived and/or modified CDS sequence (wt) from Lassa virus__ANH09751__Z
augggaaacaaacaggccaaagccccaaaagcggaggauggcccgagggccagucugaucccagaugccacacaccuagggccacaguucugcaagagcugcugguuugagaacaagggcuugguugagugcaacaaccauuaucuaugccucaacugccucacuuugcuucugagcgucagcaacaggugccccaucuguaaaaugccucucccaacaagacuaaaaccaucaguugucccaacagcaccccccaccggagcaggaggcgacaccagacccccaccccacagucccuga

SEQ ID NO: 3751 - RNA, 300 nt, Artificial Sequence
  derived and/or modified CDS sequence (wt) from Lassa virus__ANH09753__Z
auggggaacaaacaggccaaagccucagaagcagaggauggcccgagggccagucugaucccagaugccacacaccuagggccacaguucugcaagagcugcugguuugaaaacaagggcuugguugagugcaacaaccauuaucugugccucaacugccucacucugcuucugagcgucagcagcaggugccccaucugcaaaaugccccucccaacaagauuaagaccaucagucgucccaacagcacccuccgccggagcaggagacggcaccaggcccccgcccuacagucccuaa

SEQ ID NO: 3752 - RNA, 300 nt, Artificial Sequence
  derived and/or modified CDS sequence (wt) from Lassa virus__ANH09755__Z
augggcaacaaacaaaccaagaccaucaaaaagacagacagcccaagagcuagucugaucccugaugccucccacaugggaccccaguucugcaagaguuguugguuugaaaauagaggucuaguugagugcaacaaucacuaccuaugucucaauugccucucauuacuccugagcgucagcaacaggugucccaucugcaagaugccccuacccacaaaacucagggcaucccccagcccaacugcccccuccaucagagaggccaacaucacaaaucccccaccauauagccccuaa

SEQ ID NO: 3753 - RNA, 300 nt, Artificial Sequence
  derived and/or modified CDS sequence (wt) from Lassa virus__ANH09759__Z
augggcaacaaacaaaccaagaccaccaaaaagacagacagcccgagagcuagucugaucccugaugccucccacaugggaccccaguucugcaagaguuguugguuugaaaauagaggucuaguugagugcaacaaucacuaccuaugucucaauugccucucauuacuccugagcgucagcaacaggugucccaucugcaagaugccccuacccacaaaacucagggcaucccccagcccaacugcccccuccaucagagaggccaacaucacaaaucccccaccauauagccccuaa

SEQ ID NO: 3754 - RNA, 300 nt, Artificial Sequence
  derived and/or modified CDS sequence (wt) from Lassa virus__ANH09761__Z
augggcaacaaagggaccaaacccacccagaacucagaacccagcagggccaaccuagugccugaugcaagcuacuuaggaccccaguucugcaagaguugcugguuugaaaacaaagggcugguggaguguaacaaucauuaucucugccucaacugucucacaaugcuucucucugucagcaacaggugcccaaucugcaaaaugccgcuucccaccaaaauaaaggccucaggaagccccagcgcuccuccgaccgaggccaacuccgcagucagccccccuccauacacccccuaa

SEQ ID NO: 3755 - RNA, 300 nt, Artificial Sequence
  derived and/or modified CDS sequence (wt) from Lassa virus__AMR44579__Z
augggagccagacagaccaagcaaccucagauugagggaucuccuagagccucucuggugcccgaugcaagccaucuaggaccccaguucugcaagagcugcugguuugagaacaaagggcuuguggaguguaacaaucauuaccuuugccucaauugccucagccuccuacucagugucagcaacaggugcccuaucugcaagaugccccuccccaccaagcugagagugucaagcgcucccagugcacccccagcggccacggcccaacccggaacuccuccaccauacagccccuag

SEQ ID NO: 3756 - RNA, 300 nt, Artificial Sequence
  derived and/or modified CDS sequence (wt) from Lassa virus__AMZ00378__Z
augggcaacaggcaaaccaaggccacggaggcaaaggacagcccaagggccagucugaucccagaugcuacacauuuaggaccacaguucugcaaaaguuguugguuugaaaacaagggccuaguugagugcaauaaccacuaccugugucuuaacugccuuacccugcuccugagcgucagcagcagaugccccaucuguaaaaugccucuccccacaagacugaagucaucaaccaacccaacggcacccucagccaaaacagaaagcagcaucaacccuccaccguacagccccuga

SEQ ID NO: 3757 - RNA, 300 nt, Artificial Sequence
  derived and/or modified CDS sequence (opt1) from Lassa virus__ADY11072__Z
augggcaacaagcaggccaaggcccccgagagcaaggacuccccgcgcgcgagccugauccccgacgccacccaccucgggccccaguucugcaaguccugcugguucgagaacaagggccugguggagugcaacaaccacuaccugugccucaacugccugacccugcuccugagcgucuccaaccggugccccaucugcaagaugccgcugcccacgaagcuccgccccagcgccgcccccaccgccccgcccaccggggcggccgacuccauccggcccccgcccuacagccccuga

SEQ ID NO: 3758 - RNA, 300 nt, Artificial Sequence
  derived and/or modified CDS sequence (opt1) from Lassa virus__AAO59514__Z
augggcaacaagcagguccgcagcaugaagaagguggacagcccccgggccucccugauccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugccgaccaagcucaagaccuccacgacccccaccgcgcccagcauccgcgaggccaacaccacgagcccgccgcccuacucccccuga

SEQ ID NO: 3759 - RNA, 300 nt, Artificial Sequence
  derived and/or modified CDS sequence (opt1) from Lassa virus__AAO59508__Z
augggcaaccgccaggccaagaaccccgagguggagaacagcccccgggccucccugauccccgacgcgacccaccucgggccccaguucugcaagagcugcugguucgagaacaagggccuggucgagugcaacaaccacuaccugugccucaacugccugucccugcuccugagcguguccaaccgcugccccaucugcaagaugccgcugcccacccggcuccgccccacgaccacccccaccgccccgcagaucaucaaggagaacacgaccaacccgccgcccuacacccccuga

SEQ ID NO: 3760 - RNA, 300 nt, Artificial Sequence
  derived and/or modified CDS sequence (opt1) from Lassa virus__AAO59510__Z
augggcaacaagcagaccaaggcccccgaggccaaggacagcccgcgcgcgucccugauccccgacgccaccuaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgcccccaccgccccgcccgcgggggccgcccacagcgcccggcccccgcccuacucccccuga

SEQ ID NO: 3761 - RNA, 300 nt, Artificial Sequence
  derived and/or modified CDS sequence (opt1) from Lassa virus__AAT48997__Z
augggcaacaagcaggccaaggcccccgagaccaagaacagcccccgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgugcccaccgccccgcccgcccaggugggggaccggacccgcccgccgcccuacagccccuga

SEQ ID NO: 3762 - RNA, 300 nt, Artificial Sequence
  derived and/or modified CDS sequence (opt1) from Lassa virus__AAT49005__Z
augggcaacaagcaggccaaggcccccgagaccaaggacagcccgcgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccacccgccuccggcccuccgccgugcccaccgccccgcccgcccccgcgggggaccgcaccaagcccccgcccuacagccccuga

SEQ ID NO: 3763 - RNA, 300 nt, Artificial Sequence
  derived and/or modified CDS sequence (opt1) from Lassa virus__ADU56612__Z
augggcaaccgccagacccggcccaccgaggccacggagcagagccgcgcccaccuggugccggacgccucccaccucgggccccaguucugcaagagcugcugguucgagaaccggggccuggucgagugcaacaaccacuaccugugccucaacugccugucccugcuccugagcguguccagccgcugccccaucugcaagaugccccugccgacccggcucaaggccuccgcccagcccagcgccccgcccaccgaggcgccccagaacaccacgcccccgcccuacacccccuga

SEQ ID NO: 3764 - RNA, 300 nt, Artificial Sequence
  derived and/or modified CDS sequence (opt1) from Lassa virus__ADU56616__Z
augggcgggaagcacaccaagcagccccgcgagagcaacuccccgcgggccagccugauccccgacgccacccaccucggcccccaguucugcaaguccugcugguucgagaacaaggggcugguggagugcaacaaccacuaccugugccucaacugccugagccugcuccuguccgucagcaaccgcugccccaucugcaagaugccccugcccacgcggcuccgcaccuccaccaaccccaccgcgccccagguggagcagacgggcccggccagcccgccgcccuacucccccuga

SEQ ID NO: 3765 - RNA, 300 nt, Artificial Sequence
  derived and/or modified CDS sequence (opt1) from Lassa virus__ADU56620__Z
augggcgggaagcacaccaagccccagcgcgagagcaacuccccgcgggccagccugauccccgacgccacccaccucggcccccaguucugcaaguccugcugguucgagaacaaggggcugguggagugcaacaaccacuaccugugccucaacugccugacgcugcuccugagcguguccaaccgcugccccaucugcaagaugccccugcccacccggcuccgcgccagcaccaaccccaccgcgccccagguggagcaggucggcccgacgaacccgccgcccuacucccccuga

SEQ ID NO: 3766 - RNA, 300 nt, Artificial Sequence
  derived and/or modified CDS sequence (opt1) from Lassa virus__ADU56624__Z
augggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcgauccagaacaccaccccgccgcccuacacccccuga

SEQ ID NO: 3767 - RNA, 300 nt, Artificial Sequence
  derived and/or modified CDS sequence (opt1) from Lassa virus__ADU56628__Z
augggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcgauccagaacaccaccccgccgcccuacgcccccuga

SEQ ID NO: 3768 - RNA, 300 nt, Artificial Sequence
  derived and/or modified CDS sequence (opt1) from Lassa virus__ADU56632__Z
augggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcgacccaggacaccaccccgccgcccuacacgcccuga

SEQ ID NO: 3769 - RNA, 300 nt, Artificial Sequence
  derived and/or modified CDS sequence (opt1) from Lassa virus__ADU56644__Z
augggcaaccgccagaccaaggcccccgaggccaaggggagcccccgggcgucccugauccccgacgccacccaccucggcccccaguucugcaagagcugcugguucgagaacaaggggcugguggagugcaacgaccacuaccugugccucaacugccugacgcugcuccuguccgucagcucccgcugccccaucugcaagaugccgcugcccacccggcuccgccccagcaccaaccccaccgccccgcccgcccgggccgagggcgggaucaacccgccgcccuacucccccuga

SEQ ID NO: 3770 - RNA, 300 nt, Artificial Sequence
  derived and/or modified CDS sequence (opt1) from Lassa virus__AHC95545__Z
augggcaacaagcaggccaaggaccccaagaccgagagcuccccgcgcgccagccugauccccgacgcgacccaccucgggccccaguucugcaaguccugcugguucgagaacaagggccugguggagugcaacaaccacuaccugugccucaacugccugagccugcuccuguccgucagcaaccggugccccaucugcaagaugccccugcccacgaagcucaagcccaucaccacccccaccgccccgcagaucacgcgcgaguccaucaccaacccgccgcccuacacccccuga

SEQ ID NO: 3771 - RNA, 300 nt, Artificial Sequence
  derived and/or modified CDS sequence (opt1) from Lassa virus__AHC95547__Z
augggcaaccgccaggccaaggaccccaagguggagagcuccccgcgggccagccugauccccgacgcgacccaccucgggccccaguucugcaaguccugcugguucgagaacaagggccuggucgagugcaacaaccacuaccugugccucaacugccugagccugcuccuguccgugagcaaccgcugccccaucugcaagaugccccugcccacccggcuccgccccacgaccaugcccaccgccccgcagaucaucaaggaggggaccacgaacccgccgcccuacacccccuga

SEQ ID NO: 3772 - RNA, 300 nt, Artificial Sequence
  derived and/or modified CDS sequence (opt1) from Lassa virus__AIT17124__Z
augggcaacaagcaggucaagacccccgaggccaaggacagcccccgcgccucccugauccccgacgcgacccaccucgggccccaguucugcaagagcugcugguucgagaacaagggccugguggagugcaacaaccacuaccugugccucaacugccugacgcugcuccuguccguggggaaccggugccccaucugcaagaugccgcugcccaccaagcuccgccccagcgugacccccaccgccccgcccacgcgggccgccgacuccaucggcccgccgcccuacagccccuga

SEQ ID NO: 3773 - RNA, 300 nt, Artificial Sequence
  derived and/or modified CDS sequence (opt1) from Lassa virus__AIT17128__Z
augggcaacaagcaggccaagacccccgaggccaaggacagcccgcgcgcgaaccugauccccgacgccacccaccucgggccccaguucugcaaguccugcugguucgagaacaagggccugguggagugcaacaaccacuaccugugccucaacugccugacgcugcuccugagcgucuccaaccggugccccaucugcaagaugccgcugcccaccaagcuccgccccagcgccgcccccaccgccccgcccaccggggcggccgacuccauccggcccccgcccuacagccccuga

SEQ ID NO: 3774 - RNA, 300 nt, Artificial Sequence
  derived and/or modified CDS sequence (opt1) from Lassa virus__AIT17132__Z
augggcaacaagcaggccaaggcccccgaggcgcgcgacagcccccgggccucccugauccccgacgccacccaccucgggccccaguucugcaagagcugcugguucgagaacaagggccugguggagugcaacaaccacuaccugugccucaacugccugacccugcuccuguccgucagcaaccgcugccccaucugcaagaugccgcugcccacgaagcuccggcccuccgccacccccaccgccccgcccaccgaggcggccgacagcauccgcccgccgcccuaccggcccuga

SEQ ID NO: 3775 - RNA, 300 nt, Artificial Sequence
  derived and/or modified CDS sequence (opt1) from Lassa virus__AIT17136__Z
augggcaacaagcagaccaaggcccccgagagcaagaacuccccgcgcgccagccugauccccgacgcgaccuaccucgggccccaguucugcaaguccugcugguucgagaacaagggccugguggagugcaacaaccacuaccugugccucaacugccugacgcugcuccugagcgucuccaaccggugccccaucugcaagaugccgcugcccaccaagcuccgcagcuccgccgcccccaccgcgcccccgaccggggccgccgacagcacgaagcccccgcccuacucccccuga

SEQ ID NO: 3776 - RNA, 300 nt, Artificial Sequence
  derived and/or modified CDS sequence (opt1) from Lassa virus__AIT17140__Z
augggcaacaagcaggccaaggcccccgagcccaaggacagcccccgcgcgucccugauccccgacgccacccaccucgggccccaguucugcaagagcugcugguucgagaacaagggccugguggagugcaacaaccacuaccugugccucaacugccugacccugcuccuguccgucagcaaccggugcccgaucugcaagaugccccugcccacgaagcuccgccccuccgccgccccgaccgccccgcccgcgggggccguggacagcacccggcccccgcccuacucccccuga

SEQ ID NO: 3777 - RNA, 300 nt, Artificial Sequence
  derived and/or modified CDS sequence (opt1) from Lassa virus__AIT17144__Z
augggcaacaagcaggccaagacccccgagagcaaggacuccccgcgcgccagccugauccccgacgccacccaccucgggccccaguucugcaaguccugcugguucgagaacaagggccugguggagugcaacaaccacuaccugugccucaacugccugacgcugcuccugggggucagcaaccggugccccaucugcaagaugccgcugcccaccaagcuccgcuccagcguggcccccaccgcgcccccgaccggcgccguggacuccauccggcccccgcccuacagccccuga

SEQ ID NO: 3778 - RNA, 300 nt, Artificial Sequence
  derived and/or modified CDS sequence (opt1) from Lassa virus__AIT17152__Z
augggcaacaagcaggccaagacccccgagaccaaggacagcccgcgcgccucccugauccccgacgcgacgcaccucgggccccaguucugcaagagcugcugguucgagaacaagggccugguggagugcaacaaccacuaccugugccucaacugccugacccugcuccuguccgucagcaaccggugccccaucugcaagaugccgcugcccaccaagcuccgccccuccaccgcccccacggccccgcccgccggggccgcggacaacacccggcccccgcccuacagccccuga

SEQ ID NO: 3779 - RNA, 300 nt, Artificial Sequence
  derived and/or modified CDS sequence (opt1) from Lassa virus__AIT17162__Z
augggcaacaagcaggccaaggccagcgaguccaaggacagcccccgcgccucccugauccccgacgccacccaccucgggccccaguucugcaagagcugcugguucgagaacaagggccugguggagugcaacaaccacuaccugugccucaacugccugacccugcuccuguccgucagcaaccggugccccaucugcaagaugccccugccgacgaagcuccgccccuccgugacccccaccgcgcccccgacccggacggccgacaacacccgcccgccgcccuacagccccuga

SEQ ID NO: 3780 - RNA, 300 nt, Artificial Sequence
  derived and/or modified CDS sequence (opt1) from Lassa virus__AIT17166__Z
augggcaacaagcaggccaaggcccccgaggcgaaggacagcccgcgcgccucccugauccccgacgccacccaccucgggccccaguucugcaagagcugcugguucgagaccaagggccugguggagugcaacaaccacuaccugugccucaacugccugacgcugcuccuguccgucagcaaccggugccccaucugcaagaugccgcugcccaccaagcuccgccccuccgccacccccaccgccccgcccacggaggcggccgacagcaucgggcccccgcccuacucccccuga

SEQ ID NO: 3781 - RNA, 300 nt, Artificial Sequence
  derived and/or modified CDS sequence (opt1) from Lassa virus__AIT17170__Z
augggcaacaagcaggccaaggugcccgagagcaaggacuccccgcgcgccagccugauccccgacgcgacccaccucgggccccaguucugcaaguccugcugguucgagaacaagggccuggucgagugcaacaaccacuaccugugccucaacugccugacccugcuccugagcguguccaaccggugccccaucugcaagaugccgcugcccacgaagcuccgccccagcgccgcccccaccgccccgcccgccggggcggccgacuccauccggcccccgcccuacagccccuga

SEQ ID NO: 3782 - RNA, 300 nt, Artificial Sequence
  derived and/or modified CDS sequence (opt1) from Lassa virus__AIT17174__Z
augggcaacaagcagaccaaggcccccgaggccaaggggagcccgcgcgcgucccugauccccgacgccacccaccucggcccccaguucugcaagagcugcugguucgagaacaaggggcugguggagugcaacaaccacuaccugugccucaacugccugacgcugcuccuguccgucagcucccggugccccaucugcaagaugccgcugcccaccaagcuccgccccagcgccgugcccaccgccccgcccaccaaggccgaggacaacacgcggcccccgcccuacucccccuga

SEQ ID NO: 3783 - RNA, 300 nt, Artificial Sequence
  derived and/or modified CDS sequence (opt1) from Lassa virus__AIT17178__Z
augggcaacaagcaggccaaggccagcgaggcgaaggacagcccccgcgccucccugaucccggacgccacccaccucgggccccaguucugcaaguccugcugguucgagaacaagggccugguggagugcaacaaccacuaccugugccucaacugccugagccugcuccuguccgucagcucccggugccccaucugcaagaugccccugccgacccgccuccggcccagcacggcccccaccgcgcccccggcccgcgccggggacaacaucaagcccccgcccuacucccccuga

SEQ ID NO: 3784 - RNA, 300 nt, Artificial Sequence
  derived and/or modified CDS sequence (opt1) from Lassa virus__AIT17182__Z
augggcaacaagcaggccaaggugcccgagguccgcgacagcccccgggccucccugauccccgacgcgacccaccucgggccccaguucugcaagagcugcugguucgagaacaagggccugguggagugcaacaaccacuaccugugccucaacugccugacccugcuccuguccgugagcucccgcugccccaucugcaagaugccgcugcccacgaagcuccggcccagcgccacccccaccgccccgcccgccggggccggcgacgggacccgcccgccgcccuacucccccuga

SEQ ID NO: 3785 - RNA, 300 nt, Artificial Sequence
  derived and/or modified CDS sequence (opt1) from Lassa virus__AIT17186__Z
augggcaacaagcaggccaagacccccgagaccaaggacagcccgcgcgccucccugauccccgacgcgacgcaccucgggccccaguucugcaagagcugcugguucgagaacaagggccugguggagugcaacaaccacuaccugugccucaacugccugacccugcuccuguccgucagcaaccggugccccaucugcaagaugccgcugcccaccaagcuccgccccuccguggcccccaccgccccgcccgccggggccgcggacaacacgcggcccccgcccuacagccccuga

SEQ ID NO: 3786 - RNA, 300 nt, Artificial Sequence
  derived and/or modified CDS sequence (opt1) from Lassa virus__AIT17194__Z
augggcaacaagcaggccaaggcccccgagcccaaggacagcccccgcgcgucccugauccccgacgccacccaccucgggccccaguucugcaagagcugcugguucgagaacaagggccugguggagugcaacaaccacuaccugugccucaacugccugacccugcuccuguccgucagcaaccggugcccgaucugcaagaugccccugcccacgaagcuccgccccuccguggccccgaccgccccgcccgccgggguggucgacagcacccggcccccgcccuacucccccuga

SEQ ID NO: 3787 - RNA, 300 nt, Artificial Sequence
  derived and/or modified CDS sequence (opt1) from Lassa virus__AIT17198__Z
augggcaacaagcaggccaaggugcccgagagcaaggacuccccgcgcgccagccugauccccgacgcgacccaccucgggccccaguucugcaaguccugcugguucgagaaccgcggccuggucgagugcaacaaccacuaccugugccucaacugccugacccugcuccugagcguguccaaccgcugccccaucugcaagaugccgcugcccacgaagcuccggcccagcaccgcccccaccgccccgcccaccggggccgccgacuccacgcggcccccgcccuacagccccuga

SEQ ID NO: 3788 - RNA, 300 nt, Artificial Sequence
  derived and/or modified CDS sequence (opt1) from Lassa virus__AIT17202__Z
augggcaacaagcaggccaagacccccgagagcaaggacuccccgcgcgccagccugauccccgacgcgacccaccucgggccccaguucugcaaguccugcugguucgagaacaagggccugguggagugcaacaaccacuaccugugccucaacugccugacgcugcuccugagcgucuccaaccgcugccccaucugcaagaugccgcugcccacccgccuccggcccagcgccgcccccaccgccccgcccuccggggccgcggacagcacccggcccccgcccuacucccccuga

SEQ ID NO: 3789 - RNA, 300 nt, Artificial Sequence
  derived and/or modified CDS sequence (opt1) from Lassa virus__AIT17206__Z
augggcaacaagcaggccaaggcccccgaggcgaaggacagcccgcgcgccucccugauccccgacgccacccaccucgggccccaguucugcaagagcugcugguucgagaacaagggccugguggagugcaacaaccacuaccugugccucaacugccugacccugcuccuguccgucagcuaccggugccccaucugcaagaugccgcugcccacgaagcuccgccccuccgccacccccaccgccccgcccaccgaggcggccgacagcauccggcccccgcccuaccgccccuga

SEQ ID NO: 3790 - RNA, 300 nt, Artificial Sequence
  derived and/or modified CDS sequence (opt1) from Lassa virus__AIT17214__Z
augggcaacaagcaggccaaggcccccgaggugaaggacagcccgcgcgcgucccugauccccgacgccacccaccucgggccccaguucugcaagagcugcugguucgagaacaagggccuggucgagugcaacaaccacuaccugugccucaacugccugacccugcuccuguccgugagcaaccggugccccaucugcaagaugccgcugcccacgaagcuccgccccuccgccgcccccaccgccccgcccaccgggaccgcggacagcauccggcccccgcccuacucccccuga

SEQ ID NO: 3791 - RNA, 300 nt, Artificial Sequence
  derived and/or modified CDS sequence (opt1) from Lassa virus__AIT17222__Z
augggcaacaagcaggccaagacccccgagaccaaggacagcccccgcgccucccugauccccgacgcgacgcaccucgggccccaguucugcaagagcugcugguucgagaacaagggccugguggagugcaacucccacuaccugugccucaacugccugacccugcuccugagcgucuccagccggugccccaucugcaagaugccgcugcccacccgccuccggcccuccaccgcccccacggccccgcccgccggggugggcgacagcaccuccccgccgcccuacagccccuga

SEQ ID NO: 3792 - RNA, 300 nt, Artificial Sequence
  derived and/or modified CDS sequence (opt1) from Lassa virus__AIT17226__Z
augggcaacaagcaggccaagacccccgaggccaaggacagcccccgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccacccccaccgccccgcccgccggggcggccgacagcaucggcccgccgcccuacucccccuga

SEQ ID NO: 3793 - RNA, 297 nt, Artificial Sequence
  derived and/or modified CDS sequence (opt1) from Lassa virus__AIT17230__Z
augggcaacaagcaggccaaggccagcgacaagaacagcccccgcgcgucccugaucccggacgccacccaccucgggccccaguucugcaaguccugcugguucgagaacaagggccugguggagugcaacaaccacuaccugugccucaacugccugacccugcuccugagcgucuccaaccggugccccaucugcaagaugccccugccgacgaagcuccgccccagcgccacccccaccgcgcccccgaccggggccgccgacuccauccggcccccgcccuacagccccuga

SEQ ID NO: 3794 - RNA, 300 nt, Artificial Sequence
  derived and/or modified CDS sequence (opt1) from Lassa virus__AIT17234__Z
augggcaacaagcaggccaaggccagcgaggagaagaacagcccccgcgcgucccugaucccggacgccacccaccucgggccccaguucugcaaguccugcugguucgagaacaagggccugguggagugcaacaaccacuaccugugccucaacugccugacccugcuccugagcgucuccaaccggugccccaucugcaagaugccccugccgacgaagcuccgccccagcgccacccccaccgcgcccccgaccggggccgccgacuccauccggcccccgcccuacagccccuga

SEQ ID NO: 3795 - RNA, 300 nt, Artificial Sequence
  derived and/or modified CDS sequence (opt1) from Lassa virus__AIT17238__Z
augggcaacaagcagaccaaggcccccgaggccaaggggagcccgcgcgcgucccugauccccgacgccacccaccucggcccccaguucugcaagagcugcugguucgagaacaaggggcugguggagugcaacaaccacuaccugugccucaacugccugacgcugcuccuguccgucagcaaccggugccccaucugcaagaugccgcugcccaccaagcuccgccccuccgccacccccaccgccccgcccacggaggccgcggacagcauccggcccccgcccuaccgccccuga

SEQ ID NO: 3796 - RNA, 300 nt, Artificial Sequence
  derived and/or modified CDS sequence (opt1) from Lassa virus__AIT17242__Z
augggcaacaagcaggccaaggcccccgagagcaaggacuccccgcgcgcgagccugauccccgacgccacccaccucgggccccaguucugcaaguccugcugguucgagaacaagggccugguggagugcaacaaccacuaccugugccucaacugccugacccugcuccugagcgucuccaaccgcugccccaucugcaagaugccgcugcccacgcgccuccggcccagcgccgcccccaccgccccgcccaccggggcgaccgacuccacgcggcccccgcccuacagccccuga

SEQ ID NO: 3797 - RNA, 300 nt, Artificial Sequence
  derived and/or modified CDS sequence (opt1) from Lassa virus__AIT17248__Z
augggcaacaagcaggucaaggcccccgaggcccgcaacagcccgcgggcgucccugauccccgacgccacccaccucgggccccaguucugcaagagcugcugguucgagaacaagggccugguggagugcaacaaccacuaccugugccucaacugccugacccugcuccuggggguguccagccgcugccccaucugcaagacgccgcugcccacccggcuccgccccuccgccacccccaccgccccgcccgccggcgcgggggacaacacgcggcccccgcccuacagccccuga

SEQ ID NO: 3798 - RNA, 300 nt, Artificial Sequence
  derived and/or modified CDS sequence (opt1) from Lassa virus__AIT17252__Z
augggcaacaagcaggccaaggcccccgaggcgaaggacagcccgcgcgccucccugauccccgacgccacccaccucgggccccaguucugcaagagcugcugguucgagaacaagggccugguggagugcaacaaccacuaccugugccucaacugccugacccugcuccuguccgucagcaaccggugccccaucugcaagaugccgcugcccacgaagcuccgccccuccaccgcccccaccgccccgcccgcgggggccgccgacagcacccggcccccgcccuacucccccuga

SEQ ID NO: 3799 - RNA, 300 nt, Artificial Sequence
  derived and/or modified CDS sequence (opt1) from Lassa virus__AIT17256__Z
augggcaacaagcaggccaaggcccccgagaccaaggacagcccgcgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgcccccaccgccccgcccgugggggcggccgacaacacccggcccccgcccuacagccccuga

SEQ ID NO: 3800 - RNA, 300 nt, Artificial Sequence
  derived and/or modified CDS sequence (opt1) from Lassa virus__AIT17260__Z
augggcaacaagcaggccaaggcccccgagcugaaggacagcccgcgcgcgucccucauccccgacgccacccaccuggggccccaguucugcaagagcugcugguucgagaacaagggccugguggagugcaacaaccacuaccucugccugaacugccugacccuccugcuguccgucagcaaccggugccccaucugcaagaugccgcuccccacgaagcugcgccccuccgccgcccccaccgccccgcccgcgggggccguggacagcacccggcccccgcccuacucccccuga

SEQ ID NO: 3801 - RNA, 300 nt, Artificial Sequence
  derived and/or modified CDS sequence (opt1) from Lassa virus__AIT17268__Z
augggcaacaagcagaccaaggcccccgaggugaaggggagcccccgcgccucccugauccccgacgcgacccaccucggcccccaguucugcaagagcugcugguucgagaacaaggggcuggucgagugcaacaaccacuaccugugccucaacugccugacgcugcuccuguccgugagcaaccggugccccaucugcaagaugccgcugcccaccaagcucaagcccuccaccacccccacggccccgcccaccggcgccgccgacagcauccgcccgccgcccuacucccccuga

SEQ ID NO: 3802 - RNA, 300 nt, Artificial Sequence
  derived and/or modified CDS sequence (opt1) from Lassa virus__AIT17272__Z
augggcaacaagcaggucaagaccagcgaggcccgcgacagcccccgggccucccugaucccggacgccaccgaccucgggccccaguucugcaaguccugcugguucgagaacaagggccugguggagugcaacaaccacuaccugugccucaacugccugacgcugcuccugagcguguccaaccgcugccccaucugcaagaugccccugccgacccggcuccgccccagcgccaaccccaccgcgcccccggccgagaccggggacuccacgcggcccccgcccuacagccccuga

SEQ ID NO: 3803 - RNA, 300 nt, Artificial Sequence
  derived and/or modified CDS sequence (opt1) from Lassa virus__AIT17278__Z
augggcagcaagcagaccaagacccccgaggugaaggacuccccgcgcgccagccugauccccgacgccacgcaccucgggccccaguucugcaaguccugcugguucgagaacaagggccuggucgagugcaacaaccacuaccugugccucaacugccugacccugcuccugagcguguccaaccgcugccccaucugcaagaugccgcugcccaccaagcuccgccccagcgcggcccccaccgccccgcccgcccgggccgcggacgacacgcggcccccgcccuacucccccuga

SEQ ID NO: 3804 - RNA, 300 nt, Artificial Sequence
  derived and/or modified CDS sequence (opt1) from Lassa virus__AIT17282__Z
augggcaacaagcaggccaaggcccccgagcccaaggacagcccccgcgcgucccugauccccgacgccacccaccucgggccccaguucugcaagagcugcugguucgagaacaagggccugguggagugcaacaaccacuaccugugccucaacugccugacccugcuccuguccgucagcaaccggugcccgaucugcaagaugccccugcccacgaagcuccgccccuccgccgccccgaccgccccgcccgcgggggccguggacagcauccggcccccgcccuacucccccuga

SEQ ID NO: 3805 - RNA, 300 nt, Artificial Sequence
  derived and/or modified CDS sequence (opt1) from Lassa virus__AIT17286__Z
augggcaacaagcagaccaaggcccccgaggugaaggacagcccgcgcgccucccugauccccgacgcgacccaccucgggccccaguucugcaagagcugcugguucgagaacaagggccuggucgagugcaacaaccacuaccugugccucaacugccugacgcugcuccuguccgugagcaaccggugccccaucugcaagaugccgcugcccaccaagcuccgccccuccaccgcccccaccgccccgcccgccgggacgauggacagcacccggcccccgcccuacucccccuga

SEQ ID NO: 3806 - RNA, 300 nt, Artificial Sequence
  derived and/or modified CDS sequence (opt1) from Lassa virus__AIT17290__Z
augggcaacaagcaggcccgcgcccccgaggcgaaggacagcccgcgggccucccugauccccgacgccacccaccucgggccccaguucugcaagagcugcugguucgagaacaagggccugguggagugcaacaaccacuaccugugccucaacugccugacccugcuccuguccgucagcucccgcugccccaucugcaagaugccgcugcccacgcggcuccgccccagcgccauccccaccgccccgcccgcggggaccggcgacuccagccggcccccgcccuacucccccuga

SEQ ID NO: 3807 - RNA, 300 nt, Artificial Sequence
  derived and/or modified CDS sequence (opt1) from Lassa virus__AIT17296__Z
augggcaacaagcaggccaagacccccgagaucaaggacagcccgcgcgccucccugauccccgacgcgacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgcccccaccgccccgcccgccggggcggccgacaucacccggcccccgcccuacagccccuga

SEQ ID NO: 3808 - RNA, 300 nt, Artificial Sequence
  derived and/or modified CDS sequence (opt1) from Lassa virus__AIT17300__Z
augggcaacaagcaggucaaggcccccgaggcccgcaacagcccgcgggcgucccugauccccgacgccacccaccucgggccccaguucugcaagagcugcugguucgagaacaagggccugguggagugcaacaaccacuaccugugccucaacugccugacccugcuccuggggguguccagccgcugccccaucugcaagaugccgcugcccacgcggcuccgccccuccaccgcccccaccgccccgcccgccggcgcgggggacaacacccggcccccgcccuacagccccuga

SEQ ID NO: 3809 - RNA, 300 nt, Artificial Sequence
  derived and/or modified CDS sequence (opt1) from Lassa virus__AIT17312__Z
augggcaacaagcaggccaagacccccgagaccaaggacagcccgcgcgccucccugauccccgacgcgacgcaccucgggccccaguucugcaagagcugcugguucgagaacaagggccugguggagugcaacaaccacuaccugugccucaacugccugacccugcuccuguccgucagcaaccggugccccaucugcaagaugccgcugcccaccaagcuccgccccuccgccgcccccaccgccccgcccgugggggccgcggacagcacgcggcccccgcccuacucccccuga

SEQ ID NO: 3810 - RNA, 300 nt, Artificial Sequence
  derived and/or modified CDS sequence (opt1) from Lassa virus__AIT17316__Z
augggcaacaagcaggccaaggcccccgaggcgcgcaacagcccccgggccucccugauccccgacgccacccaccucgggccccaguucugcaagagcugcugguucgagaaccgcggccugguggagugcaacaaccacuaccugugccucaacugccugacccugcuccuguccgucagcucccggugccccaucugcaagaugccgcugcccacgcgccuccggcccagcgccgcccccaccgcgccgcccgccggggccggcgacaacacccgcccgccgcccuacucccccuga

SEQ ID NO: 3811 - RNA, 300 nt, Artificial Sequence
  derived and/or modified CDS sequence (opt1) from Lassa virus__AIT17320__Z
augggcaacaagcaggccaaggcccccgaggcgcgcaacagcccgcgggccucccugauccccgacgccacccaccucgggccccaguucugcaagagcugcugguucgagaacaagggccugguggagugcaacaaccacuaccugugccucaacugccugacccugcuccugggggucuccagccgcugccccaucugcaagaugccgcugcccacgcggcuccgccccuccgccgcccccaccgcgccgcuggccgaggccggcgacaacacccggcccccgcccuacagccccuga

SEQ ID NO: 3812 - RNA, 300 nt, Artificial Sequence
  derived and/or modified CDS sequence (opt1) from Lassa virus__AIT17326__Z
augggcaacaagcagagcaaggcccccgagucccgcgacagcccgcgggccucccugauccccgacgcgacccaccucgggccccaguucugcaagagcugcugguucgagaacaagggccugguggagugcaacaaccacuaccugugccucaacugccugacccugcuccuguccgucagcaaccgcugccccaucugcaagaugccgcugcccacgaagcuccggcccuccgccacccccaccgccccgcccacccgcgccgccgacagcauccggcccccgcccuacucccccuga

SEQ ID NO: 3813 - RNA, 300 nt, Artificial Sequence
  derived and/or modified CDS sequence (opt1) from Lassa virus__AIT17330__Z
augggcaacaagcaggccaaggcccuggagagcaagaacagcccccgcgcgucccucauccccgacgccaccuaccuggggccccaguucugcaaguccugcugguucgagaacaagggccugguggagugcaacaaccacuaccucugccugaacugccugacccuccugcugagcgucuccaaccggugccccaucugcaagaugccccucccgacgaagcugcgcagcuccgccgcccccaccgccccgcccaccggggcggccgacggcaccaagcccccgcccuacagccccuga

SEQ ID NO: 3814 - RNA, 300 nt, Artificial Sequence
  derived and/or modified CDS sequence (opt1) from Lassa virus__AIT17342__Z
augggcaacaagcaggccaaggccagcgaggcgaaggacagcccccgcgccucccugauccccgacgccacccaccucgggccccaguucugcaaguccugcugguucgagaacaagggccugguggagugcaacaaccacuaccugugccucaacugccugacccugcuccugagcgucuccaaccggugccccaucugcaagaugccccugccgacgaagcuccgccccagcaccgcccccaccgcgccccagaccggggccgccgacuccauccggccgccgcccuacagccccuga

SEQ ID NO: 3815 - RNA, 300 nt, Artificial Sequence
  derived and/or modified CDS sequence (opt1) from Lassa virus__AIT17346__Z
augggcaacaagcaggccaaggcccccgagaccaaggacagcccgcgcgcgucccugauccccgacgccacccaccucgggccccaguucugcaagagcugcugguucgagaacaagggccugguggagugcaacaaccacuaccugugccucaacugccugacgcugcuccuguccgucagcaaccggugccccaucugcaagaugccgcugcccaccaagcuccgccccuccgccgcccccaccgccccgcccgugggggcggccgacagcacccggcccccgcccuacucccccuga

SEQ ID NO: 3816 - RNA, 300 nt, Artificial Sequence
  derived and/or modified CDS sequence (opt1) from Lassa virus__AIT17362__Z
augggcaacaagcaggccaaggcccccgagagcaaggacuccccgcgcgcgagccugauccccgacgccacccaccucgggccccaguucugcaaguccugcugguucgagaacaagggccugguggagugcaacaaccacuaccugugccucaacugccugacccugcuccugagcgucuccaaccggugccccaucugcaagaugccgcugcccacgaagcuccgccccagcgccgcccccaccgccccgcccgcgggggccgccgacuccauccggcccccgcccuacagccccuga

SEQ ID NO: 3817 - RNA, 300 nt, Artificial Sequence
  derived and/or modified CDS sequence (opt1) from Lassa virus__AIT17366__Z
augggcaacaagcagaccaagacccccgaggugaaggacagcccccgcgccucccugauccccgacgccacgcaccucgggccccaguucugcaagagcugcugguucgagaacaagggccuggucgagugcaacaaccacuaccugugccucaacugccugacccugcuccuguccgugagcaaccggugccccaucugcaagaugccgcugcccaccaagcuccgccccuccgcggcccccaccgccccgcccgcccgggccgcggacgacacgcgcccgccgcccuacagccccuga

SEQ ID NO: 3818 - RNA, 300 nt, Artificial Sequence
  derived and/or modified CDS sequence (opt1) from Lassa virus__AIT17376__Z
augggcaacaagcaggccaaggcccccgagagcaaggacuccccgcgcgcgagccugauccccgacgccaccuaccucgggccccaguucugcaaguccugcugguucgagaacaagggccugguggagugcaacaaccacuaccugugccucaacugccugacccugcuccugagcgucuccaaccgcugccccaucugcaagaugccgcugcccacgaagcuccgcagcuccguggcccccaccgcgcccccgacccgggccgccgacagcacccggcccccgcccuacucccccuga

SEQ ID NO: 3819 - RNA, 300 nt, Artificial Sequence
  derived and/or modified CDS sequence (opt1) from Lassa virus__AIT17382__Z
augggcaacaagcagaccaagaccagcgaggugaaggacagcccccgcgccucccugauccccgacgccacgcaccucgggccccaguucugcaaguccugcugguucgagaacaagggccuggucgagugcaacaaccacuaccugugccucaacugccugacccugcuccugagcguguccaaccggugccccaucugcaagaugccccugccgaccaagcuccgccccagcgcggcccccaccgcgcccccggcccgggccgccgacgacacgcgcccgccgcccuacucccccuga

SEQ ID NO: 3820 - RNA, 300 nt, Artificial Sequence
  derived and/or modified CDS sequence (opt1) from Lassa virus__AIT17386__Z
augggcaacaagcaggccaagacccccgaggcccgcgacagcccccgggcgucccugauccccgacgccacccaccucgggccccaguucugcaagagcugcugguucgagaacaagggccugguggagugcaacaaccacuaccugugccucaacugccugacgcugcuccuguccgucagcucccgcugccccaucugcaagaugccgcugcccaccaagcuccggcccagcgccacccccaccgccccgcccgccggggcgggcgacgggacgcgcccgccgcccuacucccccuga

SEQ ID NO: 3821 - RNA, 300 nt, Artificial Sequence
  derived and/or modified CDS sequence (opt1) from Lassa virus__AIT17396__Z
augggcaacaagcaggucaaggcccccgaggcccgcaacagcccgcgggcgucccugauccccgacgccacccaccucgggccccaguucugcaagagcugcugguucgagaacaagggccugguggagugcaacaaccacuaccugugccucaacugccugacccugcuccuggggguguccagccgcugccccaucugcaagaugccgcugcccacgcggcuccgccccuccgccgcccccaccgccccgcccgcggaggccggcgacaacacccggcccccgcccuacagccccuga

SEQ ID NO: 3822 - RNA, 300 nt, Artificial Sequence
  derived and/or modified CDS sequence (opt1) from Lassa virus__AIT17402__Z
augggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggagaccauccagaacaccaccccgccgcccuacacgcccuga

SEQ ID NO: 3823 - RNA, 300 nt, Artificial Sequence
  derived and/or modified CDS sequence (opt1) from Lassa virus__AIT17406__Z
augggcaaccgccaggccaagagcuccaagguggacgagcaccagcgggcccaccugguccccgacgcgagccaccucgggccccaguucugcaaguccugcugguucgagaacaagggccugguggagugcaacaaccacuaccugugccucaacugccugagccugcuccuguccgugagcucccgcugccccaucugcaagaugccccugcccaccaagcucaaggccgccgcccagccgagcgcccccuccaccgaggcgguccagaacacggccccgccgcccuacgcccccuga

SEQ ID NO: 3824 - RNA, 300 nt, Artificial Sequence
  derived and/or modified CDS sequence (opt1) from Lassa virus__AIT17410__Z
augggcaacaagcaggccaagagcaccaagguggacgagcaccagcgcgcccaccugguccccgacgcgucccaccucgggccgcaguucugcaagagcugcugguucgagaaccggggccugguggagugcaacaaccacuaccugugccucaacugccugucccugcuccugagcguguccagccgcugccccaucugcaagaugccccugcccacccggcucaaggccgccacgcagccguccgcccccagcaccgaggccacccagaacaccacgcccccgcccuacacccccuga

SEQ ID NO: 3825 - RNA, 300 nt, Artificial Sequence
  derived and/or modified CDS sequence (opt1) from Lassa virus__AIT17418__Z
augggcaaccgccaggccaagagcaccaagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgagaccauccagaacaccacgcccccgcccuacacccccuga

SEQ ID NO: 3826 - RNA, 300 nt, Artificial Sequence
  derived and/or modified CDS sequence (opt1) from Lassa virus__AIT17422__Z
augggcaaccgccaggccaagagcgccaagguggacgagcaccagcgggcgcaccugguccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacccagccguccgcccccagcacggaggcgacccagaacaccaccccgccgcccuacacgcccuga

SEQ ID NO: 3827 - RNA, 300 nt, Artificial Sequence
  derived and/or modified CDS sequence (opt1) from Lassa virus__AIT17426__Z
augggcaacaagcaggccaagagcaccaagguggacgagcaccagcgcgcccaccugguccccgacgcgucccaccucgggccgcaguucugcaagagcugcugguucgagaaccggggccugguggagugcaacaaccacuaccugugccucaacugccugucccugcuccugagcguguccagccgcugccccaucugcaagaugccccugcccaccaagcucaaggccgccacgcagccguccgcccccagcaccgaggccacccagaacaccacgcccccgcccuacacccccuga

SEQ ID NO: 3828 - RNA, 300 nt, Artificial Sequence
  derived and/or modified CDS sequence (opt1) from Lassa virus__AIT17432__Z
augggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccagccgcugccccaucugcaagaugccccugcccacccggcucaaggccgccacgcagccguccgcccccagcaccgaggccacccagaacaccaucccgccgcccuacacgcccuga

SEQ ID NO: 3829 - RNA, 300 nt, Artificial Sequence
  derived and/or modified CDS sequence (opt1) from Lassa virus__AIT17436__Z
augggcaacaagcaggccaagagcaccaaggccgacgagcaccagcgcgcgcaccuggugcccgacgccucccaccucgggccgcaguucugcaagagcugcugguucgagaaccggggccuggucgagugcaacaaccacuaccugugccucaacugccugucccugcuccugagcguguccagccgcugccccaucugcaagaugccccugcccaccaagcucaaggccgccacgcagccguccgcccccagcaccgaggcgacccggaacaccacgcccccgcccuacacccccuga

SEQ ID NO: 3830 - RNA, 300 nt, Artificial Sequence
  derived and/or modified CDS sequence (opt1) from Lassa virus__AIT17444__Z
augggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucaaggccgccgcccagccguccgcccccagcacggaggcggcccagaacaccgccccgccgcccuacgcccccuga

SEQ ID NO: 3831 - RNA, 300 nt, Artificial Sequence
  derived and/or modified CDS sequence (opt1) from Lassa virus__AIT17448__Z
augggcaaccgccaggccaagagcaccaaggugggggagcaccagcgggcccaccugguccccgacgcgucccaccucggcccccaguucugcaagagcugcugguucgagaaccgcgggcugguggagugcaacaaccacuaccugugccucaacugccugucccugcuccugagcguguccagccggugccccaucugcaagaugccccugcccaccaagcucaaggccacggcccagccguccgcccccagcgccgaggcgauccagaacaccaccccgccgcccuacacccccuga

SEQ ID NO: 3832 - RNA, 300 nt, Artificial Sequence
  derived and/or modified CDS sequence (opt1) from Lassa virus__AIT17452__Z
augggcaaccgccaggccaagagcacccggguggacgagcaccagcgcgcccaccugguccccgacgcgucccaccucgggccgcaguucugcaagagcugcugguucgagaaccggggccugguggagugcaacaaccacuaccugugccucaacugccugucccugcuccugagcguguccagccgcugccccaucugcaagaugccccugcccacccggcuccgcgccgccguccagccguccgcccccagcacggagaccacccaggacaccacgcccccgcccuacucccccuga

SEQ ID NO: 3833 - RNA, 300 nt, Artificial Sequence
  derived and/or modified CDS sequence (opt1) from Lassa virus__AIT17456__Z
augggcaaccgccaggccaagagcaccgaggugaacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggucacccagaacaccgugcccccgcccuacucccccuga

SEQ ID NO: 3834 - RNA, 300 nt, Artificial Sequence
  derived and/or modified CDS sequence (opt1) from Lassa virus__AIT17460__Z
augggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagcccuccgccccgcccacggaggcgacccagaacaccacgccgccgcccuacacccccuga

SEQ ID NO: 3835 - RNA, 300 nt, Artificial Sequence
  derived and/or modified CDS sequence (opt1) from Lassa virus__AIT17468__Z
augggcaaccgccaggccaagcagaccaagguggacgagcaccagcgggcccaccugguccccgacgcgagccaccucgggccccaguucugcaaguccugcugguucgagaaccgcggccugguggagugcaacaaccacuaccugugccucaacugccugagccugcuccuguccaucagcucccggugccccaucugcaagaugccccugcccaccaagcucaaggccgccgcccagccgagcgcccccuccacggaggcgacccaggacaccaccccgccgcccuacacgcccuga

SEQ ID NO: 3836 - RNA, 300 nt, Artificial Sequence
  derived and/or modified CDS sequence (opt1) from Lassa virus__AIT17472__Z
augggcaacaagcagaccaagagcaccaaggccgacgagcaccagcgcgcccaccuggugcccgacgcgucccaccucgggccgcaguucugcaagagcugcugguucgagaaccggggccuggucgagugcaacaaccacuaccugugccucaacugccugucccugcuccugagcguguccagccgcugccccaucugcaagaugccccugcccacgcggcucaaggccgccgcccagccguccgcccccagcaccgaggcgacccaggacaccacgcccccgcccuacacccccuga

SEQ ID NO: 3837 - RNA, 300 nt, Artificial Sequence
  derived and/or modified CDS sequence (opt1) from Lassa virus__AIT17476__Z
augggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcgcggaggccauccagaacacgaccccgccgcccuacacccccuga

SEQ ID NO: 3838 - RNA, 300 nt, Artificial Sequence
  derived and/or modified CDS sequence (opt1) from Lassa virus__AIT17480__Z
augggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggucauccaguccaccaccccgccgcccuacacccccuga

SEQ ID NO: 3839 - RNA, 300 nt, Artificial Sequence
  derived and/or modified CDS sequence (opt1) from Lassa virus__AIT17484__Z
augggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggagauccagaacaccaccccgccgcccuacacccccuga

SEQ ID NO: 3840 - RNA, 300 nt, Artificial Sequence
  derived and/or modified CDS sequence (opt1) from Lassa virus__AIT17488__Z
augggcaaccgccaggccaagcccaccaagguggacgagcaccagcgggcccaccuggucccggacgccagccaccucgggccccaguucugcaaguccugcugguucgagaacaagggccugguggagugcaacaaccacuaccugugccucaacugccugagccugcuccuguccgugagcucccgcugccccaucugcaagaugccccugccgaccaagcucaaggccgccgcccagcccagcgcccccuccacggaggcggcccagaacaccgcgcccccgcccuacgcccccuga

SEQ ID NO: 3841 - RNA, 300 nt, Artificial Sequence
  derived and/or modified CDS sequence (opt1) from Lassa virus__AIT17496__Z
augggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccacccgccucaaggccgccacgcagccguccgcccccagcaccgaggccacccagaccacgaccccgccgcccuacacccccuga

SEQ ID NO: 3842 - RNA, 300 nt, Artificial Sequence
  derived and/or modified CDS sequence (opt1) from Lassa virus__AIT17500__Z
augggcaaccgccagaccaagagcaccaagguggacgagcaccagcgggcccaccugguccccgacgccucccaccucgggccccaguucugcaagagcugcugguucgagaacaagggccugguggagugcaacaaccacuaccugugccucaacugccugucccugcuccugagcguguccagccgcugccccaucugcaagaugccccugcccacgaagcucaagaccgcggcccagccguccgccccgcccaccgaggccgcccggaccacggcgcccccgcccuacgcccccuga

SEQ ID NO: 3843 - RNA, 300 nt, Artificial Sequence
  derived and/or modified CDS sequence (opt1) from Lassa virus__AIT17508__Z
augggcaaccgccagaccaagagcaccaagguggacgagcaccagcgggcccaccugguccccgacgccucccaccucgggccgcaguucugcaagagcugcugguucgagaacaagggccugguggagugcaacaaccacuaccugugccucaacugccugucccugcuccugagcguguccagccgcugccccaucugcaagaugccccugcccacgaagcucaaggcggccgcccagccguccgcccccagcaccgaggccacccagaacaccgcgcccccgcccuacgcccccuga

SEQ ID NO: 3844 - RNA, 300 nt, Artificial Sequence
  derived and/or modified CDS sequence (opt1) from Lassa virus__AIT17512__Z
augggcaaccgccaggccaagagcaccaagguguacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccacccgccucaaggccgccacgcagccguccgcccccagcaccgaggccacccagaacaccacgcccccgcccuacacccccuga

SEQ ID NO: 3845 - RNA, 300 nt, Artificial Sequence
  derived and/or modified CDS sequence (opt1) from Lassa virus__AIT17516__Z
augggcaaccgccaggccaagagcaccaagguggacgagcaccagcgggcccaccugguccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaagacggccacccagccguccgcgccccugaccgaggccacccagaacacgaccccgccgcccuacacccccuga

SEQ ID NO: 3846 - RNA, 300 nt, Artificial Sequence
  derived and/or modified CDS sequence (opt1) from Lassa virus__AIT17520__Z
augggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccaaccgcugccccaucugcaagaugccccugcccaccaagcucaaggccgccgcccagccgagcgcccccuccacggaggcgacccagaacaccaccccgccgcccuacacgcccuga

SEQ ID NO: 3847 - RNA, 300 nt, Artificial Sequence
  derived and/or modified CDS sequence (opt1) from Lassa virus__AIT17526__Z
augggcaaccgccaggccaagagcgccaaggugaccgagcaccagcgggcccaccugguccccgacgccucccaccucgggccgcaguucugcaagagcugcugguucgagaacaagggccugguggagugcaacaaccacuaccugugccucaacugccugucccugcuccugagcguguccagccgcugccccaucugcaagaugccccugcccacccggcucaaggccgccacccagccguccgcccccagcgcggaggcgccccaguccaccacgcccccgcccuacacccccuga

SEQ ID NO: 3848 - RNA, 300 nt, Artificial Sequence
  derived and/or modified CDS sequence (opt1) from Lassa virus__AIT17536__Z
augggcaaccgccagacccggcccaccgaggccacggagcagagccgcgcccaccuggugccggacgccucccaccucgggccccaguucugcaagagcugcugguucgagaacaagggccuggucgagugcaacaaccacuaccugugccucaacugccugucccugcuccugagcguguccagccggugccccaucugcaagaugccccugccgacccgccucaaggccuccgcccagcccagcgccccgcccaccgaggcgccccagaacaaggcgcccccgcccuacacccccuga

SEQ ID NO: 3849 - RNA, 300 nt, Artificial Sequence
  derived and/or modified CDS sequence (opt1) from Lassa virus__AIT17542__Z
augggcaaccgccaggucaagagcaccaagguggacgagcaccagcgggcccaccugauccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucgaggcggccgcccagccguccgcccccagcacggaggccacccaggacaccaccccgccgcccuacacgcccuga

SEQ ID NO: 3850 - RNA, 300 nt, Artificial Sequence
  derived and/or modified CDS sequence (opt1) from Lassa virus__AIT17546__Z
augggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccagccgcugccccaucugcaagaugccccugcccaccaagcucaaggccgccgcccagccguccgcccccagcacggagaccauccagaacaccaccccgccgcccuacacgcccuga

SEQ ID NO: 3851 - RNA, 300 nt, Artificial Sequence
  derived and/or modified CDS sequence (opt1) from Lassa virus__AIT17550__Z
augggcaaccgccaggccaagcagaccaagguggacgagcaccagcgggcccaccugguccccgacgcgagccaccucgggccccaguucugcaaguccugcugguucgagaaccgcggccugguggagugcaacaaccacuaccugugccucaacugccugagccugcuccuguccgugagcucccggugccccaucugcaagaugccccugcccaccaagcucaaggccgccgcccagccgagcgcccccuccacggagaucacccagaacaccaccccgccgcccuacacgcccuga

SEQ ID NO: 3852 - RNA, 300 nt, Artificial Sequence
  derived and/or modified CDS sequence (opt1) from Lassa virus__AIT17554__Z
augggcaaccgccaggccaagagcaccaaggccgacgagcaccagcgggcgcaccuggugcccgacgccucccaccucgggccccaguucugcaagagcugcugguucgagaaccgcggccuggucgagugcaacaaccacuaccugugccucaacugccugucccugcuccugagcguguccaaccggugccccaucugcaagaugccccugcccacccgccucaaggccgccgcccagccgagcgcgcccuccacggaggccacccaggacaccaccccgccgcccuacacgcccuga

SEQ ID NO: 3853 - RNA, 300 nt, Artificial Sequence
  derived and/or modified CDS sequence (opt1) from Lassa virus__AIT17558__Z
augggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccacccgccucaaggccgccgcccagccguccgcccccagcacggaggcgauccgguccaccaccccgccgcccuacacccccuga

SEQ ID NO: 3854 - RNA, 300 nt, Artificial Sequence
  derived and/or modified CDS sequence (opt1) from Lassa virus__AIT17570__Z
augggcaaccgccaggccaagagcgccaaggugaacgagcaccagcgggcgcaccugguccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcgcccagcaccgaggccacgcagaacaucaccccgccgcccuacacccccuga

SEQ ID NO: 3855 - RNA, 300 nt, Artificial Sequence
  derived and/or modified CDS sequence (opt1) from Lassa virus__AIT17578__Z
augggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcuccgggccgccgcccagccguccgcccccagcacggaguccgcgcagaacaccgccccgccgcccuacgcccccuga

SEQ ID NO: 3856 - RNA, 300 nt, Artificial Sequence
  derived and/or modified CDS sequence (opt1) from Lassa virus__AIT17586__Z
augggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccagccgcugccccaucugcaagaugccccugcccacccggcucaaggccgccgcccagccguccgcccccagcacggaggucacccagaacaccaccccgccgcccuacacgcccuga

SEQ ID NO: 3857 - RNA, 300 nt, Artificial Sequence
  derived and/or modified CDS sequence (opt1) from Lassa virus__AIT17590__Z
augggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucgaggccacgacccagccguccgcccccagcaccgaggagacccaguccacgaccccgccgcccuacacccccuga

SEQ ID NO: 3858 - RNA, 300 nt, Artificial Sequence
  derived and/or modified CDS sequence (opt1) from Lassa virus__AIT17602__Z
augggcaacaagcaggccaagagcaccaagguggacgaguaccagcgcgcccaccugguccccgacgcgucccaccucgggccccaguucugcaagagcugcugguucgagaaccggggccugguggagugcaacaaccacuaccugugccucaacugccugucccugcuccugagcguguccaaccgcugccccaucugcaagaugccccugcccacccggcucaaggccgccgcccagcccagcgccccgcccacggaggcgacccagaacaccacgccgccgcccuacacccccuga

SEQ ID NO: 3859 - RNA, 300 nt, Artificial Sequence
  derived and/or modified CDS sequence (opt1) from Lassa virus__AIT17610__Z
augggcaaccgccaggccaagcccaccaagguggacgagcaccagcgggcccagcuggucccggacgcgagccaccucgggccccaguucugcaaguccugcugguucgagaaccgcggccugguggagugcaacaaccacuaccugugccucaacugccugagccugcuccuguccgugagcucccggugccccaucugcaagaugccccugccgaccaagcucaaggccgccacgcagcccagcgcccccuccaccgaggccacccagaacagcacgcccccgcccuacacccccuga

SEQ ID NO: 3860 - RNA, 300 nt, Artificial Sequence
  derived and/or modified CDS sequence (opt1) from Lassa virus__AIT17614__Z
augggcaaccgccaggccaagagcaccaagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggccacccagaacaccacgcccccgcccuacacccccuga

SEQ ID NO: 3861 - RNA, 300 nt, Artificial Sequence
  derived and/or modified CDS sequence (opt1) from Lassa virus__AIT17618__Z
augggcaaccgccaggccaagagcaccgagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccaaccggugccccaucugcaagaugccccugcccaccaagcucaaggccgccacgcagccgagcgcccccuccaccgaggccacccagaacaccacgcccccgcccuacacccccuga

SEQ ID NO: 3862 - RNA, 300 nt, Artificial Sequence
  derived and/or modified CDS sequence (opt1) from Lassa virus__AIT17622__Z
augggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggucacccagaacaccaucccgccgcccuacucccccuga

SEQ ID NO: 3863 - RNA, 300 nt, Artificial Sequence
  derived and/or modified CDS sequence (opt1) from Lassa virus__AIT17628__Z
augggcaacaagcaggccaagagcaccaagaucgacgagcaccagcgcgcccaccuggugcccgacgcgucccaccucgggccgcaguucugcaagagcugcugguucgagaaccggggccuggucgagugcaacaaccacuaccugugccucaacugccugucccugcuccugagcguguccagccgcugccccaucugcaagaugccccugcccacccggcucaaggccgccacgcagccguccgcccccagcaccgaggccacccagaacaccacgcccccgcccuacacccccuga

SEQ ID NO: 3864 - RNA, 300 nt, Artificial Sequence
  derived and/or modified CDS sequence (opt1) from Lassa virus__AIT17632__Z
augggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcuccgggccacggcccagccguccgcccccagcaccgaggccauccagaacaccaccccgccgcccuacacgcccuga

SEQ ID NO: 3865 - RNA, 300 nt, Artificial Sequence
  derived and/or modified CDS sequence (opt1) from Lassa virus__AIT17636__Z
augggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcaucgagacgauccagaacaccaccccgccgcccuacacccccuga

SEQ ID NO: 3866 - RNA, 300 nt, Artificial Sequence
  derived and/or modified CDS sequence (opt1) from Lassa virus__AIT17640__Z
augggcaaccgccaggccaagagcaccaaggugggggagcaccagcgggcccaccugguccccgacgcgucccaccucggcccccaguucugcaagagcugcugguucgagaaccgcgggcugguggagugcaacaaccacuaccugugccucaacugccugucccugcuccugagcguguccagccggugccccaucugcaagaugccccugcccaccaagcucaaggccgccgcccagccguccgcccccagcacggaggcgacccaggacaccaccccgccgcccuacacgcccuga

SEQ ID NO: 3867 - RNA, 300 nt, Artificial Sequence
  derived and/or modified CDS sequence (opt1) from Lassa virus__AIT17648__Z
augggcaaccgccaggccaagagcaccaagguggacgagcaccagcgggcccaccugguccccgacgcgucccaccucgggccgcaguucugcaagagcugcugguucgagaacaagggccugguggagugcaacaaccacuaccugugccucaacugccugucccugcuccugagcguguccagccgcugccccaucugcaagaugccccugcccaccaagcucaaggccacgguccagccguccgcccccagcaccgaggccgcccaguccaccgcgcccccgcccuacgcccccuga

SEQ ID NO: 3868 - RNA, 300 nt, Artificial Sequence
  derived and/or modified CDS sequence (opt1) from Lassa virus__AIT17652__Z
augggcaaccgccaggccaagagcaccaaggugggggagcaccagcgggcccaccugguccccgacgcgucccaccucggcccccaguucugcaagagcugcugguucgagaaccgcgggcugguggagugcaacaaccacuaccugugccucaacugccugucccugcuccugagcguguccagccggugccccaucugcaagaugccccugcccaccaagcucaaggccgccgcccagccguccgcccccagcgcggaggccauccagaagacgaccccgccgcccuacacccccuga

SEQ ID NO: 3869 - RNA, 300 nt, Artificial Sequence
  derived and/or modified CDS sequence (opt1) from Lassa virus__AIT17656__Z
augggcaaccgccaggccaagagcaccaagguggacgaccaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcggcccaggacaccaccccgccgcccuacacccccuga

SEQ ID NO: 3870 - RNA, 300 nt, Artificial Sequence
  derived and/or modified CDS sequence (opt1) from Lassa virus__AIT17660__Z
augggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccaaccggugccccaucugcaagaugccccugcccaccaagcucaaggccgccgcccagccgagcgcccccuccacggaggcgauccagaacaccaccccgccgcccuacgcccccuga

SEQ ID NO: 3871 - RNA, 300 nt, Artificial Sequence
  derived and/or modified CDS sequence (opt1) from Lassa virus__AIT17664__Z
augggcaacaagcaggccaagagcaccaagguggacgagcaccagcgcgcccaccugguccccgacgcgucccaccucgggccccaguucugcaagagcugcugguucgagaacaagggccugguggagugcaacaaccacuaccugugccucaacugccugucccugcuccugagcguguccagccggugccccaucugcaagaugccccugcccaccaagcucaaggccgccgcccagccguccgcccccagcacggaggcggcccagaacaccgccccgccgcccuacgcccccuga

SEQ ID NO: 3872 - RNA, 300 nt, Artificial Sequence
  derived and/or modified CDS sequence (opt1) from Lassa virus__AIT17668__Z
augggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucaagacgaccgcccagccguccgccccgcccaccgaggccgccaagaacaccgcgcccccgcccuacgcccccuga

SEQ ID NO: 3873 - RNA, 300 nt, Artificial Sequence
  derived and/or modified CDS sequence (opt1) from Lassa virus__AIT17676__Z
augggcaaccgccaggccaagagcaccaagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggucacccagaacaccacgcccccgcccuacacccccuga

SEQ ID NO: 3874 - RNA, 300 nt, Artificial Sequence
  derived and/or modified CDS sequence (opt1) from Lassa virus__AIT17680__Z
augggcaaccgccaggccaagagcaccaagaucgacgagcaccagcgggcccaccuggugcccgacgcgucccaccucgggccccaguucugcaagagcugcugguucgagaaccgcggccuggucgagugcaacaaccacuaccugugccucaacugccugucccugcuccugagcguguccagccggugccccaucugcaagaugccccugcccaccaagcucaaggccgccgcccagccguccgcccccagcacggaggcgauccagaacaccaccccgccgcccuacacccccuga

SEQ ID NO: 3875 - RNA, 300 nt, Artificial Sequence
  derived and/or modified CDS sequence (opt1) from Lassa virus__AIT17684__Z
augggcaaccgccaggccaagagcgccaagguggacgagcaccagcgggcgcaccugguccccgacgccucccaccucgggccccaguucugcaagagcugcugguucgagaacaagggccugguggagugcaacaaccacuaccugugccucaacugccugucccugcuccugagcguguccugccgcugccccaucugcaagaugccccugcccaccaagcucaaggccgccacccagccgagcgcccccuccacggaggcgacccagaacaccaccccgccgcccuacacgcccuga

SEQ ID NO: 3876 - RNA, 300 nt, Artificial Sequence
  derived and/or modified CDS sequence (opt1) from Lassa virus__AIT17692__Z
augggcaaccgccacgccaagcccaccaagguggacgagcaccagcgggcccaccuggucccggacgcgagccaccucgggccccaguucugcaaguccugcugguucgagaaccgcggccugguggagugcaacaaccacuaccugugccucaacugccugagccugcuccuguccgugagcucccggugccccaucugcaagaugccccugccgaccaagcucaaggccgccgcccagcccagcgcccccuccaccgaggcgauccagaacaccacgcccccgcccuacacccccuga

SEQ ID NO: 3877 - RNA, 300 nt, Artificial Sequence
  derived and/or modified CDS sequence (opt1) from Lassa virus__AIT17702__Z
augggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcguuccagaacaccaccccgccgcccuacacccccuga

SEQ ID NO: 3878 - RNA, 300 nt, Artificial Sequence
  derived and/or modified CDS sequence (opt1) from Lassa virus__AIT17708__Z
augggcaaccgccacgccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcagccguccgcccccagcaccgaggccauccagaacaccaccccgccgcccuacacgcccuga

SEQ ID NO: 3879 - RNA, 300 nt, Artificial Sequence
  derived and/or modified CDS sequence (opt1) from Lassa virus__AIT17716__Z
augggcaaccgccccgccaagagcaccaagguggacgagcaccagcgggcccaccuggucccggacgcgucccaccucgggccccaguucugcaagagcugcugguucgagaaccgcggccugguggagugcaacaaccacuaccugugccucaacugccugucccugcuccugagcguguccagccggugccccaucugcaagaugccccugccgaccaagcucaaggccgccgcccagcccuccgcccccagcacggaggcgacccagaacaccacgcccccgcccuacacccccuga

SEQ ID NO: 3880 - RNA, 300 nt, Artificial Sequence
  derived and/or modified CDS sequence (opt1) from Lassa virus__AIT17720__Z
augggcaaccgccaggccaagcccaccaagguggacgagcaccagcgggcccaccuggucccggacgcgagccaccucgggccccaguucugcaaguccugcugguucgagaaccgcggccugguggagugcaacaaccacuaccugugccucaacugccugagccugcuccuguccgugagcucccggugccccaucugcaagaugccccugccgacccgccucaaggccgccgcccagcccagcgcccccuccacggaggagacccagaacaccacgcccccgcccuacacccccuga

SEQ ID NO: 3881 - RNA, 300 nt, Artificial Sequence
  derived and/or modified CDS sequence (opt1) from Lassa virus__AIT17730__Z
augggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcgccccugacggaggccauccagaacaccaccccgccgcccuacacccccuga

SEQ ID NO: 3882 - RNA, 300 nt, Artificial Sequence
  derived and/or modified CDS sequence (opt1) from Lassa virus__AIT17734__Z
augggcaaccgccaggccaagagcaccaagguggacgagcaccagcgggcccaccugguccccgacgcgucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccgcccagccguccgcccccagcacggaggcgauccagaacaccaccccgccgcccuacacccccuga

SEQ ID NO: 3883 - RNA, 300 nt, Artificial Sequence
  derived and/or modified CDS sequence (opt1) from Lassa virus__AIT17738__Z
augggcaaccgccaggccaagagcaccaagguggacgagcaccagcgggcccaccugguccccgacgcgucccaccucgggccgcaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacgcugccguccgcccccagcaccgaggucacccagaacaccacgcccccgccccacucccccuga

SEQ ID NO: 3884 - RNA, 300 nt, Artificial Sequence
  derived and/or modified CDS sequence (opt1) from Lassa virus__AIT17750__Z
augggcaaccgccaggccaagagcgccaaggugaacgagcaccagcgggcgcaccugguccccgacgccucccaccucgggccccaguucugcaagagcugcugguucgagaaccgcggccugguggagugcaacaaccacuaccugugccucaacugccugucccugcuccugagcguguccagccggugccccaucugcaagaugccccugcccaccaagcucaaggccgccacccagccguccgcccccagcacggaggcgacccagaacaccaccccgccgcccuacacgcccuga

SEQ ID NO: 3885 - RNA, 300 nt, Artificial Sequence
  derived and/or modified CDS sequence (opt1) from Lassa virus__AIT17754__Z
augggcaaccgccaggccaagagcaccaagguggacgagcaccagcgggcccaccugguccccgacgcgucccaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucaaggccuccgcccagccgagcgcccccuccacggaggccgcgcagaacaccgccccgccgcccuacgcccccuga

SEQ ID NO: 3886 - RNA, 300 nt, Artificial Sequence
  derived and/or modified CDS sequence (opt1) from Lassa virus__AIT17760__Z
augggcaaccgccaggccaagagcacccggaccgacgagcaccagcgcgcccaccuggugcccgacgcgucccaccucgggccccaguucugcaagagcugcugguucgagaacaagggccuggucgagugcaacaaccacuaccugugccucaacugccugucccugcuccugagcguguccagccggugccccaucugcaagaugccccugcccacgaagcucaaggccgccgcccagccguccgcccccagcaccgaggcggggcagaacaccgccccgccgcccuacgcccccuga

SEQ ID NO: 3887 - RNA, 300 nt, Artificial Sequence
  derived and/or modified CDS sequence (opt1) from Lassa virus__AIT17768__Z
augggcaaccgccaggccaagagcgccaccguggacgagugccagcgggcgcaccugguccccgacgccuccuaccucgggccccaguucugcaagagcugcugguucgagaacaagggccugguggagugcaacaaccacuaccugugccucaacugccugucccugcuccugagcguguccagccgcugccccaucugcaagaugccccugcccaccaagcucaaggccgccgcccagccguccgcgcccagcacgcgggccacccagaacaccaccccgccgcccuacacgcccuga

SEQ ID NO: 3888 - RNA, 300 nt, Artificial Sequence
  derived and/or modified CDS sequence (opt1) from Lassa virus__AIT17776__Z
augggcaacaagcaggccaagagcaccaagguggacgagcaccagcgcgcccaccugguccccgacgcgucccaccucgggccccaguucugcaagagcugcugguucgagaacaagggccugguggagugcaacaaccacuaccugugccucaacugccugucccugcuccugagcguguccagccggugccccaucugcaagaugccccugcccacccgccucaaggccgccgcccagccguccgcccccagcacggaggcgacccagaacgccgccccgccgcccuacgcccccuga

SEQ ID NO: 3889 - RNA, 300 nt, Artificial Sequence
  derived and/or modified CDS sequence (opt1) from Lassa virus__AIT17780__Z
augggcaaccgccagaccaagagcaccaagguggacgagcaccagcgggccuaccugguccccgacgccucccuccuggggccccaguucugcaagagcugcugguucgagaacaagggccugguggagugcaacaaccacuaccucugccugaacugccugucccuccugcugagcguguccagccgcugccccaucugcaagaugccccuccccacgcggcugaaggcggccgcccagcccuccgccccgcccaccgaggccauccagaacaccacgccgccgcccuacacccccuga

SEQ ID NO: 3890 - RNA, 300 nt, Artificial Sequence
  derived and/or modified CDS sequence (opt1) from Lassa virus__AIT17784__Z
augggcaaccgccagaccaagcccaccaagguggacgagcaccagcgggcccaccuggucccggacgccagccaccucgggccccaguucugcaaguccugcugguucgagaacaagggccugguggagugcaacaaccacuaccugugccucaacugccugagccugcuccuguccgugagcucccgcugccccaucugcaagaugccccugccgacgaagcucaaggcgaccgcccagcccagcgcccccuccaccgaggccgcccagaacaccgcgcccccgcccuacgcccccuga

SEQ ID NO: 3891 - RNA, 300 nt, Artificial Sequence
  derived and/or modified CDS sequence (opt1) from Lassa virus__AIT17788__Z
augggcaaccgccaggucaagagcaccaagguggacgagcaccagcgggcccaccuggugcccgacgccucccaccucgggccccaguucugcaagagcugcugguucgagaaccgcggccugguggagugcaacaaccacuaccugugccucaacugccugucccugcuccugagcgucuccagccggugccccaucugcaagaugccccugcccaccaagcucaaggcggccacgcagccguccgccccgcccaccgaggccacccagaagaccacgcccccgcccuacacccccuga

SEQ ID NO: 3892 - RNA, 300 nt, Artificial Sequence
  derived and/or modified CDS sequence (opt1) from Lassa virus__AIT17792__Z
augggcaacaagcaggccaagagcaccaagguggacgagcaccagcgcgcccaccugguccccgacgcgucccaccucgggccgcaguucugcaagagcugcugguucgagaaccggggccugguggagugcaacaaccacuaccugugccucaacugccugucccugcuccugagcguguccgggcgcugccccaucugcaagaugccccugcccaccaagcucaaggccacggcccagccgagcgcccccuccaccgaggccacccagaacaccacgcccccgcccuacacccccuga

SEQ ID NO: 3893 - RNA, 300 nt, Artificial Sequence
  derived and/or modified CDS sequence (opt1) from Lassa virus__AIT17796__Z
augggcaacaagcaggccaagagcaccaagguggacgagcaccagcgcgcccaccugguccccgacgcgucccaccucgggccccaguucugcaagagcugcugguucgagaaccggggccugguggagugcaacaaccacuaccugugccucaacugccugucccugcuccugagcguguccagccgcugccccaucugcaagaugccccugcccaccaagcucaaggccgccgcccagccguccgcccccagcacggaggcgauccagaacaccaccccgccgcccuacacccccuga

SEQ ID NO: 3894 - RNA, 300 nt, Artificial Sequence
  derived and/or modified CDS sequence (opt1) from Lassa virus__AIT17800__Z
augggcaacaagcaggccaaggcccccgaggcgaaggacagcccgcgcgccucccugauccccgacgccacccaccucgggccccaguucugcaagagcugcugguucgagaacaagggccugguggagugcaacaaccacuaccugugccucaacugccugacccugcuccuguccgucagcaaccggugccccaucugcaagaugccgcugcccacgaagcuccgccccuccgccacccccaccgccccgcccaccgaggcggccgacagcauccggcccccgcccuaccaccccuga

SEQ ID NO: 3895 - RNA, 300 nt, Artificial Sequence
  derived and/or modified CDS sequence (opt1) from Lassa virus__AIT17804__Z
augggcaacaagcaggccaaggccagcgaggagaagaacagcccccgcgccucccugaucccggacgccacccaccucgggccccaguucugcaaguccugcugguucgagaacaagggccugguggagugcaacaaccacuaccugugccucaacugccugacccugcuccugagcgucuccaaccggugccccaucugcaagaugccccugccgacgaagcuccgccccagcaccacccccaccgcgcccccgacgggggccgccgacuccauccggcccccgcccuacagccccuga

SEQ ID NO: 3896 - RNA, 300 nt, Artificial Sequence
  derived and/or modified CDS sequence (opt1) from Lassa virus__AIT17808__Z
augggcaacaagcaggccaaggcccccgagagcaaggacuccccgcgcgcgagccugauccccgacgccacccaccucgggccccaguucugcaaguccugcugguucgagaacaagggccugguggagugcaacaaccacuaccugugccucaacugccugacccugcuccugagcgucuccaaccgcugccccaucugcaagaugccgcugcccacgcgccuccggcccagcgccgcccccaccgccccgcccaccggggcggccgacuccacccggcccccgcccuacagccccuga

SEQ ID NO: 3897 - RNA, 303 nt, Artificial Sequence
  derived and/or modified CDS sequence (opt1) from Lassa virus__AIT17834__Z
augggcaacaagcagacccgcagcccgcccaagcccgagcacccccggcccacccugcuccccgacgccucccaccuggggccccaguucugcaagagcugcugguucgagaacaagggccugguggagugcaacaaccacuaccucugccugaacugccugacgcuccugcuguccgucagcgaccgcugccccaucugcaagaugccccuccccaccaagcuggccgugcggacccagcccuccgcgccgccccugaaccaggggaacacccagagcagcccgccgcccuacucccccuga

SEQ ID NO: 3898 - RNA, 300 nt, Artificial Sequence
  derived and/or modified CDS sequence (opt1) from Lassa virus__AIT17838__Z
augggcaacaagcaggccaaggugcccgagagcaaggacuccccgcgcgccagccugauccccgacgcgacccaccucgggccccaguucugcaaguccugcugguucgagaacaagggccuggucgagugcaacaaccacuaccugugccucaacugccugacccugcuccugagcguguccaaccgcugccccaucugcaagaugccgcugcccacgaagcucaagcccagcgccgcccccaccgccccgcccaccggggccgcggacuccauccggcccccgcccuacagccccuga

SEQ ID NO: 3899 - RNA, 300 nt, Artificial Sequence
  derived and/or modified CDS sequence (opt1) from Lassa virus__AIT17842__Z
augggcaacaagcaggccaaggugcccgagagcaaggacuccccgcgcgccagccugauccccgacgcgacccaccucgggccccaguucugcaaguccugcugguucgagaacaagggccuggucgagugcaacaaccacuaccugugccucaacugccugacccugcuccugagcguguccaaccggugccccaucugcaagaugccgcugcccacgaagcuccgccccagcgccgcccccaccgccccgcccaccgggguggccgacuccauccggcccccgcccuacagccccuga

SEQ ID NO: 3900 - RNA, 300 nt, Artificial Sequence
  derived and/or modified CDS sequence (opt1) from Lassa virus__ANH09743__Z
augggcaacaagcaggccaaggccagcgagguggaggacgggccccgcgccucccugauccccgacgccacccaccucggcccccaguucugcaagagcugcugguucgagaacaagucccuggucgagugcaacaaccacuaccugugccucaacugccugacccugcuccugagcguguccaaccggugccccaucugcaagaugccccugccgacgcgccucaagcccagcgugguccccaccgcgcccccgacccgggccggggacggcacccgcccgccgcccuacucccccuga

SEQ ID NO: 3901 - RNA, 300 nt, Artificial Sequence
  derived and/or modified CDS sequence (opt1) from Lassa virus__ANH09745__Z
augggcaacaagcagaccaaggcccccgagguggaggacgggccccgcgccagccugauccccgacgcgacccaccucggcccccaguucugcaaguccugcugguucgagaacaaggggcuggucgagugcaacaaccacuaccugugccucaacugccugacgcugcuccugagcguguccagccggugccccaucugcaagaugccgcugcccacccgccucaagcccuccaucgugcccaccgccccgcccgcccggaccggcgagaacacgcgcccgccgcccuacagccccuga

SEQ ID NO: 3902 - RNA, 300 nt, Artificial Sequence
  derived and/or modified CDS sequence (opt1) from Lassa virus__ANH09749__Z
augggcaacaagcaggccaaggcccccgagguggaggacgggccccgcgcgagccugauccccgacgccacccaccucggcccccaguucugcaaguccugcugguucgagaaccgggggcuggucgagugcaacaaccacuaccugugccucaacugccugacccugcuccugagcguguccaaccgcugccccaucugcaagaugccgcugcccacgcggcucaagcccagcgugguccccaccgccccgcccaccggcgccgggggcgacacccgcccgccgcccuacucccccuga

SEQ ID NO: 3903 - RNA, 300 nt, Artificial Sequence
  derived and/or modified CDS sequence (opt1) from Lassa virus__ANH09751__Z
augggcaacaagcaggccaaggcccccaaggcggaggacgggccgcgcgccagccugauccccgacgccacccaccucggcccccaguucugcaaguccugcugguucgagaacaaggggcugguggagugcaacaaccacuaccugugccucaacugccugacccugcuccugagcgucuccaaccggugccccaucugcaagaugccgcugcccacgcgccucaagcccagcguggugcccaccgccccgcccaccggcgccgggggcgacacccggcccccgccccacucccccuga

SEQ ID NO: 3904 - RNA, 300 nt, Artificial Sequence
  derived and/or modified CDS sequence (opt1) from Lassa virus__ANH09753__Z
augggcaacaagcaggccaaggccagcgaggcggaggacgggccccgcgccucccugauccccgacgccacccaccucggcccccaguucugcaagagcugcugguucgagaacaaggggcugguggagugcaacaaccacuaccugugccucaacugccugacccugcuccuguccgucagcucccggugccccaucugcaagaugccccugccgacgcgccuccggcccagcguggugcccaccgcccccuccgccggcgcgggggacggcacccgcccgccgcccuacagccccuga

SEQ ID NO: 3905 - RNA, 300 nt, Artificial Sequence
  derived and/or modified CDS sequence (opt1) from Lassa virus__ANH09755__Z
augggcaacaagcagaccaagaccaucaagaagacggacagcccccgcgccucccugauccccgacgccagccacauggggccccaguucugcaaguccugcugguucgagaaccggggccucguggagugcaacaaccacuaccugugccugaacugccucagccugcugcucuccgucagcaaccgcugccccaucugcaagaugccccugccgaccaagcugcgggcgucccccagccccaccgcccccuccauccgcgaggccaacaucaccaacccgccgcccuacagccccuga

SEQ ID NO: 3906 - RNA, 300 nt, Artificial Sequence
  derived and/or modified CDS sequence (opt1) from Lassa virus__ANH09759__Z
augggcaacaagcagaccaagaccacgaagaagaccgacagcccccgcgccucccugauccccgacgccagccacauggggccccaguucugcaaguccugcugguucgagaaccggggccucguggagugcaacaaccacuaccugugccugaacugccucagccugcugcucuccgucagcaaccgcugccccaucugcaagaugccccugccgaccaagcugcgggcgucccccagccccaccgcccccuccauccgcgaggccaacaucacgaacccgccgcccuacagccccuga

SEQ ID NO: 3907 - RNA, 300 nt, Artificial Sequence
  derived and/or modified CDS sequence (opt1) from Lassa virus__ANH09761__Z
augggcaacaaggggaccaagcccacccagaacagcgagcccucccgcgccaaccuggugcccgacgccagcuaccucggcccccaguucugcaaguccugcugguucgagaacaaggggcuggucgagugcaacaaccacuaccugugccucaacugccugacgaugcugcucagcguguccaaccggugccccaucugcaagaugccgcugcccaccaagaucaaggccagcggcucccccagcgcgcccccgaccgaggccaacuccgccgugagcccgccgcccuacacccccuga

SEQ ID NO: 3908 - RNA, 300 nt, Artificial Sequence
  derived and/or modified CDS sequence (opt1) from Lassa virus__AMR44579__Z
augggcgcccgccagaccaagcagccccagaucgaggggagcccccgggccucccuggugcccgacgcgagccaccucggcccccaguucugcaaguccugcugguucgagaacaaggggcuggucgagugcaacaaccacuaccugugccucaacugccugagccugcuccuguccgugagcaaccgcugccccaucugcaagaugccgcugcccaccaagcuccggguguccagcgcccccuccgcgcccccggccgccacggcccagcccggcaccccgccgcccuacagccccuga

SEQ ID NO: 3909 - RNA, 300 nt, Artificial Sequence
  derived and/or modified CDS sequence (opt1) from Lassa virus__AMZ00378__Z
augggcaaccgccagaccaaggccaccgaggccaaggacagcccccgggcgucccugauccccgacgccacgcaccucgggccccaguucugcaagagcugcugguucgagaacaagggccugguggagugcaacaaccacuaccugugccucaacugccugacccugcuccuguccgucagcucccgcugccccaucugcaagaugccccugccgacccggcucaagagcuccaccaaccccacggcccccagcgccaagaccgaguccagcaucaacccgccgcccuacucccccuga

SEQ ID NO: 3910 - RNA, 300 nt, Artificial Sequence
  derived and/or modified CDS sequence (opt2) from Lassa virus__ADY11072__Z
augggcaacaagcaggccaaggcccccgaguccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccaccggcgccgccgacuccauccgccccccccccuacucccccuga

SEQ ID NO: 3911 - RNA, 300 nt, Artificial Sequence
  derived and/or modified CDS sequence (opt2) from Lassa virus__AAO59514__Z
augggcaacaagcagguccgcuccaugaagaaggucgacuccccccgcgccucccucauccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaagaccuccaccacccccaccgcccccuccauccgcgaggccaacaccaccucccccccccccuacucccccuga

SEQ ID NO: 3912 - RNA, 300 nt, Artificial Sequence
  derived and/or modified CDS sequence (opt2) from Lassa virus__AAO59508__Z
augggcaaccgccaggccaagaaccccgaggucgagaacuccccccgcgccucccucauccccgacgccacccaccucggcccccaguucugcaaguccugcugguucgagaacaagggccucgucgagugcaacaaccacuaccucugccucaacugccucucccuccuccucuccgucuccaaccgcugccccaucugcaagaugccccuccccacccgccuccgccccaccaccacccccaccgccccccagaucaucaaggagaacaccaccaaccccccccccuacacccccuga

SEQ ID NO: 3913 - RNA, 300 nt, Artificial Sequence
  derived and/or modified CDS sequence (opt2) from Lassa virus__AAO59510__Z
augggcaacaagcagaccaaggcccccgaggccaaggacuccccccgcgccucccucauccccgacgccaccuaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccgccggcgccgcccacuccgcccgccccccccccuacucccccuga

SEQ ID NO: 3914 - RNA, 300 nt, Artificial Sequence
  derived and/or modified CDS sequence (opt2) from Lassa virus__AAT48997__Z
augggcaacaagcaggccaaggcccccgagaccaagaacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccguccccaccgccccccccgcccaggucggcgaccgcacccgccccccccccuacucccccuga

SEQ ID NO: 3915 - RNA, 300 nt, Artificial Sequence
  derived and/or modified CDS sequence (opt2) from Lassa virus__AAT49005__Z
augggcaacaagcaggccaaggcccccgagaccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccacccgccuccgccccuccgccguccccaccgccccccccgcccccgccggcgaccgcaccaagcccccccccuacucccccuga

SEQ ID NO: 3916 - RNA, 300 nt, Artificial Sequence
  derived and/or modified CDS sequence (opt2) from Lassa virus__ADU56612__Z
augggcaaccgccagacccgccccaccgaggccaccgagcagucccgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccacccgccucaaggccuccgcccagcccuccgccccccccaccgaggccccccagaacaccacccccccccccuacacccccuga

SEQ ID NO: 3917 - RNA, 300 nt, Artificial Sequence
  derived and/or modified CDS sequence (opt2) from Lassa virus__ADU56616__Z
augggcggcaagcacaccaagcagccccgcgaguccaacuccccccgcgccucccucauccccgacgccacccaccucggcccccaguucugcaaguccugcugguucgagaacaagggccucgucgagugcaacaaccacuaccucugccucaacugccucucccuccuccucuccgucuccaaccgcugccccaucugcaagaugccccuccccacccgccuccgcaccuccaccaaccccaccgccccccaggucgagcagaccggccccgccucccccccccccuacucccccuga

SEQ ID NO: 3918 - RNA, 300 nt, Artificial Sequence
  derived and/or modified CDS sequence (opt2) from Lassa virus__ADU56620__Z
augggcggcaagcacaccaagccccagcgcgaguccaacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccacccgccuccgcgccuccaccaaccccaccgccccccaggucgagcaggucggccccaccaaccccccccccuacucccccuga

SEQ ID NO: 3919 - RNA, 300 nt, Artificial Sequence
  derived and/or modified CDS sequence (opt2) from Lassa virus__ADU56624__Z
augggcaaccgccacgccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccauccagaacaccacccccccccccuacacccccuga

SEQ ID NO: 3920 - RNA, 300 nt, Artificial Sequence
  derived and/or modified CDS sequence (opt2) from Lassa virus__ADU56628__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccauccagaacaccacccccccccccuacgcccccuga

SEQ ID NO: 3921 - RNA, 300 nt, Artificial Sequence
  derived and/or modified CDS sequence (opt2) from Lassa virus__ADU56632__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccacccaggacaccacccccccccccuacacccccuga

SEQ ID NO: 3922 - RNA, 300 nt, Artificial Sequence
  derived and/or modified CDS sequence (opt2) from Lassa virus__ADU56644__Z
augggcaaccgccagaccaaggcccccgaggccaagggcuccccccgcgccucccucauccccgacgccacccaccucggcccccaguucugcaaguccugcugguucgagaacaagggccucgucgagugcaacgaccacuaccucugccucaacugccucacccuccuccucuccgucuccucccgcugccccaucugcaagaugccccuccccacccgccuccgccccuccaccaaccccaccgccccccccgcccgcgccgagggcggcaucaaccccccccccuacucccccuga

SEQ ID NO: 3923 - RNA, 300 nt, Artificial Sequence
  derived and/or modified CDS sequence (opt2) from Lassa virus__AHC95545__Z
augggcaacaagcaggccaaggaccccaagaccgaguccuccccccgcgccucccucauccccgacgccacccaccucggcccccaguucugcaaguccugcugguucgagaacaagggccucgucgagugcaacaaccacuaccucugccucaacugccucucccuccuccucuccgucuccaaccgcugccccaucugcaagaugccccuccccaccaagcucaagcccaucaccacccccaccgccccccagaucacccgcgaguccaucaccaaccccccccccuacacccccuga

SEQ ID NO: 3924 - RNA, 300 nt, Artificial Sequence
  derived and/or modified CDS sequence (opt2) from Lassa virus__AHC95547__Z
augggcaaccgccaggccaaggaccccaaggucgaguccuccccccgcgccucccucauccccgacgccacccaccucggcccccaguucugcaaguccugcugguucgagaacaagggccucgucgagugcaacaaccacuaccucugccucaacugccucucccuccuccucuccgucuccaaccgcugccccaucugcaagaugccccuccccacccgccuccgccccaccaccaugcccaccgccccccagaucaucaaggagggcaccaccaaccccccccccuacacccccuga

SEQ ID NO: 3925 - RNA, 300 nt, Artificial Sequence
  derived and/or modified CDS sequence (opt2) from Lassa virus__AIT17124__Z
augggcaacaagcaggucaagacccccgaggccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucggcaaccgcugccccaucugcaagaugccccuccccaccaagcuccgccccuccgucacccccaccgccccccccacccgcgccgccgacuccaucggccccccccccuacucccccuga

SEQ ID NO: 3926 - RNA, 300 nt, Artificial Sequence
  derived and/or modified CDS sequence (opt2) from Lassa virus__AIT17128__Z
augggcaacaagcaggccaagacccccgaggccaaggacuccccccgcgccaaccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccaccggcgccgccgacuccauccgccccccccccuacucccccuga

SEQ ID NO: 3927 - RNA, 300 nt, Artificial Sequence
  derived and/or modified CDS sequence (opt2) from Lassa virus__AIT17132__Z
augggcaacaagcaggccaaggcccccgaggcccgcgacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccacccccaccgccccccccaccgaggccgccgacuccauccgccccccccccuaccgccccuga

SEQ ID NO: 3928 - RNA, 300 nt, Artificial Sequence
  derived and/or modified CDS sequence (opt2) from Lassa virus__AIT17136__Z
augggcaacaagcagaccaaggcccccgaguccaagaacuccccccgcgccucccucauccccgacgccaccuaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgcuccuccgccgcccccaccgccccccccaccggcgccgccgacuccaccaagcccccccccuacucccccuga

SEQ ID NO: 3929 - RNA, 300 nt, Artificial Sequence
  derived and/or modified CDS sequence (opt2) from Lassa virus__AIT17140__Z
augggcaacaagcaggccaaggcccccgagcccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccgccggcgccgucgacuccacccgccccccccccuacucccccuga

SEQ ID NO: 3930 - RNA, 300 nt, Artificial Sequence
  derived and/or modified CDS sequence (opt2) from Lassa virus__AIT17144__Z
augggcaacaagcaggccaagacccccgaguccaaggacuccccccgcgccucccucauccccgacgccacccaccucggcccccaguucugcaaguccugcugguucgagaacaagggccucgucgagugcaacaaccacuaccucugccucaacugccucacccuccuccucggcgucuccaaccgcugccccaucugcaagaugccccuccccaccaagcuccgcuccuccgucgcccccaccgccccccccaccggcgccgucgacuccauccgccccccccccuacucccccuga

SEQ ID NO: 3931 - RNA, 300 nt, Artificial Sequence
  derived and/or modified CDS sequence (opt2) from Lassa virus__AIT17152__Z
augggcaacaagcaggccaagacccccgagaccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccaccgcccccaccgccccccccgccggcgccgccgacaacacccgccccccccccuacucccccuga

SEQ ID NO: 3932 - RNA, 300 nt, Artificial Sequence
  derived and/or modified CDS sequence (opt2) from Lassa virus__AIT17162__Z
augggcaacaagcaggccaaggccuccgaguccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgucacccccaccgccccccccacccgcaccgccgacaacacccgccccccccccuacucccccuga

SEQ ID NO: 3933 - RNA, 300 nt, Artificial Sequence
  derived and/or modified CDS sequence (opt2) from Lassa virus__AIT17166__Z
augggcaacaagcaggccaaggcccccgaggccaaggacuccccccgcgccucccucauccccgacgccacccaccucggcccccaguucugcaaguccugcugguucgagaccaagggccucgucgagugcaacaaccacuaccucugccucaacugccucacccuccuccucuccgucuccaaccgcugccccaucugcaagaugccccuccccaccaagcuccgccccuccgccacccccaccgccccccccaccgaggccgccgacuccaucggccccccccccuacucccccuga

SEQ ID NO: 3934 - RNA, 300 nt, Artificial Sequence
  derived and/or modified CDS sequence (opt2) from Lassa virus__AIT17170__Z
augggcaacaagcaggccaagguccccgaguccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccgccggcgccgccgacuccauccgccccccccccuacucccccuga

SEQ ID NO: 3935 - RNA, 300 nt, Artificial Sequence
  derived and/or modified CDS sequence (opt2) from Lassa virus__AIT17174__Z
augggcaacaagcagaccaaggcccccgaggccaagggcuccccccgcgccucccucauccccgacgccacccaccucggcccccaguucugcaaguccugcugguucgagaacaagggccucgucgagugcaacaaccacuaccucugccucaacugccucacccuccuccucuccgucuccucccgcugccccaucugcaagaugccccuccccaccaagcuccgccccuccgccguccccaccgccccccccaccaaggccgaggacaacacccgccccccccccuacucccccuga

SEQ ID NO: 3936 - RNA, 300 nt, Artificial Sequence
  derived and/or modified CDS sequence (opt2) from Lassa virus__AIT17178__Z
augggcaacaagcaggccaaggccuccgaggccaaggacuccccccgcgccucccucauccccgacgccacccaccucggcccccaguucugcaaguccugcugguucgagaacaagggccucgucgagugcaacaaccacuaccucugccucaacugccucucccuccuccucuccgucuccucccgcugccccaucugcaagaugccccuccccacccgccuccgccccuccaccgcccccaccgccccccccgcccgcgccggcgacaacaucaagcccccccccuacucccccuga

SEQ ID NO: 3937 - RNA, 300 nt, Artificial Sequence
  derived and/or modified CDS sequence (opt2) from Lassa virus__AIT17182__Z
augggcaacaagcaggccaagguccccgagguccgcgacuccccccgcgccucccucauccccgacgccacccaccucggcccccaguucugcaaguccugcugguucgagaacaagggccucgucgagugcaacaaccacuaccucugccucaacugccucacccuccuccucuccgucuccucccgcugccccaucugcaagaugccccuccccaccaagcuccgccccuccgccacccccaccgccccccccgccggcgccggcgacggcacccgccccccccccuacucccccuga

SEQ ID NO: 3938 - RNA, 300 nt, Artificial Sequence
  derived and/or modified CDS sequence (opt2) from Lassa virus__AIT17186__Z
augggcaacaagcaggccaagacccccgagaccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgucgcccccaccgccccccccgccggcgccgccgacaacacccgccccccccccuacucccccuga

SEQ ID NO: 3939 - RNA, 300 nt, Artificial Sequence
  derived and/or modified CDS sequence (opt2) from Lassa virus__AIT17194__Z
augggcaacaagcaggccaaggcccccgagcccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgucgcccccaccgccccccccgccggcgucgucgacuccacccgccccccccccuacucccccuga

SEQ ID NO: 3940 - RNA, 300 nt, Artificial Sequence
  derived and/or modified CDS sequence (opt2) from Lassa virus__AIT17198__Z
augggcaacaagcaggccaagguccccgaguccaaggacuccccccgcgccucccucauccccgacgccacccaccucggcccccaguucugcaaguccugcugguucgagaaccgcggccucgucgagugcaacaaccacuaccucugccucaacugccucacccuccuccucuccgucuccaaccgcugccccaucugcaagaugccccuccccaccaagcuccgccccuccaccgcccccaccgccccccccaccggcgccgccgacuccacccgccccccccccuacucccccuga

SEQ ID NO: 3941 - RNA, 300 nt, Artificial Sequence
  derived and/or modified CDS sequence (opt2) from Lassa virus__AIT17202__Z
augggcaacaagcaggccaagacccccgaguccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccacccgccuccgccccuccgccgcccccaccgccccccccuccggcgccgccgacuccacccgccccccccccuacucccccuga

SEQ ID NO: 3942 - RNA, 300 nt, Artificial Sequence
  derived and/or modified CDS sequence (opt2) from Lassa virus__AIT17206__Z
augggcaacaagcaggccaaggcccccgaggccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccuaccgcugccccaucugcaagaugccccuccccaccaagcuccgccccuccgccacccccaccgccccccccaccgaggccgccgacuccauccgccccccccccuaccgccccuga

SEQ ID NO: 3943 - RNA, 300 nt, Artificial Sequence
  derived and/or modified CDS sequence (opt2) from Lassa virus__AIT17214__Z
augggcaacaagcaggccaaggcccccgaggucaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccaccggcaccgccgacuccauccgccccccccccuacucccccuga

SEQ ID NO: 3944 - RNA, 300 nt, Artificial Sequence
  derived and/or modified CDS sequence (opt2) from Lassa virus__AIT17222__Z
augggcaacaagcaggccaagacccccgagaccaaggacuccccccgcgccucccucauccccgacgccacccaccucggcccccaguucugcaaguccugcugguucgagaacaagggccucgucgagugcaacucccacuaccucugccucaacugccucacccuccuccucuccgucuccucccgcugccccaucugcaagaugccccuccccacccgccuccgccccuccaccgcccccaccgccccccccgccggcgucggcgacuccaccucccccccccccuacucccccuga

SEQ ID NO: 3945 - RNA, 300 nt, Artificial Sequence
  derived and/or modified CDS sequence (opt2) from Lassa virus__AIT17226__Z
augggcaacaagcaggccaagacccccgaggccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccacccccaccgccccccccgccggcgccgccgacuccaucggccccccccccuacucccccuga

SEQ ID NO: 3946 - RNA, 297 nt, Artificial Sequence
  derived and/or modified CDS sequence (opt2) from Lassa virus__AIT17230__Z
augggcaacaagcaggccaaggccuccgacaagaacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccacccccaccgccccccccaccggcgccgccgacuccauccgccccccccccuacucccccuga

SEQ ID NO: 3947 - RNA, 300 nt, Artificial Sequence
  derived and/or modified CDS sequence (opt2) from Lassa virus__AIT17234__Z
augggcaacaagcaggccaaggccuccgaggagaagaacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccacccccaccgccccccccaccggcgccgccgacuccauccgccccccccccuacucccccuga

SEQ ID NO: 3948 - RNA, 300 nt, Artificial Sequence
  derived and/or modified CDS sequence (opt2) from Lassa virus__AIT17238__Z
augggcaacaagcagaccaaggcccccgaggccaagggcuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccacccccaccgccccccccaccgaggccgccgacuccauccgccccccccccuaccgccccuga

SEQ ID NO: 3949 - RNA, 300 nt, Artificial Sequence
  derived and/or modified CDS sequence (opt2) from Lassa virus__AIT17242__Z
augggcaacaagcaggccaaggcccccgaguccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccacccgccuccgccccuccgccgcccccaccgccccccccaccggcgccaccgacuccacccgccccccccccuacucccccuga

SEQ ID NO: 3950 - RNA, 300 nt, Artificial Sequence
  derived and/or modified CDS sequence (opt2) from Lassa virus__AIT17248__Z
augggcaacaagcaggucaaggcccccgaggcccgcaacuccccccgcgccucccucauccccgacgccacccaccucggcccccaguucugcaaguccugcugguucgagaacaagggccucgucgagugcaacaaccacuaccucugccucaacugccucacccuccuccucggcgucuccucccgcugccccaucugcaagaccccccuccccacccgccuccgccccuccgccacccccaccgccccccccgccggcgccggcgacaacacccgccccccccccuacucccccuga

SEQ ID NO: 3951 - RNA, 300 nt, Artificial Sequence
  derived and/or modified CDS sequence (opt2) from Lassa virus__AIT17252__Z
augggcaacaagcaggccaaggcccccgaggccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccaccgcccccaccgccccccccgccggcgccgccgacuccacccgccccccccccuacucccccuga

SEQ ID NO: 3952 - RNA, 300 nt, Artificial Sequence
  derived and/or modified CDS sequence (opt2) from Lassa virus__AIT17256__Z
augggcaacaagcaggccaaggcccccgagaccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccgucggcgccgccgacaacacccgccccccccccuacucccccuga

SEQ ID NO: 3953 - RNA, 300 nt, Artificial Sequence
  derived and/or modified CDS sequence (opt2) from Lassa virus__AIT17260__Z
augggcaacaagcaggccaaggcccccgagcucaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccgccggcgccgucgacuccacccgccccccccccuacucccccuga

SEQ ID NO: 3954 - RNA, 300 nt, Artificial Sequence
  derived and/or modified CDS sequence (opt2) from Lassa virus__AIT17268__Z
augggcaacaagcagaccaaggcccccgaggucaagggcuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcucaagcccuccaccacccccaccgccccccccaccggcgccgccgacuccauccgccccccccccuacucccccuga

SEQ ID NO: 3955 - RNA, 300 nt, Artificial Sequence
  derived and/or modified CDS sequence (opt2) from Lassa virus__AIT17272__Z
augggcaacaagcaggucaagaccuccgaggcccgcgacuccccccgcgccucccucauccccgacgccaccgaccucggcccccaguucugcaaguccugcugguucgagaacaagggccucgucgagugcaacaaccacuaccucugccucaacugccucacccuccuccucuccgucuccaaccgcugccccaucugcaagaugccccuccccacccgccuccgccccuccgccaaccccaccgccccccccgccgagaccggcgacuccacccgccccccccccuacucccccuga

SEQ ID NO: 3956 - RNA, 300 nt, Artificial Sequence
  derived and/or modified CDS sequence (opt2) from Lassa virus__AIT17278__Z
augggcuccaagcagaccaagacccccgaggucaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccgcccgcgccgccgacgacacccgccccccccccuacucccccuga

SEQ ID NO: 3957 - RNA, 300 nt, Artificial Sequence
  derived and/or modified CDS sequence (opt2) from Lassa virus__AIT17282__Z
augggcaacaagcaggccaaggcccccgagcccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccgccggcgccgucgacuccauccgccccccccccuacucccccuga

SEQ ID NO: 3958 - RNA, 300 nt, Artificial Sequence
  derived and/or modified CDS sequence (opt2) from Lassa virus__AIT17286__Z
augggcaacaagcagaccaaggcccccgaggucaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccaccgcccccaccgccccccccgccggcaccauggacuccacccgccccccccccuacucccccuga

SEQ ID NO: 3959 - RNA, 300 nt, Artificial Sequence
  derived and/or modified CDS sequence (opt2) from Lassa virus__AIT17290__Z
augggcaacaagcaggcccgcgcccccgaggccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccucccgcugccccaucugcaagaugccccuccccacccgccuccgccccuccgccauccccaccgccccccccgccggcaccggcgacuccucccgccccccccccuacucccccuga

SEQ ID NO: 3960 - RNA, 300 nt, Artificial Sequence
  derived and/or modified CDS sequence (opt2) from Lassa virus__AIT17296__Z
augggcaacaagcaggccaagacccccgagaucaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccgccggcgccgccgacaucacccgccccccccccuacucccccuga

SEQ ID NO: 3961 - RNA, 300 nt, Artificial Sequence
  derived and/or modified CDS sequence (opt2) from Lassa virus__AIT17300__Z
augggcaacaagcaggucaaggcccccgaggcccgcaacuccccccgcgccucccucauccccgacgccacccaccucggcccccaguucugcaaguccugcugguucgagaacaagggccucgucgagugcaacaaccacuaccucugccucaacugccucacccuccuccucggcgucuccucccgcugccccaucugcaagaugccccuccccacccgccuccgccccuccaccgcccccaccgccccccccgccggcgccggcgacaacacccgccccccccccuacucccccuga

SEQ ID NO: 3962 - RNA, 300 nt, Artificial Sequence
  derived and/or modified CDS sequence (opt2) from Lassa virus__AIT17312__Z
augggcaacaagcaggccaagacccccgagaccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccgucggcgccgccgacuccacccgccccccccccuacucccccuga

SEQ ID NO: 3963 - RNA, 300 nt, Artificial Sequence
  derived and/or modified CDS sequence (opt2) from Lassa virus__AIT17316__Z
augggcaacaagcaggccaaggcccccgaggcccgcaacuccccccgcgccucccucauccccgacgccacccaccucggcccccaguucugcaaguccugcugguucgagaaccgcggccucgucgagugcaacaaccacuaccucugccucaacugccucacccuccuccucuccgucuccucccgcugccccaucugcaagaugccccuccccacccgccuccgccccuccgccgcccccaccgccccccccgccggcgccggcgacaacacccgccccccccccuacucccccuga

SEQ ID NO: 3964 - RNA, 300 nt, Artificial Sequence
  derived and/or modified CDS sequence (opt2) from Lassa virus__AIT17320__Z
augggcaacaagcaggccaaggcccccgaggcccgcaacuccccccgcgccucccucauccccgacgccacccaccucggcccccaguucugcaaguccugcugguucgagaacaagggccucgucgagugcaacaaccacuaccucugccucaacugccucacccuccuccucggcgucuccucccgcugccccaucugcaagaugccccuccccacccgccuccgccccuccgccgcccccaccgccccccucgccgaggccggcgacaacacccgccccccccccuacucccccuga

SEQ ID NO: 3965 - RNA, 300 nt, Artificial Sequence
  derived and/or modified CDS sequence (opt2) from Lassa virus__AIT17326__Z
augggcaacaagcaguccaaggcccccgagucccgcgacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccacccccaccgccccccccacccgcgccgccgacuccauccgccccccccccuacucccccuga

SEQ ID NO: 3966 - RNA, 300 nt, Artificial Sequence
  derived and/or modified CDS sequence (opt2) from Lassa virus__AIT17330__Z
augggcaacaagcaggccaaggcccucgaguccaagaacuccccccgcgccucccucauccccgacgccaccuaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgcuccuccgccgcccccaccgccccccccaccggcgccgccgacggcaccaagcccccccccuacucccccuga

SEQ ID NO: 3967 - RNA, 300 nt, Artificial Sequence
  derived and/or modified CDS sequence (opt2) from Lassa virus__AIT17342__Z
augggcaacaagcaggccaaggccuccgaggccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccaccgcccccaccgccccccagaccggcgccgccgacuccauccgccccccccccuacucccccuga

SEQ ID NO: 3968 - RNA, 300 nt, Artificial Sequence
  derived and/or modified CDS sequence (opt2) from Lassa virus__AIT17346__Z
augggcaacaagcaggccaaggcccccgagaccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccgucggcgccgccgacuccacccgccccccccccuacucccccuga

SEQ ID NO: 3969 - RNA, 300 nt, Artificial Sequence
  derived and/or modified CDS sequence (opt2) from Lassa virus__AIT17362__Z
augggcaacaagcaggccaaggcccccgaguccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccgccggcgccgccgacuccauccgccccccccccuacucccccuga

SEQ ID NO: 3970 - RNA, 300 nt, Artificial Sequence
  derived and/or modified CDS sequence (opt2) from Lassa virus__AIT17366__Z
augggcaacaagcagaccaagacccccgaggucaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccgcccgcgccgccgacgacacccgccccccccccuacucccccuga

SEQ ID NO: 3971 - RNA, 300 nt, Artificial Sequence
  derived and/or modified CDS sequence (opt2) from Lassa virus__AIT17376__Z
augggcaacaagcaggccaaggcccccgaguccaaggacuccccccgcgccucccucauccccgacgccaccuaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgcuccuccgucgcccccaccgccccccccacccgcgccgccgacuccacccgccccccccccuacucccccuga

SEQ ID NO: 3972 - RNA, 300 nt, Artificial Sequence
  derived and/or modified CDS sequence (opt2) from Lassa virus__AIT17382__Z
augggcaacaagcagaccaagaccuccgaggucaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccgcccgcgccgccgacgacacccgccccccccccuacucccccuga

SEQ ID NO: 3973 - RNA, 300 nt, Artificial Sequence
  derived and/or modified CDS sequence (opt2) from Lassa virus__AIT17386__Z
augggcaacaagcaggccaagacccccgaggcccgcgacuccccccgcgccucccucauccccgacgccacccaccucggcccccaguucugcaaguccugcugguucgagaacaagggccucgucgagugcaacaaccacuaccucugccucaacugccucacccuccuccucuccgucuccucccgcugccccaucugcaagaugccccuccccaccaagcuccgccccuccgccacccccaccgccccccccgccggcgccggcgacggcacccgccccccccccuacucccccuga

SEQ ID NO: 3974 - RNA, 300 nt, Artificial Sequence
  derived and/or modified CDS sequence (opt2) from Lassa virus__AIT17396__Z
augggcaacaagcaggucaaggcccccgaggcccgcaacuccccccgcgccucccucauccccgacgccacccaccucggcccccaguucugcaaguccugcugguucgagaacaagggccucgucgagugcaacaaccacuaccucugccucaacugccucacccuccuccucggcgucuccucccgcugccccaucugcaagaugccccuccccacccgccuccgccccuccgccgcccccaccgccccccccgccgaggccggcgacaacacccgccccccccccuacucccccuga

SEQ ID NO: 3975 - RNA, 300 nt, Artificial Sequence
  derived and/or modified CDS sequence (opt2) from Lassa virus__AIT17402__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgagaccauccagaacaccacccccccccccuacacccccuga

SEQ ID NO: 3976 - RNA, 300 nt, Artificial Sequence
  derived and/or modified CDS sequence (opt2) from Lassa virus__AIT17406__Z
augggcaaccgccaggccaaguccuccaaggucgacgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccguccagaacaccgcccccccccccuacgcccccuga

SEQ ID NO: 3977 - RNA, 300 nt, Artificial Sequence
  derived and/or modified CDS sequence (opt2) from Lassa virus__AIT17410__Z
augggcaacaagcaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccacccgccucaaggccgccacccagcccuccgcccccuccaccgaggccacccagaacaccacccccccccccuacacccccuga

SEQ ID NO: 3978 - RNA, 300 nt, Artificial Sequence
  derived and/or modified CDS sequence (opt2) from Lassa virus__AIT17418__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccacccagcccuccgcccccuccaccgagaccauccagaacaccacccccccccccuacacccccuga

SEQ ID NO: 3979 - RNA, 300 nt, Artificial Sequence
  derived and/or modified CDS sequence (opt2) from Lassa virus__AIT17422__Z
augggcaaccgccaggccaaguccgccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccacccagcccuccgcccccuccaccgaggccacccagaacaccacccccccccccuacacccccuga

SEQ ID NO: 3980 - RNA, 300 nt, Artificial Sequence
  derived and/or modified CDS sequence (opt2) from Lassa virus__AIT17426__Z
augggcaacaagcaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccacccagcccuccgcccccuccaccgaggccacccagaacaccacccccccccccuacacccccuga

SEQ ID NO: 3981 - RNA, 300 nt, Artificial Sequence
  derived and/or modified CDS sequence (opt2) from Lassa virus__AIT17432__Z
augggcaacaagcaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccacccgccucaaggccgccacccagcccuccgcccccuccaccgaggccacccagaacaccauccccccccccuacacccccuga

SEQ ID NO: 3982 - RNA, 300 nt, Artificial Sequence
  derived and/or modified CDS sequence (opt2) from Lassa virus__AIT17436__Z
augggcaacaagcaggccaaguccaccaaggccgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccacccagcccuccgcccccuccaccgaggccacccgcaacaccacccccccccccuacacccccuga

SEQ ID NO: 3983 - RNA, 300 nt, Artificial Sequence
  derived and/or modified CDS sequence (opt2) from Lassa virus__AIT17444__Z
augggcaaccgccaggccaaguccaccaaggucgacgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccgcccagaacaccgcccccccccccuacgcccccuga

SEQ ID NO: 3984 - RNA, 300 nt, Artificial Sequence
  derived and/or modified CDS sequence (opt2) from Lassa virus__AIT17448__Z
augggcaaccgccaggccaaguccaccaaggucggcgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccaccgcccagcccuccgcccccuccgccgaggccauccagaacaccacccccccccccuacacccccuga

SEQ ID NO: 3985 - RNA, 300 nt, Artificial Sequence
  derived and/or modified CDS sequence (opt2) from Lassa virus__AIT17452__Z
augggcaaccgccaggccaaguccacccgcgucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccacccgccuccgcgccgccguccagcccuccgcccccuccaccgagaccacccaggacaccacccccccccccuacucccccuga

SEQ ID NO: 3986 - RNA, 300 nt, Artificial Sequence
  derived and/or modified CDS sequence (opt2) from Lassa virus__AIT17456__Z
augggcaaccgccaggccaaguccaccgaggucaacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccacccagcccuccgcccccuccaccgaggucacccagaacaccguccccccccccuacucccccuga

SEQ ID NO: 3987 - RNA, 300 nt, Artificial Sequence
  derived and/or modified CDS sequence (opt2) from Lassa virus__AIT17460__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgccccccccaccgaggccacccagaacaccacccccccccccuacacccccuga

SEQ ID NO: 3988 - RNA, 300 nt, Artificial Sequence
  derived and/or modified CDS sequence (opt2) from Lassa virus__AIT17468__Z
augggcaaccgccaggccaagcagaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccaucuccucccgcugccccaucugcaagaugccccuccccaccaagcucaaggccgccgcccagcccuccgcccccuccaccgaggccacccaggacaccacccccccccccuacacccccuga

SEQ ID NO: 3989 - RNA, 300 nt, Artificial Sequence
  derived and/or modified CDS sequence (opt2) from Lassa virus__AIT17472__Z
augggcaacaagcagaccaaguccaccaaggccgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccacccgccucaaggccgccgcccagcccuccgcccccuccaccgaggccacccaggacaccacccccccccccuacacccccuga

SEQ ID NO: 3990 - RNA, 300 nt, Artificial Sequence
  derived and/or modified CDS sequence (opt2) from Lassa virus__AIT17476__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccgccgaggccauccagaacaccacccccccccccuacacccccuga

SEQ ID NO: 3991 - RNA, 300 nt, Artificial Sequence
  derived and/or modified CDS sequence (opt2) from Lassa virus__AIT17480__Z
augggcaaccgccacgccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggucauccaguccaccacccccccccccuacacccccuga

SEQ ID NO: 3992 - RNA, 300 nt, Artificial Sequence
  derived and/or modified CDS sequence (opt2) from Lassa virus__AIT17484__Z
augggcaaccgccacgccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggagauccagaacaccacccccccccccuacacccccuga

SEQ ID NO: 3993 - RNA, 300 nt, Artificial Sequence
  derived and/or modified CDS sequence (opt2) from Lassa virus__AIT17488__Z
augggcaaccgccaggccaagcccaccaaggucgacgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccgcccagaacaccgcccccccccccuacgcccccuga

SEQ ID NO: 3994 - RNA, 300 nt, Artificial Sequence
  derived and/or modified CDS sequence (opt2) from Lassa virus__AIT17496__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccacccgccucaaggccgccacccagcccuccgcccccuccaccgaggccacccagaccaccacccccccccccuacacccccuga

SEQ ID NO: 3995 - RNA, 300 nt, Artificial Sequence
  derived and/or modified CDS sequence (opt2) from Lassa virus__AIT17500__Z
augggcaaccgccagaccaaguccaccaaggucgacgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccaccaagcucaagaccgccgcccagcccuccgccccccccaccgaggccgcccgcaccaccgcccccccccccuacgcccccuga

SEQ ID NO: 3996 - RNA, 300 nt, Artificial Sequence
  derived and/or modified CDS sequence (opt2) from Lassa virus__AIT17508__Z
augggcaaccgccagaccaaguccaccaaggucgacgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccacccagaacaccgcccccccccccuacgcccccuga

SEQ ID NO: 3997 - RNA, 300 nt, Artificial Sequence
  derived and/or modified CDS sequence (opt2) from Lassa virus__AIT17512__Z
augggcaaccgccaggccaaguccaccaaggucuacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccacccgccucaaggccgccacccagcccuccgcccccuccaccgaggccacccagaacaccacccccccccccuacacccccuga

SEQ ID NO: 3998 - RNA, 300 nt, Artificial Sequence
  derived and/or modified CDS sequence (opt2) from Lassa virus__AIT17516__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaagaccgccacccagcccuccgccccccucaccgaggccacccagaacaccacccccccccccuacacccccuga

SEQ ID NO: 3999 - RNA, 300 nt, Artificial Sequence
  derived and/or modified CDS sequence (opt2) from Lassa virus__AIT17520__Z
augggcaacaagcaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccaaccgcugccccaucugcaagaugccccuccccaccaagcucaaggccgccgcccagcccuccgcccccuccaccgaggccacccagaacaccacccccccccccuacacccccuga

SEQ ID NO: 4000 - RNA, 300 nt, Artificial Sequence
  derived and/or modified CDS sequence (opt2) from Lassa virus__AIT17526__Z
augggcaaccgccaggccaaguccgccaaggucaccgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccacccgccucaaggccgccacccagcccuccgcccccuccgccgaggccccccaguccaccacccccccccccuacacccccuga

SEQ ID NO: 4001 - RNA, 300 nt, Artificial Sequence
  derived and/or modified CDS sequence (opt2) from Lassa virus__AIT17536__Z
augggcaaccgccagacccgccccaccgaggccaccgagcagucccgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccacccgccucaaggccuccgcccagcccuccgccccccccaccgaggccccccagaacaaggcccccccccccuacacccccuga

SEQ ID NO: 4002 - RNA, 300 nt, Artificial Sequence
  derived and/or modified CDS sequence (opt2) from Lassa virus__AIT17542__Z
augggcaaccgccaggucaaguccaccaaggucgacgagcaccagcgcgcccaccucauccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucgaggccgccgcccagcccuccgcccccuccaccgaggccacccaggacaccacccccccccccuacacccccuga

SEQ ID NO: 4003 - RNA, 300 nt, Artificial Sequence
  derived and/or modified CDS sequence (opt2) from Lassa virus__AIT17546__Z
augggcaacaagcaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgagaccauccagaacaccacccccccccccuacacccccuga

SEQ ID NO: 4004 - RNA, 300 nt, Artificial Sequence
  derived and/or modified CDS sequence (opt2) from Lassa virus__AIT17550__Z
augggcaaccgccaggccaagcagaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgagaucacccagaacaccacccccccccccuacacccccuga

SEQ ID NO: 4005 - RNA, 300 nt, Artificial Sequence
  derived and/or modified CDS sequence (opt2) from Lassa virus__AIT17554__Z
augggcaaccgccaggccaaguccaccaaggccgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccaaccgcugccccaucugcaagaugccccuccccacccgccucaaggccgccgcccagcccuccgcccccuccaccgaggccacccaggacaccacccccccccccuacacccccuga

SEQ ID NO: 4006 - RNA, 300 nt, Artificial Sequence
  derived and/or modified CDS sequence (opt2) from Lassa virus__AIT17558__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccacccgccucaaggccgccgcccagcccuccgcccccuccaccgaggccauccgcuccaccacccccccccccuacacccccuga

SEQ ID NO: 4007 - RNA, 300 nt, Artificial Sequence
  derived and/or modified CDS sequence (opt2) from Lassa virus__AIT17570__Z
augggcaaccgccaggccaaguccgccaaggucaacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccacccagaacaucacccccccccccuacacccccuga

SEQ ID NO: 4008 - RNA, 300 nt, Artificial Sequence
  derived and/or modified CDS sequence (opt2) from Lassa virus__AIT17578__Z
augggcaaccgccaggccaaguccaccaaggucgacgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccaccaagcuccgcgccgccgcccagcccuccgcccccuccaccgaguccgcccagaacaccgcccccccccccuacgcccccuga

SEQ ID NO: 4009 - RNA, 300 nt, Artificial Sequence
  derived and/or modified CDS sequence (opt2) from Lassa virus__AIT17586__Z
augggcaacaagcaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccacccgccucaaggccgccgcccagcccuccgcccccuccaccgaggucacccagaacaccacccccccccccuacacccccuga

SEQ ID NO: 4010 - RNA, 300 nt, Artificial Sequence
  derived and/or modified CDS sequence (opt2) from Lassa virus__AIT17590__Z
augggcaaccgccaggccaaguccaccaaggucgacgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccaccaagcucgaggccaccacccagcccuccgcccccuccaccgaggagacccaguccaccacccccccccccuacacccccuga

SEQ ID NO: 4011 - RNA, 300 nt, Artificial Sequence
  derived and/or modified CDS sequence (opt2) from Lassa virus__AIT17602__Z
augggcaacaagcaggccaaguccaccaaggucgacgaguaccagcgcgcccaccucguccccgacgccucccaccucggcccccaguucugcaaguccugcugguucgagaaccgcggccucgucgagugcaacaaccacuaccucugccucaacugccucucccuccuccucuccgucuccaaccgcugccccaucugcaagaugccccuccccacccgccucaaggccgccgcccagcccuccgccccccccaccgaggccacccagaacaccacccccccccccuacacccccuga

SEQ ID NO: 4012 - RNA, 300 nt, Artificial Sequence
  derived and/or modified CDS sequence (opt2) from Lassa virus__AIT17610__Z
augggcaaccgccaggccaagcccaccaaggucgacgagcaccagcgcgcccagcucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccacccagcccuccgcccccuccaccgaggccacccagaacuccacccccccccccuacacccccuga

SEQ ID NO: 4013 - RNA, 300 nt, Artificial Sequence
  derived and/or modified CDS sequence (opt2) from Lassa virus__AIT17614__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccacccagcccuccgcccccuccaccgaggccacccagaacaccacccccccccccuacacccccuga

SEQ ID NO: 4014 - RNA, 300 nt, Artificial Sequence
  derived and/or modified CDS sequence (opt2) from Lassa virus__AIT17618__Z
augggcaaccgccaggccaaguccaccgaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccaaccgcugccccaucugcaagaugccccuccccaccaagcucaaggccgccacccagcccuccgcccccuccaccgaggccacccagaacaccacccccccccccuacacccccuga

SEQ ID NO: 4015 - RNA, 300 nt, Artificial Sequence
  derived and/or modified CDS sequence (opt2) from Lassa virus__AIT17622__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccacccagcccuccgcccccuccaccgaggucacccagaacaccauccccccccccuacucccccuga

SEQ ID NO: 4016 - RNA, 300 nt, Artificial Sequence
  derived and/or modified CDS sequence (opt2) from Lassa virus__AIT17628__Z
augggcaacaagcaggccaaguccaccaagaucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccacccgccucaaggccgccacccagcccuccgcccccuccaccgaggccacccagaacaccacccccccccccuacacccccuga

SEQ ID NO: 4017 - RNA, 300 nt, Artificial Sequence
  derived and/or modified CDS sequence (opt2) from Lassa virus__AIT17632__Z
augggcaaccgccaggccaaguccaccaaggucgacgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccaccaagcuccgcgccaccgcccagcccuccgcccccuccaccgaggccauccagaacaccacccccccccccuacacccccuga

SEQ ID NO: 4018 - RNA, 300 nt, Artificial Sequence
  derived and/or modified CDS sequence (opt2) from Lassa virus__AIT17636__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaucgagaccauccagaacaccacccccccccccuacacccccuga

SEQ ID NO: 4019 - RNA, 300 nt, Artificial Sequence
  derived and/or modified CDS sequence (opt2) from Lassa virus__AIT17640__Z
augggcaaccgccaggccaaguccaccaaggucggcgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccacccaggacaccacccccccccccuacacccccuga

SEQ ID NO: 4020 - RNA, 300 nt, Artificial Sequence
  derived and/or modified CDS sequence (opt2) from Lassa virus__AIT17648__Z
augggcaaccgccaggccaaguccaccaaggucgacgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccaccaagcucaaggccaccguccagcccuccgcccccuccaccgaggccgcccaguccaccgcccccccccccuacgcccccuga

SEQ ID NO: 4021 - RNA, 300 nt, Artificial Sequence
  derived and/or modified CDS sequence (opt2) from Lassa virus__AIT17652__Z
augggcaaccgccaggccaaguccaccaaggucggcgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccgccgaggccauccagaagaccacccccccccccuacacccccuga

SEQ ID NO: 4022 - RNA, 300 nt, Artificial Sequence
  derived and/or modified CDS sequence (opt2) from Lassa virus__AIT17656__Z
augggcaaccgccaggccaaguccaccaaggucgacgaccaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccgcccaggacaccacccccccccccuacacccccuga

SEQ ID NO: 4023 - RNA, 300 nt, Artificial Sequence
  derived and/or modified CDS sequence (opt2) from Lassa virus__AIT17660__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccaaccgcugccccaucugcaagaugccccuccccaccaagcucaaggccgccgcccagcccuccgcccccuccaccgaggccauccagaacaccacccccccccccuacgcccccuga

SEQ ID NO: 4024 - RNA, 300 nt, Artificial Sequence
  derived and/or modified CDS sequence (opt2) from Lassa virus__AIT17664__Z
augggcaacaagcaggccaaguccaccaaggucgacgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccgcccagaacaccgcccccccccccuacgcccccuga

SEQ ID NO: 4025 - RNA, 300 nt, Artificial Sequence
  derived and/or modified CDS sequence (opt2) from Lassa virus__AIT17668__Z
augggcaaccgccaggccaaguccaccaaggucgacgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccaccaagcucaagaccaccgcccagcccuccgccccccccaccgaggccgccaagaacaccgcccccccccccuacgcccccuga

SEQ ID NO: 4026 - RNA, 300 nt, Artificial Sequence
  derived and/or modified CDS sequence (opt2) from Lassa virus__AIT17676__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccacccagcccuccgcccccuccaccgaggucacccagaacaccacccccccccccuacacccccuga

SEQ ID NO: 4027 - RNA, 300 nt, Artificial Sequence
  derived and/or modified CDS sequence (opt2) from Lassa virus__AIT17680__Z
augggcaaccgccaggccaaguccaccaagaucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccauccagaacaccacccccccccccuacacccccuga

SEQ ID NO: 4028 - RNA, 300 nt, Artificial Sequence
  derived and/or modified CDS sequence (opt2) from Lassa virus__AIT17684__Z
augggcaaccgccaggccaaguccgccaaggucgacgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccugccgcugccccaucugcaagaugccccuccccaccaagcucaaggccgccacccagcccuccgcccccuccaccgaggccacccagaacaccacccccccccccuacacccccuga

SEQ ID NO: 4029 - RNA, 300 nt, Artificial Sequence
  derived and/or modified CDS sequence (opt2) from Lassa virus__AIT17692__Z
augggcaaccgccacgccaagcccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccauccagaacaccacccccccccccuacacccccuga

SEQ ID NO: 4030 - RNA, 300 nt, Artificial Sequence
  derived and/or modified CDS sequence (opt2) from Lassa virus__AIT17702__Z
augggcaaccgccacgccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccuuccagaacaccacccccccccccuacacccccuga

SEQ ID NO: 4031 - RNA, 300 nt, Artificial Sequence
  derived and/or modified CDS sequence (opt2) from Lassa virus__AIT17708__Z
augggcaaccgccacgccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccacccagcccuccgcccccuccaccgaggccauccagaacaccacccccccccccuacacccccuga

SEQ ID NO: 4032 - RNA, 300 nt, Artificial Sequence
  derived and/or modified CDS sequence (opt2) from Lassa virus__AIT17716__Z
augggcaaccgccccgccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccacccagaacaccacccccccccccuacacccccuga

SEQ ID NO: 4033 - RNA, 300 nt, Artificial Sequence
  derived and/or modified CDS sequence (opt2) from Lassa virus__AIT17720__Z
augggcaaccgccaggccaagcccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccacccgccucaaggccgccgcccagcccuccgcccccuccaccgaggagacccagaacaccacccccccccccuacacccccuga

SEQ ID NO: 4034 - RNA, 300 nt, Artificial Sequence
  derived and/or modified CDS sequence (opt2) from Lassa virus__AIT17730__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgccccccucaccgaggccauccagaacaccacccccccccccuacacccccuga

SEQ ID NO: 4035 - RNA, 300 nt, Artificial Sequence
  derived and/or modified CDS sequence (opt2) from Lassa virus__AIT17734__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccauccagaacaccacccccccccccuacacccccuga

SEQ ID NO: 4036 - RNA, 300 nt, Artificial Sequence
  derived and/or modified CDS sequence (opt2) from Lassa virus__AIT17738__Z
augggcaaccgccaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccacccuccccuccgcccccuccaccgaggucacccagaacaccaccccccccccccacucccccuga

SEQ ID NO: 4037 - RNA, 300 nt, Artificial Sequence
  derived and/or modified CDS sequence (opt2) from Lassa virus__AIT17750__Z
augggcaaccgccaggccaaguccgccaaggucaacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccacccagcccuccgcccccuccaccgaggccacccagaacaccacccccccccccuacacccccuga

SEQ ID NO: 4038 - RNA, 300 nt, Artificial Sequence
  derived and/or modified CDS sequence (opt2) from Lassa virus__AIT17754__Z
augggcaaccgccaggccaaguccaccaaggucgacgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccaccaagcucaaggccuccgcccagcccuccgcccccuccaccgaggccgcccagaacaccgcccccccccccuacgcccccuga

SEQ ID NO: 4039 - RNA, 300 nt, Artificial Sequence
  derived and/or modified CDS sequence (opt2) from Lassa virus__AIT17760__Z
augggcaaccgccaggccaaguccacccgcaccgacgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccggccagaacaccgcccccccccccuacgcccccuga

SEQ ID NO: 4040 - RNA, 300 nt, Artificial Sequence
  derived and/or modified CDS sequence (opt2) from Lassa virus__AIT17768__Z
augggcaaccgccaggccaaguccgccaccgucgacgagugccagcgcgcccaccucguccccgacgccuccuaccucggcccccaguucugcaaguccugcugguucgagaacaagggccucgucgagugcaacaaccacuaccucugccucaacugccucucccuccuccucuccgucuccucccgcugccccaucugcaagaugccccuccccaccaagcucaaggccgccgcccagcccuccgcccccuccacccgcgccacccagaacaccacccccccccccuacacccccuga

SEQ ID NO: 4041 - RNA, 300 nt, Artificial Sequence
  derived and/or modified CDS sequence (opt2) from Lassa virus__AIT17776__Z
augggcaacaagcaggccaaguccaccaaggucgacgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccacccgccucaaggccgccgcccagcccuccgcccccuccaccgaggccacccagaacgccgcccccccccccuacgcccccuga

SEQ ID NO: 4042 - RNA, 300 nt, Artificial Sequence
  derived and/or modified CDS sequence (opt2) from Lassa virus__AIT17780__Z
augggcaaccgccagaccaaguccaccaaggucgacgagcaccagcgcgccuaccucguccccgacgccucccuccucggcccccaguucugcaaguccugcugguucgagaacaagggccucgucgagugcaacaaccacuaccucugccucaacugccucucccuccuccucuccgucuccucccgcugccccaucugcaagaugccccuccccacccgccucaaggccgccgcccagcccuccgccccccccaccgaggccauccagaacaccacccccccccccuacacccccuga

SEQ ID NO: 4043 - RNA, 300 nt, Artificial Sequence
  derived and/or modified CDS sequence (opt2) from Lassa virus__AIT17784__Z
augggcaaccgccagaccaagcccaccaaggucgacgagcaccagcgcgcccaccucguccccgacgccucccaccucggcccccaguucugcaaguccugcugguucgagaacaagggccucgucgagugcaacaaccacuaccucugccucaacugccucucccuccuccucuccgucuccucccgcugccccaucugcaagaugccccuccccaccaagcucaaggccaccgcccagcccuccgcccccuccaccgaggccgcccagaacaccgcccccccccccuacgcccccuga

SEQ ID NO: 4044 - RNA, 300 nt, Artificial Sequence
  derived and/or modified CDS sequence (opt2) from Lassa virus__AIT17788__Z
augggcaaccgccaggucaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccacccagcccuccgccccccccaccgaggccacccagaagaccacccccccccccuacacccccuga

SEQ ID NO: 4045 - RNA, 300 nt, Artificial Sequence
  derived and/or modified CDS sequence (opt2) from Lassa virus__AIT17792__Z
augggcaacaagcaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccggccgcugccccaucugcaagaugccccuccccaccaagcucaaggccaccgcccagcccuccgcccccuccaccgaggccacccagaacaccacccccccccccuacacccccuga

SEQ ID NO: 4046 - RNA, 300 nt, Artificial Sequence
  derived and/or modified CDS sequence (opt2) from Lassa virus__AIT17796__Z
augggcaacaagcaggccaaguccaccaaggucgacgagcaccagcgcgcccaccucguccccgacgccucccaccucggcccccaguucugcaaguccugcugguucgagaaccgcggccucgucgagugcaacaaccacuaccucugccucaacugccucucccuccuccucuccgucuccucccgcugccccaucugcaagaugccccuccccaccaagcucaaggccgccgcccagcccuccgcccccuccaccgaggccauccagaacaccacccccccccccuacacccccuga

SEQ ID NO: 4047 - RNA, 300 nt, Artificial Sequence
  derived and/or modified CDS sequence (opt2) from Lassa virus__AIT17800__Z
augggcaacaagcaggccaaggcccccgaggccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccacccccaccgccccccccaccgaggccgccgacuccauccgccccccccccuaccaccccuga

SEQ ID NO: 4048 - RNA, 300 nt, Artificial Sequence
  derived and/or modified CDS sequence (opt2) from Lassa virus__AIT17804__Z
augggcaacaagcaggccaaggccuccgaggagaagaacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccaccacccccaccgccccccccaccggcgccgccgacuccauccgccccccccccuacucccccuga

SEQ ID NO: 4049 - RNA, 300 nt, Artificial Sequence
  derived and/or modified CDS sequence (opt2) from Lassa virus__AIT17808__Z
augggcaacaagcaggccaaggcccccgaguccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccacccgccuccgccccuccgccgcccccaccgccccccccaccggcgccgccgacuccacccgccccccccccuacucccccuga

SEQ ID NO: 4050 - RNA, 303 nt, Artificial Sequence
  derived and/or modified CDS sequence (opt2) from Lassa virus__AIT17834__Z
augggcaacaagcagacccgcuccccccccaagcccgagcacccccgccccacccuccuccccgacgccucccaccucggcccccaguucugcaaguccugcugguucgagaacaagggccucgucgagugcaacaaccacuaccucugccucaacugccucacccuccuccucuccgucuccgaccgcugccccaucugcaagaugccccuccccaccaagcucgccguccgcacccagcccuccgcccccccccucaaccagggcaacacccaguccucccccccccccuacucccccuga

SEQ ID NO: 4051 - RNA, 300 nt, Artificial Sequence
  derived and/or modified CDS sequence (opt2) from Lassa virus__AIT17838__Z
augggcaacaagcaggccaagguccccgaguccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcucaagcccuccgccgcccccaccgccccccccaccggcgccgccgacuccauccgccccccccccuacucccccuga

SEQ ID NO: 4052 - RNA, 300 nt, Artificial Sequence
  derived and/or modified CDS sequence (opt2) from Lassa virus__AIT17842__Z
augggcaacaagcaggccaagguccccgaguccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccaccaagcuccgccccuccgccgcccccaccgccccccccaccggcgucgccgacuccauccgccccccccccuacucccccuga

SEQ ID NO: 4053 - RNA, 300 nt, Artificial Sequence
  derived and/or modified CDS sequence (opt2) from Lassa virus__ANH09743__Z
augggcaacaagcaggccaaggccuccgaggucgaggacggcccccgcgccucccucauccccgacgccacccaccucggcccccaguucugcaaguccugcugguucgagaacaagucccucgucgagugcaacaaccacuaccucugccucaacugccucacccuccuccucuccgucuccaaccgcugccccaucugcaagaugccccuccccacccgccucaagcccuccgucguccccaccgccccccccacccgcgccggcgacggcacccgccccccccccuacucccccuga

SEQ ID NO: 4054 - RNA, 300 nt, Artificial Sequence
  derived and/or modified CDS sequence (opt2) from Lassa virus__ANH09745__Z
augggcaacaagcagaccaaggcccccgaggucgaggacggcccccgcgccucccucauccccgacgccacccaccucggcccccaguucugcaaguccugcugguucgagaacaagggccucgucgagugcaacaaccacuaccucugccucaacugccucacccuccuccucuccgucuccucccgcugccccaucugcaagaugccccuccccacccgccucaagcccuccaucguccccaccgccccccccgcccgcaccggcgagaacacccgccccccccccuacucccccuga

SEQ ID NO: 4055 - RNA, 300 nt, Artificial Sequence
  derived and/or modified CDS sequence (opt2) from Lassa virus__ANH09749__Z
augggcaacaagcaggccaaggcccccgaggucgaggacggcccccgcgccucccucauccccgacgccacccaccucggcccccaguucugcaaguccugcugguucgagaaccgcggccucgucgagugcaacaaccacuaccucugccucaacugccucacccuccuccucuccgucuccaaccgcugccccaucugcaagaugccccuccccacccgccucaagcccuccgucguccccaccgccccccccaccggcgccggcggcgacacccgccccccccccuacucccccuga

SEQ ID NO: 4056 - RNA, 300 nt, Artificial Sequence
  derived and/or modified CDS sequence (opt2) from Lassa virus__ANH09751__Z
augggcaacaagcaggccaaggcccccaaggccgaggacggcccccgcgccucccucauccccgacgccacccaccucggcccccaguucugcaaguccugcugguucgagaacaagggccucgucgagugcaacaaccacuaccucugccucaacugccucacccuccuccucuccgucuccaaccgcugccccaucugcaagaugccccuccccacccgccucaagcccuccgucguccccaccgccccccccaccggcgccggcggcgacacccgcccccccccccacucccccuga

SEQ ID NO: 4057 - RNA, 300 nt, Artificial Sequence
  derived and/or modified CDS sequence (opt2) from Lassa virus__ANH09753__Z
augggcaacaagcaggccaaggccuccgaggccgaggacggcccccgcgccucccucauccccgacgccacccaccucggcccccaguucugcaaguccugcugguucgagaacaagggccucgucgagugcaacaaccacuaccucugccucaacugccucacccuccuccucuccgucuccucccgcugccccaucugcaagaugccccuccccacccgccuccgccccuccgucguccccaccgcccccuccgccggcgccggcgacggcacccgccccccccccuacucccccuga

SEQ ID NO: 4058 - RNA, 300 nt, Artificial Sequence
  derived and/or modified CDS sequence (opt2) from Lassa virus__ANH09755__Z
augggcaacaagcagaccaagaccaucaagaagaccgacuccccccgcgccucccucauccccgacgccucccacaugggcccccaguucugcaaguccugcugguucgagaaccgcggccucgucgagugcaacaaccacuaccucugccucaacugccucucccuccuccucuccgucuccaaccgcugccccaucugcaagaugccccuccccaccaagcuccgcgccucccccucccccaccgcccccuccauccgcgaggccaacaucaccaaccccccccccuacucccccuga

SEQ ID NO: 4059 - RNA, 300 nt, Artificial Sequence
  derived and/or modified CDS sequence (opt2) from Lassa virus__ANH09759__Z
augggcaacaagcagaccaagaccaccaagaagaccgacuccccccgcgccucccucauccccgacgccucccacaugggcccccaguucugcaaguccugcugguucgagaaccgcggccucgucgagugcaacaaccacuaccucugccucaacugccucucccuccuccucuccgucuccaaccgcugccccaucugcaagaugccccuccccaccaagcuccgcgccucccccucccccaccgcccccuccauccgcgaggccaacaucaccaaccccccccccuacucccccuga

SEQ ID NO: 4060 - RNA, 300 nt, Artificial Sequence
  derived and/or modified CDS sequence (opt2) from Lassa virus__ANH09761__Z
augggcaacaagggcaccaagcccacccagaacuccgagcccucccgcgccaaccucguccccgacgccuccuaccucggcccccaguucugcaaguccugcugguucgagaacaagggccucgucgagugcaacaaccacuaccucugccucaacugccucaccaugcuccucuccgucuccaaccgcugccccaucugcaagaugccccuccccaccaagaucaaggccuccggcucccccuccgccccccccaccgaggccaacuccgccgucucccccccccccuacacccccuga

SEQ ID NO: 4061 - RNA, 300 nt, Artificial Sequence
  derived and/or modified CDS sequence (opt2) from Lassa virus__AMR44579__Z
augggcgcccgccagaccaagcagccccagaucgagggcuccccccgcgccucccucguccccgacgccucccaccucggcccccaguucugcaaguccugcugguucgagaacaagggccucgucgagugcaacaaccacuaccucugccucaacugccucucccuccuccucuccgucuccaaccgcugccccaucugcaagaugccccuccccaccaagcuccgcgucuccuccgcccccuccgccccccccgccgccaccgcccagcccggcacccccccccccuacucccccuga

SEQ ID NO: 4062 - RNA, 300 nt, Artificial Sequence
  derived and/or modified CDS sequence (opt2) from Lassa virus__AMZ00378__Z
augggcaaccgccagaccaaggccaccgaggccaaggacuccccccgcgccucccucauccccgacgccacccaccucggcccccaguucugcaaguccugcugguucgagaacaagggccucgucgagugcaacaaccacuaccucugccucaacugccucacccuccuccucuccgucuccucccgcugccccaucugcaagaugccccuccccacccgccucaaguccuccaccaaccccaccgcccccuccgccaagaccgaguccuccaucaaccccccccccuacucccccuga

SEQ ID NO: 4063 - RNA, 300 nt, Artificial Sequence
  derived and/or modified CDS sequence (opt3) from Lassa virus__ADY11072__Z
augggcaacaagcaggccaaggcucccgagagcaaggacuccccuagagcaucucugaucccagaugccacccaccucgggccgcaauucugcaaaucauguugguuugaaaauaagggacuuguggagugcaacaaucauuaccuguguuugaacugcuuaacacugcuacucagugucagcaauaggugucccauuugcaaaaugccucugccaacuaaacuucggcccuccgcggcuccuacggccccacccaccggugcagccgacucuauacgcccuccaccguauucgcccuga

SEQ ID NO: 4064 - RNA, 300 nt, Artificial Sequence
  derived and/or modified CDS sequence (opt3) from Lassa virus__AAO59514__Z
augggcaacaaacaggugagaagcaugaagaaggucgacucccccagggccucucugaucccugaugcuucacaccucgggccacaauucugcaaaaguuguugguuugagaaucggggacuuguugaaugcaacaaucauuaccuguguuugaacugcuuaagccugcuacucuccgugucuucgcgcuguccgauuugcaagaugccccugccuacuaaacuuaagacaucaacuacgccaaccgcacccagcauacgagaggccaauacaaccaguccuccacccuauuccccuuga

SEQ ID NO: 4065 - RNA, 300 nt, Artificial Sequence
  derived and/or modified CDS sequence (opt3) from Lassa virus__AAO59508__Z
augggcaacagacaggccaagaaucccgagguggaaaacagcccuagggcuucccugaucccagacgcaacccaccucgggccgcaauucugcaaaucuuguugguuugagaauaagggacuugucgaaugcaacaaucauuaccuguguuugaacugcuuaucacugcuacucaguguuagcaaucggugucccauuugcaaaaugccucugccaacacgccuucgacccacuacgaccccuacagccccacagauaaucaaggagaacacuaccaaucccccuccauauacaccguga

SEQ ID NO: 4066 - RNA, 300 nt, Artificial Sequence
  derived and/or modified CDS sequence (opt3) from Lassa virus__AAO59510__Z
augggcaacaagcagaccaaggcccccgaggcuaaggacagcccuagagcaucccugaucccagaugccacauaccucgggccgcaauucugcaaaucuuguugguuugaaaauaagggacuuguggagugcaacaaucacuaucuguguuugaacugcuuaacucugcuacucucagucaguaauaggugucccauuugcaaaaugccucugccaacgaaacuucggcccagcgcggcuccuaccgccccacccgccggugcagcucauuccgcacgcccuccaccguacucucccuga

SEQ ID NO: 4067 - RNA, 300 nt, Artificial Sequence
  derived and/or modified CDS sequence (opt3) from Lassa virus__AAT48997__Z
augggcaacaagcaggccaaggcucccgagaccaagaauagcccuagagcaucccugaucccagacgccacacaccucgggccgcaauucugcaaaucuuguugguuugaaaacaagggacuuguggagugcaauaaccauuaccuguguuugaauugcuuaacucugcuacucucagucaguaacaggugucccauuugcaaaaugccucugccaacgaaacuucggcccagcgcgguuccuaccgcuccacccgcccaggugggugaucgcacacgaccuccaccguauucccccuga

SEQ ID NO: 4068 - RNA, 300 nt, Artificial Sequence
  derived and/or modified CDS sequence (opt3) from Lassa virus__AAT49005__Z
augggcaacaagcaggcaaaagcucccgagaccaaggacagcccuagagcaucccugaucccagaugccacacaccucgggccgcaauucugcaaaucuuguugguuugaaaauaagggacuuguggagugcaacaaucauuaccuguguuugaacugcuuaacucugcuacucucagucaguaauaggugucccauuugcaaaaugccucugccaacgcggcuucgccccagcgcgguuccuaccgcuccacccgccccugccggugaccgaacaaagccaccgcccuauuccccuuga

SEQ ID NO: 4069 - RNA, 300 nt, Artificial Sequence
  derived and/or modified CDS sequence (opt3) from Lassa virus__ADU56612__Z
augggcaacagacagaccaggcccacagaggccacugaacaaagccgggcucaccuggugccugacgcaucccaucucgggccacaguucugcaagucuuguugguuugagaaucgcggacuugucgaaugcaacaaucacuaccuguguuugaacugcuuaucacugcuacucaguguuagcucccgauguccgaucugcaaaaugccccugccuacgcgucuuaaggccucugcgcagccaucggcucccccuaccgaggccccacagaauacaacucccccuccauauaccccguga

SEQ ID NO: 4070 - RNA, 300 nt, Artificial Sequence
  derived and/or modified CDS sequence (opt3) from Lassa virus__ADU56616__Z
augggcgggaagcacaccaaacagcccagagagagcaacuccccuagggccucucugaucccagacgcuacacaucucggaccgcaauucugcaagucauguugguuugaaaauaaaggucuuguggagugcaacaaucacuaccuguguuugaacugcuuaagucugcuacucagcgucuccaaucggugucccauuugcaagaugccucugccaacucgccuucgaacgucuaccaaccccacagcaccucagguugaacagacuggcccagccucgcccccuccauauucaccguga

SEQ ID NO: 4071 - RNA, 300 nt, Artificial Sequence
  derived and/or modified CDS sequence (opt3) from Lassa virus__ADU56620__Z
augggcgggaagcacaccaaaccccagagagagagcaacuccccuagggccucucugaucccagacgcuacacaucucggaccgcaauucugcaagucauguugguuugaaaauaaaggucuuguggagugcaacaaucacuaccuguguuugaacugcuuaacucugcuacucagugucagcaaucggugucccauuugcaagaugccucugccaacgcgccuucgagcauccaccaaccccacagccccucagguugaacaggugggcccaacuaaucccccuccauauucuccguga

SEQ ID NO: 4072 - RNA, 300 nt, Artificial Sequence
  derived and/or modified CDS sequence (opt3) from Lassa virus__ADU56624__Z
augggcaacagacacgccaagagcaccaaaguggacgagcaucagagggcucaccugguccccgaugcaucccaucucgggccucaauucugcaagucuuguugguuugaaaaucggggacuuguugagugcaacaaucacuaccuguguuugaacugcuuaucacugcuacucagugugagcucccgcuguccaaucugcaaaaugccgcugcccacaaaacuuaaggccgcggcucagccuucugccccaucgacugaagcaauucagaauacgacacccccuccauauacccccuga

SEQ ID NO: 4073 - RNA, 300 nt, Artificial Sequence
  derived and/or modified CDS sequence (opt3) from Lassa virus__ADU56628__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccaccaaacuuaaggccgcggcucagccuucugccccaucgacugaagcaauucagaauacgacacccccuccauaugcccccuga

SEQ ID NO: 4074 - RNA, 300 nt, Artificial Sequence
  derived and/or modified CDS sequence (opt3) from Lassa virus__ADU56632__Z
augggcaacagacaggccaagagcaccaaaguggacgagcaccaaagggcucaucugguccccgaugcaucccaccucgggccucaguucugcaagucuuguugguuugaaaaucggggacuuguugagugcaacaaucauuaccuguguuugaacugcuuaucacugcuacucagugugagcucccgcuguccaaucugcaaaaugccgcugcccacaaaacuuaaggccgcggcucagccuucugccccaucgacugaagcaacgcaggacaccacacccccuccauauacucccuga

SEQ ID NO: 4075 - RNA, 300 nt, Artificial Sequence
  derived and/or modified CDS sequence (opt3) from Lassa virus__ADU56644__Z
augggcaacagacagaccaaggcccccgaggcuaaagggagcccuagggcaucccugaucccagacgccacacaccucggaccgcaauucugcaagucuuguugguuugaaaauaaaggucuuguggagugcaacgaucauuaccuguguuugaauugcuuaacucugcuacucucagucaguagccggugucccauuugcaagaugccucugccaacgcgccuucgacccuccaccaacccuacagcgccacccgcucgugccgaaggcgggauaaauccuccaccguauucucccuga

SEQ ID NO: 4076 - RNA, 300 nt, Artificial Sequence
  derived and/or modified CDS sequence (opt3) from Lassa virus__AHC95545__Z
augggcaacaagcaggccaaggaccccaagaccgagagcuccccuagagcuucucugaucccagaugcaacacaccucgggccgcaauucugcaaaucauguugguuugaaaacaagggacuuguggagugcaacaaucauuaccuguguuugaacugcuuaagucugcuacucagcgucuccaauaggugucccauuugcaaaaugccucugccaacuaaacuuaagcccauaacgaccccuacagccccacagaucacucgggaaucuauuaccaaucccccuccauauacaccguga

SEQ ID NO: 4077 - RNA, 300 nt, Artificial Sequence
  derived and/or modified CDS sequence (opt3) from Lassa virus__AHC95547__Z
augggcaacagacaggccaaggaccccaaaguggagagcuccccuagggcuucucugaucccagaugcaacccaccucgggccgcaauucugcaagucauguugguuugaaaacaaaggacuugucgagugcaacaaucauuaccuguguuugaacugcuuaagucugcuacucagcguuuccaaucggugucccauuugcaagaugccucugccaacacgccuucgacccacuacgaugccuaccgccccacagauaaucaaagaagguacaacuaaucccccuccauauaccccguga

SEQ ID NO: 4078 - RNA, 300 nt, Artificial Sequence
  derived and/or modified CDS sequence (opt3) from Lassa virus__AIT17124__Z
augggcaacaaacaggugaagacccccgaggccaaggacagcccuagagcuucccugaucccagaugcaacacaccucgggccgcaauucugcaagucuuguugguuugaaaauaagggacuugucgagugcaacaaucauuaccuguguuugaacugcuuaacucugcuacucucaguugguaauaggugucccauuugcaaaaugccucugccaacgaaacuucggcccagugugaccccuacagccccacccacucgcgcggcugacagcauaggcccuccaccguauucccccuga

SEQ ID NO: 4079 - RNA, 300 nt, Artificial Sequence
  derived and/or modified CDS sequence (opt3) from Lassa virus__AIT17128__Z
augggcaacaagcaggccaagacccccgaggcuaaggacagcccuagagcaaaucugaucccagaugccacacaccucgggccgcaauucugcaaauccuguugguuugaaaacaagggacuuguggagugcaauaaccauuaccuguguuugaauugcuuaacucugcuacucucugucucaaacaggugucccauuugcaaaaugccucugccaacgaaacuucggcccagugcggcuccuaccgccccacccacaggugcagccgacagcauacgcccuccaccguauucccccuga

SEQ ID NO: 4080 - RNA, 300 nt, Artificial Sequence
  derived and/or modified CDS sequence (opt3) from Lassa virus__AIT17132__Z
augggcaacaagcaggccaaagcucccgaggcaagagacagcccuagggccucccugaucccagaugcgacccaccucgggccgcaauucugcaagucuuguugguuugaaaauaaaggacuuguggagugcaacaaucauuaccuguguuugaacugcuuaacacugcuacucucagucaguaaucggugucccauuugcaagaugccucugccaacuaaacuucgccccagcgcuacgccuaccgccccacccacagaagcagccgacuccauacgaccuccaccguaucgucccuga

SEQ ID NO: 4081 - RNA, 300 nt, Artificial Sequence
  derived and/or modified CDS sequence (opt3) from Lassa virus__AIT17136__Z
augggcaacaagcagaccaaggcccccgagagcaaaaauuccccuagagcuucucugaucccagacgcaacauaccucgggccgcaauucugcaagucauguugguuugaaaacaagggacuuguggagugcaauaaccacuaucuguguuugaauugcuuaacucugcuacucagugucagcaacaggugucccauuugcaaaaugccucugccaacgaaacuucgguccucugccgcgcccaccgcuccuccaacaggugccgcagauucgacuaagcccccuccauacucaccguga

SEQ ID NO: 4082 - RNA, 300 nt, Artificial Sequence
  derived and/or modified CDS sequence (opt3) from Lassa virus__AIT17140__Z
augggcaacaagcaggccaaggcucccgagccuaaggacagcccaagagcaucccugaucccggaugccacccaccucgggccccaauucugcaaaucuuguugguuugaaaauaagggacuuguggagugcaacaaucauuaccuguguuugaacugcuuaacacugcuacucucagucaguaauagguguccuauuugcaaaaugccacugcccacuaaacuucggccuagcgcggcuccaacggcacccccugccggugccguugacuccacccgcccaccgcccuauucuccuuga

SEQ ID NO: 4083 - RNA, 300 nt, Artificial Sequence
  derived and/or modified CDS sequence (opt3) from Lassa virus__AIT17144__Z
augggcaacaagcaggccaagacccccgagagcaaggacuccccucgcgcuucucugaucccagaugcaacacaccucgggccgcaauucugcaaaucauguugguuugaaaauaagggacuuguggagugcaacaaucauuaccuguguuugaacugcuuaacucugcuacucggugucaguaauaggugucccauuugcaaaaugccucugccaacgaaacuucggagcuccguugcccccaccgcgccuccaacaggcgcuguggacucuauaagacccccuccauauucgccguga

SEQ ID NO: 4084 - RNA, 300 nt, Artificial Sequence
  derived and/or modified CDS sequence (opt3) from Lassa virus__AIT17152__Z
augggcaacaagcaggccaagacccccgagacaaaggacagcccuagagcuucccugaucccagaugcaacucaccucgggccgcaauucugcaaaucuuguugguuugaaaauaagggacuuguggagugcaacaaucauuaccuguguuugaacugcuuaacgcugcuacucucagucaguaauaggugucccauuugcaaaaugccucugccaaccaaacuucggcccagcacagccccuacugcgccacccgcuggugccgcagacaacacccgcccuccaccguauucccccuga

SEQ ID NO: 4085 - RNA, 300 nt, Artificial Sequence
  derived and/or modified CDS sequence (opt3) from Lassa virus__AIT17162__Z
augggcaacaagcaggccaaggcuagcgaguccaaggacucucccagagcaucacugaucccugaugccacccaccucgggccacaauucugcaaaaguuguugguuugaaaauaagggacuuguggagugcaacaaucauuaccuguguuugaacugcuuaacacugcuacucagcgucuccaauagguguccgauuugcaaaaugccccugccuacuaaacuucggccaucuguuacgcccaccgcgccuccaacacgcacugcugacaacacccgacccccuccauauucgccguga

SEQ ID NO: 4086 - RNA, 300 nt, Artificial Sequence
  derived and/or modified CDS sequence (opt3) from Lassa virus__AIT17166__Z
augggcaacaagcaggccaaggcucccgaggcaaaggacagcccuagagccucccugaucccagaugcgacccaccucgggccgcaauucugcaaaucuuguugguuugaaacaaagggacuuguggagugcaauaaccauuaccuguguuugaauugcuuaacucugcuacucucagucaguaacaggugucccauuugcaaaaugccucugccaacgaaacuucggcccagcgcuaccccuacagccccacccacugaagcagccgacuccauagguccuccaccguauucucccuga

SEQ ID NO: 4087 - RNA, 300 nt, Artificial Sequence
  derived and/or modified CDS sequence (opt3) from Lassa virus__AIT17170__Z
augggcaacaagcaggccaaggugcccgagagcaaggacuccccuagagcuucucugaucccagaugcaacccaccucgggccgcaauucugcaaaucauguugguuugaaaauaagggacuugucgagugcaacaaucauuaccuguguuugaacugcuuaacacugcuacucaguguuagcaauaggugucccauuugcaaaaugccucugccaacuaaacuucggcccuccgccgcgccuacggcuccacccgccggugcagccgacucuauacgcccuccaccguauucgcccuga

SEQ ID NO: 4088 - RNA, 300 nt, Artificial Sequence
  derived and/or modified CDS sequence (opt3) from Lassa virus__AIT17174__Z
augggcaacaagcagaccaaggcccccgaggcuaaggggagcccuagagcaucccugaucccagacgccacacaccucggaccgcaauucugcaaaucuuguugguuugaaaauaagggucuuguggagugcaacaaucauuaccuguguuugaacugcuuaacucugcuacucucagucaguuccaggugucccauuugcaaaaugccucugccaacgaaacuucggcccagcgcgguuccuaccgcuccacccacaaaggccgaagauaauacucgcccuccaccguauucucccuga

SEQ ID NO: 4089 - RNA, 300 nt, Artificial Sequence
  derived and/or modified CDS sequence (opt3) from Lassa virus__AIT17178__Z
augggcaacaagcaggccaaagcuagcgaggcaaaggacucccccagagccucucugaucccugaugcgacccaccucgggccacaauucugcaaaucauguugguuugaaaauaagggacuuguggagugcaacaaucauuaccuguguuugaacugcuuaagucugcuacucagcgucuccucuagguguccgauuugcaaaaugccccugccuacacggcuucgcccaucgacugcucccacggccccuccagcacgagccggugacaauauaaagcccccuccauauucaccguga

SEQ ID NO: 4090 - RNA, 300 nt, Artificial Sequence
  derived and/or modified CDS sequence (opt3) from Lassa virus__AIT17182__Z
augggcaacaagcaggccaaagugcccgaggucagagacagcccuagggcuucccugaucccagaugcaacccaccucgggccgcaauucugcaagucuuguugguuugaaaauaaaggacuuguugagugcaacaaucauuaccuguguuugaacugcuuaacacugcuacucucagugaguagccggugucccauuugcaagaugccucugccaacuaaacuucgccccuccgccacgccuaccgcgccacccgcuggugccggcgacgggacacgaccuccaccguauucucccuga

SEQ ID NO: 4091 - RNA, 300 nt, Artificial Sequence
  derived and/or modified CDS sequence (opt3) from Lassa virus__AIT17186__Z
augggcaacaagcaggccaagacccccgagacaaaggacagcccuagagcuucccugaucccagaugcaacucaccucgggccgcaauucugcaaaucuuguugguuugaaaauaagggacuuguggagugcaacaaucauuaccuguguuugaacugcuuaacgcugcuacucucagucaguaauaggugucccauuugcaaaaugccucugccaaccaaacuucggcccagcguugccccuacagcgccacccgcuggugccgcagacaacacucgcccuccaccguauucccccuga

SEQ ID NO: 4092 - RNA, 300 nt, Artificial Sequence
  derived and/or modified CDS sequence (opt3) from Lassa virus__AIT17194__Z
augggcaacaagcaggccaaggcucccgagccuaaggacagcccaagagcaucccugaucccggaugccacccaccucgggccccaauucugcaaaucuuguugguuugaaaauaagggacuuguggagugcaacaaucauuaccuguguuugaacugcuuaacacugcuacucucagucaguaauagguguccuauuugcaaaaugccacugcccacuaaacuucggccuagcguugcgccaacggcucccccugccggugugguagacuccacccgcccaccgcccuauucuccuuga

SEQ ID NO: 4093 - RNA, 300 nt, Artificial Sequence
  derived and/or modified CDS sequence (opt3) from Lassa virus__AIT17198__Z
augggcaacaagcaggccaaagugcccgagagcaaggacuccccuagagcuucucugaucccagaugcaacccaccucgggccgcaauucugcaaaucauguugguuugaaaauaggggacuugucgagugcaacaaucauuaccuguguuugaacugcuuaacacugcuacucaguguuagcaaucggugucccauuugcaagaugccucugccaacuaaacuucgccccuccacggccccuaccgcgccacccacaggugcugccgacucuacucgaccuccaccguauucgcccuga

SEQ ID NO: 4094 - RNA, 300 nt, Artificial Sequence
  derived and/or modified CDS sequence (opt3) from Lassa virus__AIT17202__Z
augggcaacaagcaggccaaaacccccgagagcaaggacuccccuagagcuucucugaucccagaugcaacacaccucgggccgcaauucugcaaaucauguugguuugaaaauaagggacuuguggagugcaacaaucauuaccuguguuugaacugcuuaacucugcuacucagugucagcaauaggugucccauuugcaaaaugccucugccaacgcggcuucgccccuccgccgcgccuaccgcuccacccucuggugccgcagacucgacacgaccuccaccguauucacccuga

SEQ ID NO: 4095 - RNA, 300 nt, Artificial Sequence
  derived and/or modified CDS sequence (opt3) from Lassa virus__AIT17206__Z
augggcaacaagcaggccaaggcucccgaggcaaaggacagcccuagagccucccugaucccagaugcgacccaccucgggccgcaauucugcaaaucuuguugguuugaaaauaagggacuuguggagugcaacaaucauuaccuguguuugaacugcuuaacacugcuacucucagucaguuauaggugucccauuugcaaaaugccucugccaacuaaacuucggcccagcgcuacgccuaccgccccacccacagaagcagccgacuccauacgcccuccaccguaccgacccuga

SEQ ID NO: 4096 - RNA, 300 nt, Artificial Sequence
  derived and/or modified CDS sequence (opt3) from Lassa virus__AIT17214__Z
augggcaacaagcaggccaaggcucccgaggugaaggacagcccuagagcaucccugaucccagaugccacccaccucgggccgcaauucugcaaaucuuguugguuugaaaauaagggacuugucgagugcaacaaucauuaccuguguuugaacugcuuaacacugcuacucucaguuaguaauaggugucccauuugcaaaaugccucugccaacuaaacuucggcccagcgcggcuccuacggccccacccaccgguacagcagacuccauacgcccuccaccguauucucccuga

SEQ ID NO: 4097 - RNA, 300 nt, Artificial Sequence
  derived and/or modified CDS sequence (opt3) from Lassa virus__AIT17222__Z
augggcaacaagcaggccaaaacccccgagacaaaggacagcccuagagcuucccugaucccagaugcaacucaccucgggccgcaauucugcaaaucuuguugguuugaaaauaagggacuuguggagugcaacucacauuaccuguguuugaauugcuuaacgcugcuacucagugucagcuccaggugucccauuugcaaaaugccucugccaacccggcuucgccccucuacagccccuacugcgccacccgcugguguuggcgacucgaccucaccuccaccguauagccccuga

SEQ ID NO: 4098 - RNA, 300 nt, Artificial Sequence
  derived and/or modified CDS sequence (opt3) from Lassa virus__AIT17226__Z
augggcaacaagcaggccaagacccccgaggcuaaggacagcccuagagcaucccugaucccagaugccacacaccucgggccgcaauucugcaaaucuuguugguuugaaaauaagggacuuguggagugcaacaaucauuaccuguguuugaacugcuuaacucugcuacucucagucaguaauaggugucccauuugcaaaaugccucugccaacgaaacuucggcccagcgcgaccccuacagcuccacccgccggugcagccgacuccauaggcccuccaccguauucucccuga

SEQ ID NO: 4099 - RNA, 297 nt, Artificial Sequence
  derived and/or modified CDS sequence (opt3) from Lassa virus__AIT17230__Z
augggcaacaagcaggccaaggcuagcgacaaaaauucccccagagcaucucugaucccugaugccacccaccucgggccacaauucugcaagucauguugguuugagaacaagggacuuguggaaugcaauaaccauuaccuguguuugaauugcuuaacacugcuacucagugucagcaacagguguccgauuugcaaaaugccccugccuacuaaacuucggccauccgcgacgcccaccgcuccuccaacaggugccgcagacucuauacgcccucccccauauucgccguga

SEQ ID NO: 4100 - RNA, 300 nt, Artificial Sequence
  derived and/or modified CDS sequence (opt3) from Lassa virus__AIT17234__Z
augggcaacaagcaggccaaggcuagcgaggaaaagaacucccccagagcaucucugaucccugacgccacccaccucgggccacaauucugcaaaucauguugguuugagaauaagggacuuguggaaugcaauaaccauuaccuguguuugaauugcuuaacacugcuacucagugucagcaacagguguccgauuugcaaaaugccccugccuacuaaacuucggccauccgcgacgcccaccgcuccuccaacaggugccgcagauucuauacgcccucccccauauucgccguga

SEQ ID NO: 4101 - RNA, 300 nt, Artificial Sequence
  derived and/or modified CDS sequence (opt3) from Lassa virus__AIT17238__Z
augggcaacaagcagaccaaggcccccgaggcuaaggggagcccuagagcaucccugaucccagacgccacacaccucggaccgcaauucugcaaaucuuguugguuugaaaauaagggucuuguggagugcaacaaucauuaccuguguuugaacugcuuaacucugcuacucucagucaguaauaggugucccauuugcaaaaugccucugccaacgaaacuucggcccagcgcgaccccuacagcuccacccacugaagccgcagauuccauacgcccuccaccguaucgacccuga

SEQ ID NO: 4102 - RNA, 300 nt, Artificial Sequence
  derived and/or modified CDS sequence (opt3) from Lassa virus__AIT17242__Z
augggcaacaagcaggccaaagcucccgagagcaaggacuccccuagagcaucucugaucccagaugccacccaccucgggccgcaauucugcaaaucauguugguuugaaaauaagggacuuguggagugcaacaaucauuaccuguguuugaacugcuuaacacugcuacucagugucagcaauaggugucccauuugcaaaaugccucugccaacucggcuucgccccuccgcggcuccuacggccccacccaccggugcaacagacucuacucgaccuccaccguauucgcccuga

SEQ ID NO: 4103 - RNA, 300 nt, Artificial Sequence
  derived and/or modified CDS sequence (opt3) from Lassa virus__AIT17248__Z
augggcaacaaacaggugaaggcccccgaggcuagaaauagcccuagggcaucccugaucccagacgccacccaccucgggccgcaauucugcaagucuuguugguuugaaaacaaaggacuugucgagugcaauaaccauuaccuguguuugaauugcuuaacacugcuacucgguguuucaagucggugucccauuugcaagacuccucugccaacgcgccuucgacccagcgcgaccccuacagcuccacccgccggcgcaggggauaacacucguccuccaccguauucccccuga

SEQ ID NO: 4104 - RNA, 300 nt, Artificial Sequence
  derived and/or modified CDS sequence (opt3) from Lassa virus__AIT17252__Z
augggcaacaagcaggccaaggcucccgaggcaaaggacagcccuagagccucccugaucccagaugcgacccaccucgggccgcaauucugcaaaucuuguugguuugaaaauaagggacuuguggagugcaacaaucauuaccuguguuugaacugcuuaacacugcuacucucagucaguaauaggugucccauuugcaaaaugccucugccaacuaaacuucggcccagcacggcuccuaccgccccacccgccggugcagcugacuccacacgcccuccaccguauucucccuga

SEQ ID NO: 4105 - RNA, 300 nt, Artificial Sequence
  derived and/or modified CDS sequence (opt3) from Lassa virus__AIT17256__Z
augggcaacaagcaggccaaggcucccgagaccaaggacagcccuagagcaucccugaucccagaugccacacaccucgggccgcaauucugcaaaucuuguugguuugaaaauaagggacuuguggagugcaacaaucauuaccuguguuugaacugcuuaacucugcuacucucagucaguaauaggugucccauuugcaaaaugccucugccaacgaaacuucggcccagcgcggcuccuaccgccccacccguuggugcagccgacaacacacgcccuccaccguauucccccuga

SEQ ID NO: 4106 - RNA, 300 nt, Artificial Sequence
  derived and/or modified CDS sequence (opt3) from Lassa virus__AIT17260__Z
augggcaacaagcaggccaaagcucccgagcugaaggacagcccuagagcaucccucaucccagaugccacccaccuugggccgcaauucugcaaaucuuguugguuugaaaauaagggacugguggagugcaacaaucauuacuuguguuuaaacugccugacacuacuccugucagucaguaauaggugucccauuugcaaaaugccucuuccaacuaagcugcggcccagcgcggcuccuacggccccacccgccggugcaguugacuccacccgcccuccaccguauucucccuga

SEQ ID NO: 4107 - RNA, 300 nt, Artificial Sequence
  derived and/or modified CDS sequence (opt3) from Lassa virus__AIT17268__Z
augggcaacaagcagaccaaggcccccgaggugaaggggagcccuagagcuucccugaucccagacgcaacacaccucggaccgcaauucugcaaaucuuguugguuugaaaauaagggucuugucgagugcaacaaucauuaccuguguuugaacugcuuaacucugcuacucucaguuaguaauaggugucccauuugcaaaaugccucugccaacgaaacuuaagcccagcaccacaccuacugccccacccaccggcgcggcugauuccauacggccuccaccguauucucccuga

SEQ ID NO: 4108 - RNA, 300 nt, Artificial Sequence
  derived and/or modified CDS sequence (opt3) from Lassa virus__AIT17272__Z
augggcaacaaacaggugaagaccagcgaggccagagacucccccagggcuucucugaucccugaugcaacagaccucgggccacaauucugcaagucauguugguuugaaaauaaaggacuugucgagugcaacaaucacuaccuguguuugaacugcuuaacucugcuacucaguguuagcaaucgguguccgauuugcaagaugccccugccuacgcgccuucgaccauccgccaaccccaccgcgccuccagcugaaacaggugauucuacucgucccccuccauauucgccguga

SEQ ID NO: 4109 - RNA, 300 nt, Artificial Sequence
  derived and/or modified CDS sequence (opt3) from Lassa virus__AIT17278__Z
augggcagcaagcagaccaagacacccgaggugaaggacuccccuagagccucucugaucccagaugcuacucaccucgggccgcaauucugcaaaucauguugguuugaaaacaagggacuugucgagugcaauaaccauuaccuguguuugaauugcuuaacgcugcuacucaguguuagcaacaggugucccauuugcaaaaugccucugccaaccaaacuucggcccuccgcagccccuacagcgccacccgcucgcgccgcagacgauacucgaccuccaccguauucucccuga

SEQ ID NO: 4110 - RNA, 300 nt, Artificial Sequence
  derived and/or modified CDS sequence (opt3) from Lassa virus__AIT17282__Z
augggcaacaagcaggccaaggcucccgagccuaaggacagcccaagagcaucccugaucccggaugccacccaccucgggccccaauucugcaaaucuuguugguuugaaaauaagggacuuguggagugcaacaaucauuaccuguguuugaacugcuuaacacugcuacucucagucaguaauagguguccuauuugcaaaaugccacugcccacuaaacuucggccuagcgcggcuccaacggcacccccugccggugccguugacuccauacgcccaccgcccuauucuccuuga

SEQ ID NO: 4111 - RNA, 300 nt, Artificial Sequence
  derived and/or modified CDS sequence (opt3) from Lassa virus__AIT17286__Z
augggcaacaagcagaccaaggcccccgaggugaaggacagcccuagagcuucccugaucccagaugcaacacaccucgggccgcaauucugcaaaucuuguugguuugaaaauaagggacuugucgagugcaacaaucauuaccuguguuugaacugcuuaacucugcuacucucaguuaguaauaggugucccauuugcaaaaugccucugccaacgaaacuucggcccagcaccgccccuacagcgccacccgcugguacuauggacuccacccgcccuccaccguauucucccuga

SEQ ID NO: 4112 - RNA, 300 nt, Artificial Sequence
  derived and/or modified CDS sequence (opt3) from Lassa virus__AIT17290__Z
augggcaacaagcaggccagagcucccgaggcaaaagacagcccuagggccucccugaucccagaugcgacccaccucgggccgcaauucugcaagucuuguugguuugaaaauaaaggacuuguggagugcaacaaucauuaccuguguuugaacugcuuaacacugcuacucucagucaguagccggugucccauuugcaagaugccucugccaacucgccuucgacccuccgcuauaccuacggccccacccgcagguaccggcgacucuucgcguccuccaccguauucacccuga

SEQ ID NO: 4113 - RNA, 300 nt, Artificial Sequence
  derived and/or modified CDS sequence (opt3) from Lassa virus__AIT17296__Z
augggcaacaagcaggccaagacccccgagaucaaggacagcccuagagcuucccugauuccagaugcaacacaccucgggccgcaauucugcaaaucuuguugguuugaaaauaagggacuuguggagugcaacaaucauuaccuguguuugaacugcuuaacucugcuacucucagucaguaauaggugucccauaugcaaaaugccucugccaacgaaacuucggcccagcgccgcgccuaccgcuccacccgccggugcagccgacaucacacgcccuccaccguauucccccuga

SEQ ID NO: 4114 - RNA, 300 nt, Artificial Sequence
  derived and/or modified CDS sequence (opt3) from Lassa virus__AIT17300__Z
augggcaacaaacaggugaaggcccccgaggcuagaaauagcccuagggcaucccugaucccagacgccacccaccucgggccgcaauucugcaagucuuguugguuugaaaacaaaggacuugucgagugcaauaaccauuaccuguguuugaauugcuuaacacugcuacucgguguuucaagucggugucccauuugcaagaugccucugccaacucgccuucgacccagcacggcgccuaccgcuccacccgccggcgcaggggauaacacacguccuccaccguauucccccuga

SEQ ID NO: 4115 - RNA, 300 nt, Artificial Sequence
  derived and/or modified CDS sequence (opt3) from Lassa virus__AIT17312__Z
augggcaacaagcaggccaagacccccgagacaaaggacagcccuagagcuucccugaucccagaugcaacucaccucgggccgcaauucugcaaaucuuguugguuugaaaauaagggacuuguggagugcaacaaucauuaccuguguuugaacugcuuaacgcugcuacucucagucaguaauaggugucccauuugcaaaaugccucugccaaccaaacuucggcccagcgccgcgccuacagcuccacccguuggugccgcagacuccacucgcccuccaccguauucucccuga

SEQ ID NO: 4116 - RNA, 300 nt, Artificial Sequence
  derived and/or modified CDS sequence (opt3) from Lassa virus__AIT17316__Z
augggcaacaagcaggccaaagcucccgaggcaagaaauagcccuagggccucccugaucccagacgcgacccaccucgggccgcaauucugcaagucuuguugguuugaaaaccggggacuuguggagugcaauaaccauuaccuguguuugaauugcuuaacacugcuacucucagucaguagccgcugucccauuugcaaaaugccucugccaacucgacuucgucccuccgcugccccuacggcaccacccgccggugcuggcgauaacaccagaccuccaccguauucucccuga

SEQ ID NO: 4117 - RNA, 300 nt, Artificial Sequence
  derived and/or modified CDS sequence (opt3) from Lassa virus__AIT17320__Z
augggcaacaagcaggccaaagcucccgaggcaagaaauagcccuagggccucccugaucccagacgcgacccaccucgggccgcaauucugcaagucuuguugguuugaaaacaaaggacuuguggagugcaauaaccauuaccuguguuugaauugcuuaacacugcuacucggugucucaagucggugucccauuugcaagaugccucugccaacucgccuucgacccagcgcugccccuacggcaccacuggccgaagcuggcgauaacacccgucccccuccauauuccccguga

SEQ ID NO: 4118 - RNA, 300 nt, Artificial Sequence
  derived and/or modified CDS sequence (opt3) from Lassa virus__AIT17326__Z
augggcaacaagcagagcaaagcccccgaguccagagacucuccuagggcuucacugaucccagaugcaacccaccucgggccgcaauucugcaagaguuguugguuugaaaauaaaggacuuguggagugcaacaaucauuaccuguguuugaacugcuuaacacugcuacucagcgucuccaaucggugucccauuugcaagaugccucugccaacuaaacuucgccccucugccacgccuaccgcgccacccacacgagcugccgacucgauacguccuccaccguauucacccuga

SEQ ID NO: 4119 - RNA, 300 nt, Artificial Sequence
  derived and/or modified CDS sequence (opt3) from Lassa virus__AIT17330__Z
augggcaacaagcaggccaaagcucuggagagcaaaaauucccccagagcaucucucaucccugacgccaccuaccuugggccacaauucugcaagucauguugguuugaaaacaagggacugguggagugcaauaaccacuauuuguguuuaaauugccugacacuacuccugagugucagcaacagguguccgauuugcaaaaugccccuuccuacuaagcugcgguccucugcggcuccaacggcacccccuaccggugccgccgauggcacaaagccacccccuuacucgccauga

SEQ ID NO: 4120 - RNA, 300 nt, Artificial Sequence
  derived and/or modified CDS sequence (opt3) from Lassa virus__AIT17342__Z
augggcaacaagcaggccaaggcuagcgaggcaaaggacucccccagagccucucugaucccugaugcgacccaccucgggccacaauucugcaaaucauguugguuugaaaauaagggacuuguggagugcaacaaucauuaccuguguuugaacugcuuaacacugcuacucagugucagcaauagguguccgauuugcaaaaugccccugccuacuaaacuucggccauccacggcucccaccgccccucagacaggugcagccgacucuauacgcccacccccuuauucgccauga

SEQ ID NO: 4121 - RNA, 300 nt, Artificial Sequence
  derived and/or modified CDS sequence (opt3) from Lassa virus__AIT17346__Z
augggcaacaagcaggccaaggcucccgagaccaaggacagcccuagagcaucccugaucccagaugccacacaccucgggccgcaauucugcaaaucuuguugguuugaaaauaagggacuuguggagugcaacaaucauuaccuguguuugaacugcuuaacucugcuacucucagucaguaauaggugucccauuugcaaaaugccucugccaacgaaacuucggcccagcgcggcuccuaccgccccacccguuggugcagccgacuccacacgcccuccaccguauucucccuga

SEQ ID NO: 4122 - RNA, 300 nt, Artificial Sequence
  derived and/or modified CDS sequence (opt3) from Lassa virus__AIT17362__Z
augggcaacaagcaggccaaggcucccgagagcaaggacuccccuagagcaucucugaucccagaugccacccaccucgggccgcaauucugcaaaucauguugguuugaaaauaagggacuuguggagugcaacaaucauuaccuguguuugaacugcuuaacacugcuacucagugucagcaauaggugucccauuugcaaaaugccucugccaacuaaacuucggcccuccgcggcuccuacggccccacccgccggugcagcugacucuauacgcccuccaccguauucgcccuga

SEQ ID NO: 4123 - RNA, 300 nt, Artificial Sequence
  derived and/or modified CDS sequence (opt3) from Lassa virus__AIT17366__Z
augggcaacaagcagaccaagacacccgaggugaaggacagcccuagagccucccugaucccagaugcuacucaccucgggccgcaauucugcaaaucuuguugguuugaaaauaagggacuugucgagugcaacaaucauuaccuguguuugaacugcuuaacgcugcuacucucaguuaguaauaggugucccauuugcaaaaugccucugccaaccaaacuucggcccagcgcagccccuacagcgccacccgcucgcgccgcagacgauacucgaccuccaccguauucccccuga

SEQ ID NO: 4124 - RNA, 300 nt, Artificial Sequence
  derived and/or modified CDS sequence (opt3) from Lassa virus__AIT17376__Z
augggcaacaagcaggccaaggcucccgagagcaaggacuccccuagagcaucucugaucccagaugccaccuaccucgggccgcaauucugcaaaucauguugguuugaaaauaagggacuuguggagugcaacaaucacuaucuguguuugaacugcuuaacacugcuacucagugucagcaauaggugucccauuugcaaaaugccucugccaacuaaacuucgguccucuguugcgcccacggcuccuccaacccgcgccgcagacucgacacgacccccuccauacucaccguga

SEQ ID NO: 4125 - RNA, 300 nt, Artificial Sequence
  derived and/or modified CDS sequence (opt3) from Lassa virus__AIT17382__Z
augggcaacaagcagaccaagacaagcgaggugaaggacucccccagagccucucugaucccugaugcuacucaccucgggccacaauucugcaaaucauguugguuugaaaauaagggacuugucgagugcaacaaucauuaccuguguuugaacugcuuaacgcugcuacucaguguuagcaauagguguccgauuugcaaaaugccccugccuaccaaacuucggccauccgcagcccccacagcgccuccagcucgcgccgcagacgauacucgacccccuccauauucuccguga

SEQ ID NO: 4126 - RNA, 300 nt, Artificial Sequence
  derived and/or modified CDS sequence (opt3) from Lassa virus__AIT17386__Z
augggcaacaagcaggccaaaacccccgaggcuagagacagcccuagggcaucccugaucccagaugccacacaccucgggccgcaauucugcaagucuuguugguuugaaaauaaaggacuuguggagugcaacaaucauuaccuguguuugaacugcuuaacucugcuacucucagucaguagccggugucccauuugcaagaugccucugccaacgaaacuucgccccuccgcgaccccuacagcuccacccgccggugcaggcgacgggacucgaccuccaccguauucucccuga

SEQ ID NO: 4127 - RNA, 300 nt, Artificial Sequence
  derived and/or modified CDS sequence (opt3) from Lassa virus__AIT17396__Z
augggcaacaaacaggugaaggcccccgaggcuagaaauagcccuagggcaucccugaucccagacgccacccaccucgggccgcaauucugcaagucuuguugguuugaaaacaaaggacuugucgagugcaauaaccauuaccuguguuugaauugcuuaacacugcuacucgguguuucaagucggugucccauuugcaagaugccucugccaacucgccuucgacccagcgcggcuccuacggccccacccgcagaagccggcgauaacacccguccuccaccguauucccccuga
